United States Patent 12,642,819 (COMPOSITIONS AND METHODS FOR TREATING INFLAMMATORY BOWEL DISEASE) - sequence listing, part 109

SEQ ID NO: 58 - DNA, 2188510 bp, Collinsella aerofaciens
  modified_base (608216)..(608313): a, c, t, g, unknown or other
  modified_base (716856)..(716955): a, c, t, g, unknown or other
  modified_base (1423047)..(1423143): a, c, t, g, unknown or other
  modified_base (2079819)..(2079911): a, c, t, g, unknown or other
cccgcgtgatgcgcgaggagggcctcgaggtcgtctacaacaagaggcgcgcccggggctacagctcctacgccggcgaggtctccaaggcgccggagaacctcgtgagcaggaatttccacgccgacgagcccaaccggctgtggctcaccgacatcaccgagttcaggctcccgggcggcgagaaggtctacctgagcccgatcgtcgactgcttcgacgggatgcccgtcgcctggtcgatcgggctgcaccccgacaagcgcctcgcgaactcgagcctgctcaaggcctgcgcggcgaggccggcgggcgcgcgcacgacgatccactcggaccggggcggccactaccgctggccggagtggatcgggatctgcgaggagaacggcctgatcaggagcatgtccgcgaagggctgcagcccggacaactcggcctgcgagggcttcttcgggcgcctcaagaacgagttcttccactacagggactgggagggcgtgacggccgaggagttcatgggaaggctcgaggcctacctcgtgtactatcgtgaggagcggatcaagaagtccctcgggtggctgagcccgatggagtaccgcaggaagcttggatacgcctaggcgcggtccaagaaatcgtccgcacccccatagtagtagcattttgataaagcgatttagcaaaaacatcgcacttgacctgcttttttattgcagtggtatcttcataaggtaaccacctttacctaccgtttaccgccagttttagcacgtttaccaaaccgcgcaccctctgctcaagcctgcccaaaacccgccgtatagttccctcacggcccgcattcggcgggtcgattcgttaccacggtcgtgcgcgagagcgcatggaaggggaagtgtcgtgagcgattgcaagagggtttaccgttttggaaccgacgcccagggcacctgtgtcaccgagggcgacaagtccatgaacttcgcgcttggcggcaaaggcgctaaccttgccgagatgagccgtatcggcctgccggttcccggtggctttactattacctgccagacttgcgtcgagtactccggtgccggcaacgtgtggcccgagggtgcactcgatgagatcgttgctgccgaggcggacctcgaggcccgctgcggcaagaagctcggcgacgcctccgatccgctgctcgtgtcggttcgttcgggcgctccgttctccatgcccggcatgatggacacggtcctcaacttaggcctcaacgacgactccgttcaggggctcatcgcccagacgcaaaatccgcgttttgcttgggatagctaccgccgctttattcagatgttctccaacgtcgttatgggcgttgacgccgacctgttcgagaacgcgctgacccaggcacgcctggtcgccggcgtccgcgtcgactccgagctttcggccgaggatctgcaggagctcgtcgagacctttaagggcatcttctccgagaacgtcgatgcctccctgtatcccgagctcgaggtcgctgacggcaagcccgttttcccgcacgacccggagcttcagctacgccttgcaattcaggccgtctttggcagctggatgaacgagcgtgcctgcatctaccgcaagcagcatggcatttccgacgaactcggcaccgccgtcaacgtacaggccatggcctttggcaacaagggcgagacatctgcgaccggcgttgccttcacgcgcaatccggccgacggcaccaaggagttctacggtgattttttggttaatgcccaaggcgaggacgtcgtcgccggtatccgcaacaccgagcccatcgccgacctcaaggccaccccgggcctcgagtccgcaggcaaggagctcgagcgcgtcttcctgacgctcgaggatcactatcgcgacatgtgcgacattgagttcaccatcgagcagggcaagctctggatgctccagacccgcgtgggcaagcgaactgccaccgccgccctgcgcatcgccatcgagatggtcgaggagggtctgatcacccgcgatgaggctgtgagccgcatcgatcccgcgcagctcgaccagctcctgcacccacagttcgacgcctccaagaagtacgaggctctcgccagcggtcttaatgccagccccggtgccgccgtgggcgaggtcatgttctcgagcgacgacgccgtcgcgcgcgccaacgagggccacaaggtcattctggttcgttgggagaccaaccccgacgacctgaagggcatggtcgccgccgagggcattctgaccagccacggtggcaagacgagccatgccgccgttattgcccgcggcatgggtacgccctgcgtctgcggcgttgagcgcttccatatcgacgccgccgagaaggtcgtgcgcatcgagggcagcgaccgcgtgctgcatgagggcgatgtcatctccatcgacggcacccagggtatcgtcgtcgacggcgccgttgatctggtttcggccgagctcaccggcgacctggacaccatcctgtcctgggccgacgagattcgcctggacgagaccggcggccacgccaaccatgtgcgcgtcaacgccgacaaccccgaggatgccgcgctcgcgctcgagtttggcgccgaggccatcggcctgtgccgcaccgagcacatgttcctgggcgaccgcaagaacatcatccagagcttcatcctctccgatgatgaggccgtgaagcagcaggccctggcggacctgcttaaggttcagaccgaggacttcctggcgatgttcaagaccatgtccggtcgcgacgtagttgttcgcctgctcgatccgccgcttcatgagttcctggataatcctcgcgagctcgaggtcgccatcaccaagaaggaagccgctggcgccagcgaggaagagcttgccgtcctgcgtgcccgcctgcgccgtatcgatggcatggtcgagtcgaaccccatgctcggcctgcgcggcgtgcgcctgtccgttgtctttagcgatctgccactcatgcaggttcgcgccgtcgccacggctgccgctcgcctcatcaaggagggcgtcgatccgcgtcccgagatcatggtcccgctcgtctccatcacggcggagcatgtccagacccgcgaggtcatcgagcgcgtgatcgccgaggtttccgtcgaggagggcgtcgagctcaatattcccgtgggcacgatgctcgagctgccgcgtgcctgcatggttgccgacgagatcgcccatcatgctgacttcttctgctttggcaccaatgacctcacccagacgaccttcggcttctctcgtgacgatgccgaggccaagttcatcccgctgtacatgcacaagaagatcttgaaggacaaccccttcgagaccatcgactcggcggtgctggagctcgtgcgcatggccgtcgagaagggtcgcgccaccaaccccgacatgcactttggcgtgtgcggcgagcacggcggcgaccccaaatccattaagggcctgttcaacgtggccgatgtggactacgtgtcctgctcgccctatcgcgtgcccctcgcgcgcctggcggccgctcaggccaagctcgaggcgaagcgctccgcctaacgttttgggtttagacgcctagcgtagcccccttcatgccgcccgtctcattcgcgaggcgggcggttatcatgtgcgggttttgtctttttgtctgcgtaaaaaattgttcttgcagcagaaacccgcgcgtgtatactcgaatacgtttgttcaactacgtgccggccaaggtggtacggcacctctagaagagtaaggaattgcacatggattacatccgcgcaatcgagcgtcagcagatccgcgaggacattcctcaggttcgcgtcgccgacaacgtcaaggttcactaccgcattaaggaaggcgaccgcgagcgcatccaggtcttccagggcgacgtcatccgcatggccggcgccggtgcccgcgagaccttcactgtccgcaagatgtccttcggtgtcggtgttgagcgtaccttcccgcttcacagccccaagatcgccaagctcgaggtcgttcgtcatggtcgcgtccgtcgcgccaaactgtactacctccgcgacaaggtgggcaaggctgctcgcatccccgagaagcgctaagaagatcgcagcgtctgtccactcgtttggacgtaagggtcaccttcgggtggcccttctttttatctgatttgcatgcaaggagggcctggtatggccaatatgacgagctcggtttcggcatcgcaggttgccggcgagctggcgagtgccacgttcgaggagattcccgccctcgtggagcattatcgcgaggatccgcgccagcaggtgatcaaggcttgcgagcgtgcccttaagcgccatgccaaggagcttgccgagcgcgagcgcgtcaacggcatgtacgagcttatgcatgagctcggcggtgatggcgtggtcgtgggcgtcgacgaggtgggccgtggctcggtagcggggcccttgaccgtgtgtgccgtgtgccttccgatggagccgcgcatctggggcatcaacgattccaaaaagctcacgccggcgcgccgcgagctgctctcggttaagattgccgaggtggcgactgctatcggcttttgccatatcgctcctgcagatatcgatgagatgggtatggcccgcgccatccgcgctgccgttgcgggtgcggtggccgatacgggacttgaacccgactgcgtcctcatggatggcaaccccttgggcgccgttcccaatgagcgcgacgtggtgaagggcgatgccaagatcgcctgtatcgccgcggcatccatcatggcaaaggtcacgcgtgacgagatgatggtcgagtacgacgccgagtaccccgagtaccatctggccgaatcgaagggctatgcgagccccgagcacatcgaggccattcgaaaacatggactttgtccactgcatcgtgtgagcttttgcggaaactttctgcagactgagcgccttttctaggtcaattgtggagacagggacctctagggttttataaacctgctggtagcgggccgtatgcaacagcattgctgcgtacggccctttttttgacggcatttggtcagcttttggtttgcttcctgtacttacccgcatgaaaggtgccctcatcatcggggcaatgcagtgtgcgggaaaggagaccccatgagtgccgcaagcaaaaagagcaagacgcagcagctcaaggagcgttgggaaaacggcgagctcgactgcggggcgatgacgcccgagtttatcaagggactcagtccccgtgagctgggcatgctgggcgagctgatcaccatcgactactttaacgagcgcggctacaccttgctggagcagggttatcgttgcaccgagggcgaggccgatctggtgctgctcgatgagcttgacgatgtcgtggtgatggccgaggtcaagaccaggcgcgtcgccctggattgcaccacgcgggtctttcccgaggaggccgtggatgcccaaaagcagcgtcggtatcgccgtatcgcaagttgctatctcatggagcactatccgctcaaggcgatccgcttcgatgcagtgggtgtcaccattcgcggcgggcatatcgccgagatcgagcatcagtacaacgcgttcgattggcaggtgtcgtgatggcgttcgagacgtttgccgttcacgcggcctgcatccgcggcgtcgaggcgattcacgtcacggtcgaggtctcgcttgccggcggcgttccgggcattcagatgctcggcatcccgagtatggaggtgatggagtcacgcggtcgtattcgctgcgcgatgcgctccgccgggttcgagatcccgcgctcgggcattaccgttaacctggcacccggcgatatccgcaagaccggtagcggctttgacctgcccatcgccatcgcggttctagcggccgatgagcagattccccgtgacaacctcgatcgctgccttatcgcaggtgagcttggtctggacggtacggtgcttcccgtcaagggcgaggtggcgtttcagctattggctcgcgacatggggctgtcttttatcgccggcaggtccgaccagcatgtgccactcgcgggcgtagattgcggctttatcgaccatctgtctcagcttgctcacggcatgggcgatgccgcacggcactacttggattccgagggtgtcgaggcgacctttgagcccgagctcgactatgcagacgtgctggggcaggaagtcgctaaacgcggcatggcgcttgcggcggcaggagaactcggcttgctcatgatcgggtctccgggatcgggcaagacgatgctcgcacgccgtatgaccggcatcctgcccgagctttccgttgaggatcagcaggaggcactgtgcatccattcggttttgggtgagaacattgatggcttgttggcggggcaccgccccttccgcagtccccaccacagtatttcgaccgcaggccttatcggcggcgggcgcccggtgcacccgggtgagatcagccttgctcatggcggcgtgctctttttggacgagcttgccgagtttcccactggcgtgctgcagacgctgcgtcagcccatcgagcgtggctacgtgaggatcgtacgcgtcgacggggcttttaccttcccgtcgcgctttcagctgctggctgcgagcaatccctgcccctgcggctttttgggcgatcgcgaggtaccgtgtcgctgctcggcggcgatggtcgagcgctatcggtctaaactgcgcggtcccttggccgaccgtatcgacatgatgatcgatgtgacccgtcccgaccctcaagtgattatcgagggtgcggagggtatgtcgtcggccgagttacgtgactacgttgtgcgcggtcgtgcctttcgcgcctggcgcgagttccgtatggacgatgcggatgccgaggccgaggatgacgagacgcggtctattgacggcgtcgtttcgaccttcgagctcgatgatgctgccgagaaatgcgtacttggcctatccaaacgcacgcatctcacgggccgcggcatcgtacgcctggtgcgtatcgcgcgtacaatcgctgacgtcgccgagagcgagcaagtgacgcaggaccacgtgctcgaggcggcgatgtaccagggaaggagggaccaatgatagctgaggggaccttcgagctgcatccaggtgatgcgttgtatcccgagagcgttttggagctatctgatgtaccccagacgctctatgtgcgcggcaaccccgaggtgctttcgacgcccgcgctctccatcatcggtgcgcgaaaggcctcgccgtatggtcttgccgtggcagagcttgcggcgaaggtggcggttgaggcgggagtgacggtagtttcgggcggtgcggtcggttgtgaccaggcctcgggttgggctgcggtcaacgccggcggcaaacacgtcgtggtgctggggacgggcgccgacgtggtctacccgcgttcgagcgcggggcttattacgcgcacgctcgatacgggcggcgcggtcgtgtcgatctctccgtggggcatgggtccgcgcaagtttgcctttccgcgtcgcaatcgcgtgatcgcggccctgtcgcaagccctctttgtatccgaggcgggtatgccttccgggacgttttctacagccgaggctactatggatttggggcgcgaacttcttgccgtgccggggtcgatcctatcgcccgagtcgcgtggcacgaattacctcattgcgaacggtgcctgctgcattgtcgacgaggagtccatcgagatggctatctctcgcatatacggcaccctgcgctactcgcgccccgatgctcccggcattgccgacctgaatccaacacagcagaccgtgatgcatgcgctcatcgcctctccgctcaaggtcgacgacatcgcggcgctcgtctcactcgatgctgtcggcgtactcaaactcttgggttcgcttgaactcgagggccttatcgagcgcatgatggatggaaggtatgcgccctccaagtttgcccttcacgcccagacgcccttcggtcacaatggaaaacgtgtcaattagaaaggtgtttgtagatgcagttcgatcaggtgacggttatcggtggcggtctggcgggttcggaatgcgcgatccagctggcagaccgcgggtttgccgtaaagctgtgcgagatgcgcccccaggtgagctccccggctcaccataccgatcacctggcagagctcgtctgctccaattcgtttaagtcgacccgtccggattccgcggctggtttgctgaaggccgagcttgagcgcatgggttcagtcctgctcgactgcgcccatcgcgctgctgttcccgctggtggcgccctggcggtcgaccgtgttacattctccgagctcgtcgaggctgaggttgccgcccgccccaatatcgaggtcgttcacggcgaggtcacccagatccccgagggccacgtggtcattgccgcgggcccgctgtgttcaccggcgctgagcgaagaggtcatgaagctcgtcggtggcgacgcccttgcgttcttcgatgccgcggcgccgatcgtcgatgcctccacgctcgatatggacgtgctgttttcgcagtcgcgctacgaggagcaggggagcggcgactatctcaacgctccgctcaacaaggaggagtacgaggcctttatcgaggcgctcaccacggccgaccgcgtggtgctcaaggactttgagggcggcgatctgttccaggcctgccagcctgccgaggaggttgcgcgcaccggcaaggacgccattcgctttggcgccatgaagcccgtcggcctcaccgacccgcgtaccggacgtcgcccttgggcggcgattcagctgcgtgccgagaacaaggagaagaccgcctataacctggtgggcttccagaccaacctgacctttggcgagcagaagcgcgtcttccatatggtgccgggcctggagaacgctgagttcttccgctacggtgtcatgcaccgcaatacctttgtcgacgccccgcacgtgctcgatggcacctttgccgtgcccggtaccggcgtgcgcctggccggtcagatcaccggcaccgaggggtacatggaagccgtggcgaccggtctgctcgcggcgctcaacacctatgcagaggctatcggcgccgattccgtcgagttgccccgcgtgggcgccctgggcgcgctcgtgggctatgcgaccgatcctgccaccgtgggctaccagcccatgcatgtcaactttggcctggtgccgccgctcgaggacggtaagcgtcgcagcaagcgcgaccgctaccaggcctatgcggaccgtgcgcttgaggcccttgatgcctatctggccactcgccccgatctgtttggaggcgaccggtcatagcctttgacctgtacgatgccgtcgactcgtttatcgcctatatcgcacgtgtcgagggactttctcccaacacggtgacggcctatggctcgaggctggagcgctttgcttcctggtgcgagcgcgaggatatcgatgctttcgctgccgacgtgcgcaccattcgtcgctatcttgccgagctttcgcgtgaacaggtggctccccgaacgcttgcggcgcatctgtctgccattcgctcgctctatcggtggatgactgccgaggggattatcgagggtgatgcggtctcggcgatcgcatcgcccaagctgccgcgcgacctgccgggcgtccttacgacccagcaggtcgaggcgctgctcaagacgcctgatacctcgacgcccgcgggactgcgcgatgcggcgatgctcgagctgctctatgcctcgggtgctcgtatctctgagctcgcagcactcaatgtggagtccatcgcttggtccgaatgcacgctgcgcctgtggggcaaggggggcaaggaacgtatcgtccctctgtatcgtcgtgcgctcgaagtgacgcgtctctatattgaggaggggaggccggagttgctcgctcaggcaaagcgccgtgacctcgctaccgggccgcatccgctgcttgtatcggcgcgcggcaaccgcatgagcgccgccatgctccggcggcggttccatacgctggcgacgcgcgccggcattccggccgacatcgccccgcatgcgatgcgccatacctttgcgaccgacttgctcgagggcggtgcggacctgcgctcggttcaagagctgctgggtcatgcgagcctgtccacgacgcagatctacacgcatctcacacccgatcggcttaagcgggctgtggctcaagcccatccccgcggcgaatagtggctgggacgtcccgcgccgcactcaggtgtgtggttttgattgcgggttggcaggaggaagcattcctgctatcattcatcgggttgcttcacggcaacatgtttttatcacgcacgcgcggctacttcataccgtggtgcccgggctttggtagcacatgtccgggttggttttggaggatgaccccgcgcggaggcaaaccacaggaggtttaacatggctaccaagattaatatccgcaccctgctcgaggccggctgccacttcggtcaccagacccgtcgctggaaccccaagatgaagccgttcatcttcggtgagcgcaacggcatctacatcctcgacctcaagcagaccatcctcgacgccgaccaggcctacaccttcgtcaagaacgtcgccaagggtggcaacgtgctgttcgtcggcaccaagaagcaggctcaggaggccgtcaagaacgctgctgagcgcgccaacatgccttacatcaaccagcgttggctcggcggtatgctgaccaacttcgtcaccatccgctcccgcatcaaccgcatggaggagctcgaggccatggtcgaggacggccgcatggctgttctgcccaagaaggagcaggctgtgctcggcaaggagctcaccaagctccagaccaacctcggcggcgcccgcgacatgaagggtctgccccaggctctcttcgtcatcgacaccaagcgcgaggagaacgccatcaaggaggctcagcgcctgaacatccccgtcgtcgctctgatcgacaccaactccgatcccgacgaggtcgagtacggcatcccctgcaacgatgacgctatctccgctgtcacccttatgtgcgagctcatggctgacgcctgcctcgctggctccggcaaggagcaggtctccgaggccgagatggccgctgagcccaaggccgagtaaatcagtcttagttaattctttttcatctctttgaaaggaaccacaatggcccagattaccgccgctatggtcaagcagctccgcgagatgaccgactccccgatgatggagtgcaagaaggctctcgtcgaggctgacggcgacatggacgccgctgtcgacgttctgcgtaagaacggccttgccaaggctgccaagaaggctggccgtgagaccaacgagggcgctgtcgccgcgttcgtctccgaggatggcaagaccggcgctctgctcgagctctcctgcgagaccgacttcgttggctctaacgccaagttcaccggctttgcttccaaggtcgctgaggttgtcgctaccaccgagcctgctgacgtcgacgctctgctcgagaagccgatgggcgaggagaccgtttcctccgagctcaccgagatgattcacatcatgggcgagaacatgaagatctcccgcttcgctgcccgcaaggctgagaacggagcgctcgcttcttacatccacatgggtggtaagatcggcgtcctcgtcgagttcgccttcgagaaggctgagaccgctcaggctgaatccttcaagaccttcgctcacgacgttgcccttcaggttgccgccgtcgccccgatctgcgctacccgcgatcaggttccggccgagaccgtcgagcacgagaagcagatctacatggctcaggctgccgagtccggtaagcccgaggctatccaggagaagatggctgtcggccgtctggagaagttctacaagcagtccgtgctcaccgagcaggagttcatcaaggacagctccctcaccatcaagaagtacgctgagcaggtctccaaggagctcggcgacaccattaccgtcgttgcctttgaccgtctggtccgtggcgagtaaataagctcttgtagctggtaatgagcaggctgtgggttttactcacagcctgctttttcatggctcttatcagagcctttgatatcatattgagagtctaattaaaggaggatcgctttgtccgacatccgatataaacgcgtgcttcttaagctttccggcgaagcactgatgggcgacggccaatatggcatcgaccccaaggttaccgaccatcttgccaagcaggtcaaggagctgctcgccgttggccatgaggtcggcgtcgttgtcggcggcggcaatattttccgcggcatggcaggcgctgccggtggcatggagcgtgctcaggccgattatatgggcatgctcgcgaccgttatgaacgcgctcgccctgcaggatgccttcgagcacaacgatgttccctgccgcgtgatgagcgctatccagatgaacgagatctgcgagccctatattcgccgtcgcgccatcaaccacctttccaagggcaacgtcgttatctttgccgccggttcgggcaatccgtactttacgaccgacaccgccgcggctcttcgtgcgtgcgagatcggcgccgagattctgattaaagccaccaaggtcgacggcatctatgacaaggaccccgtcaagtgtgccgacgccgtccgctttgacaagatcacctatcacgaggttctcgtccgcggtctgcaggttatggattccacggctacggcactgtgccaggataaccgtatgccgattttggtcctcaacatcgatggcgaggacaccgtcaagcgcgcgctttcgggtgagcccgtcggcacgctcgtctatcaggaggattaagcatggcagagaacatcaccgcccatatggacaagtcgctcgagtccctcaagcataacttctccaaggtccgtaccggccgcgccaatgccaacattctgtccgacatcaccgtcgattattacggtgttcccacgccggtcacgcaggttgccgccgtcaagacccccgaggcccacatgctgctcatcgagccgtgggacaaggcgctcatcaatgctatcgtcaaggccatcggcgcttccgatctgggcattacccccaactccgatggcaccgtcgttcgtctgccgttcccggctcccaccgaggagcgtcgtcgcgagctcgtcaaggagtgccgcgagtacgccgagcaggccaaggtgtctatccgtaacatccgtcgcgacttcaacaacaagctcgagcgcgatgaggagctcaccgaggacgatgtccgtcgcgagcaggccaaggtccagaagcacaccgatgagtatgtcgccaaggtcgaggagcttctgaaggaaaaagaagccgaggtcatggagatctaaggtgcaatacgacgagcataaactggtcgagtactttgccgacgcccccgcgggcgtcggtttttccgaccttgacctcaataacattccgcaccatatctcgtgcatcatggacggcaacggtcgttgggccacatcgcgcggtcttgcacgcaccgagggccacaaggcgggtatcgtctcccttcgcgagattattaccgcctgcgtgcgtctgggcgtcgacgtgctttcggcctatgcgttttctaccgaaaactggaaccgcccgcagcatgaggtcaacgtcttgatgcacctgtttgccaagacgtttatcgacgagctgccgcttctgaagcgcgaaaacgtgcgcgttatctttttgggtgacatttccgcgctgcccaagaagacccgcgacgtttttgaacgcggtcttgccgagtgcgccaatcacaccggcatgacgctggcgcttgccgtcaactacggcgcgcgtgccgagattacccgcgctgtccgtcagatcgcactcgacgctgccgccggtaagatcgatcctggcgcaattgatgacgacatggtggcttcccacctctataccgccggcctacccgatcctgagcttgtgattcgcacctctggtgagcttcgcctttcgaactacctgctgtggcaggtggcttattcagagttctacgtcaccgatacctattggcccgactttgatcgttggggccttgtcgacgccattttggcctatcagggccgtgaccgtaggtttggtggactgagcaagaccgaggaggcttaatcgtgtctgatcgtcccaaggcatctgctcccaagacgcctgcgcgcaaagctgccactgcgggagcgcctgcagcgaagagcggcaccggttcgtggctggcgggctttattacccgtgccgctgccggtatcgtctacgccgttgtctttatcctgtgcttggttttgggtattgtgcccacggccatctttgtttctgtcatgagcggtctgtgctgctatgagtttttccgtatgacgaggctcgatggcaagatggctaacgagcgcatgggtatcgctgccgccgtactctttccgctgtcggcgttgggcgattcaatgttgctgaatgccctgctttttgccctgatgctcgctgtgggcatttggtatgtctggtcaccgcgtacccgcatctctgatgtggccgtgacgctcatgggtcccatctacactggctttatgctgtcggctatcgtgctgctgcgcgatgccgtgcccggttttgccggcgccctgctttcggtgggcgtttgtgcgtccctttgggtctccgattcgtttgcctacatcgtgggcagccgtatcggtaaacacaagatggttcccaagatttctcccaaaaagagctgggaggggtttgtcggcggcatcctgggctcggttttgatttggctcatcctgtgggcgacgcatttctacaagctcagcctgccctatgcgctgctgtgcggcgtggtcgtgtccattttgggcgttatcggcgaccttatcgagtctcgcatcaagcgcggtgtgggcgttaaggattccggtaaccttatcccgggccacggcggcatgctcgatcgtagcgattcgcttatcttcggctgcatcacagcgcagctgatgctgatgatcggaggcgtgctgtaatgtcattccagacgacgtatggctccgatggacgtctccgtgttgccatcctgggctgtacgggctctatcggcactcaggcgctcgatgtgtgccgtcagcatgccgatcgcctgcaggtgacggcgctatccgttaactccagtacctccgagctcgttgccgctgcccgcgagttctcggttccggcggttgccgtggccgatgtcgctcatggcgatgacgccgtgctgcaggagttgcccgagggaacgaagctcggcgttggcgcgcaggcggtttgcgagctcgcgcgtcgcgacgatgtcgactgcgtgctcgtcgctattgtgggtgccgccggtctcgaggcgagccatgcggccttgacctcgaataagcgtcttgcccttgccaacaaggagtccctcgtcgtcggtggcgacttgcttatgccgttggcgcaaccgggccagcttattccagtcgactctgagcactccgccatctaccagtgctatctgggggagagcccgcgcgaggctcattgtatttggctcacctgctcgggcggtccgttctttggccgcacgcgcgacgagctagatcgcgtgacgcgtgccgatgccctcgcacatcccacgtgggccatgggtgctaagatcaccatcgactccgccaccctcatgaataagggcttggagcgcattgaggccatgcatctgtttaactgcgacctcgatttcattaacgtggtcgtgcagcgtcagtccaagattcactctatggtcgagtttgccgacggctccgtgatggcgcatctcggtgcttccgacatgcgtattcccatccagttcgcgttctcgtatcccgagcgttgggataccccggcgcctcgtatcgatttccgcgagctggggcagctcacgtttgatgctgccgacatgaataccttccgctgcctggcgctggccgagcgtgccggcaagacgggcggcaccatgccgtgcgtgcttaatgcggccaacgaggtcgctgtcgatgcgttcttacacgacggctgtagctttaccgatatcgaccgcgttgtggaatcctgcatggatgcgcatgacacacaggcggttacctcgtttgagcagcttcgcgacatcgatgcctgggcgcgcgaaaaggccgctctggtgctcgccgcaacccattcctaaccataaggatttctttttcgatttatggatactgttctgagcgttctctcatcggtcttttggggccttctgatgctttccgtcctcgtgtttttgcacgagggcggccactttttggcggcgcgtgcctgcggcgtccgtgtgaccgagttctatttgggcctgccgtgccgttttgacatccatcacacgtcgcgtcgcatcggaaccaagtttggcgtgacgccgctgctgctgggcggctatgctgccatctgcggcatggatcccacggacgtctcgtgtgccgattgcgtgcttgcggcaatctatcgtcacggtcgcgtgaccgtggccgaccttgccgccgagctcgaactgcccgaggaggacgtactcgaggcctgtgccttgctgctggggtggggttccatcgctccctggtacgaggagggggagaaaccctcgccgagttattaccccaccaagtaccagacgctgccgcgcgatgctgcaggatataccacctttgacggtcgcaagttcgatcgagagcatgcgactgccgagggcgatgtatgggaactgccgtgcggcgaggctgaattcctcgcacgcgagcgctcgcacacctatttgggccaaggctttctcaagcgagcctttatgttgctcgcgggcattgtcgtcaatatcctgacgggctttttgctccttatgagcatctattccatcgcaggtgtcgcggtgccgttggataccaatgtgatcggtcaggttgacgaaggctcgattgccgccgcggcgggaatcgagggcggtgacgcgatcctttcggtcgacggagtatcgtgctctacctggatagacgtttacgacgccatcggcaaggctgccggtaaggacgatatcgccatcgagtacgagcgtgatggcaagcagcattcgaccacggttgcactcaaagaggacgagcgcctaggtgtgtacgcctctacgcaggtggtccgtttggaccccatcacgtcggctcgcctgtcgttctcctatgtcgtgcagacagcggagggcgtgatgcgcctgctccagccgcagcacacgatggagattctcgaccagtcctcttcgatcgtgggtattagcgttatgtcctcacaggctgctgctgccggtcctgccacgttcctctcgtttgccgccctcatttcgttctcgcttggctttatgaacctgctgcccatcccaccgctcgatggcggcaagctggtcatcgagatcattcaaaagattgcgggccgcgagcttccgctcaaggtccagacgattgtgagctatgtgggcatcgcgctctttgcgctgttgtttgtctatatgcttcgttccgacgtccttcgatttattttgtaggggagtgtttggattgtctttatcccatcctttgcctcgcgagctgacgcgccccgtgcatgtgggcggcgtgcagatcggtggcggcgcgccggtggtggtccaatccatgacctgcaccgataccgctgatgcccaggcaacgcttgcgcaagtgcgcgcgttggcgcaggctggctgcgatatcgtgcgcgtgagcgtgcccaccgaggccgcgcttgagggtttccgcaccatctgtgccgagtctccggtgccgattgtcgccgacatccactttaaccataagctcgccattggtgccgtcgaggccggtgctgccaagctgcgcatcaaccccggcaatatcggcgattgggccaaggttgacgcggtgatcgatgctgcgggtgccgcgggctgcgcaattcgtatcggcgtcaatgccggttcgcttgagcaggatatcgccgagcgcgaagacctcacgcagcccgaaaagctcgtgatgtcgagcgagcgtttcgtcaagcattttgaagaccgcggctttacgaacattgtgctttcagccaaggcccacagcgtgcaaacgacgctcgatgcctatcgagccctgtcgcgtgagattccccacgttccgcttcacctgggcgtaaccgaggcaggtaccaagctgcagggcaccatcaagagctcggtgggccttggtatcctgctgtctgagggtatcggtgacaccatgcgcgtctcgctcacggccgatccggtcgaggagccgccggtcgcctggggcattttgcagtctctgggcctgcgtcgccgtggacccgagattgtctcgtgccccacgtgcgcccgctgccaggttaacctgattgcaatcgccgaggaagtaaccgagcggcttaagaactatgccgcgccgctttcgattgccgtcatggggtgtgccgttaatggccccggtgaggcttctgatgccgacctgggcgttgcttgcggacgtggtcaggctctgctcttttcgcatggccagatcattggtaaagtagctgaggaccaaattgtcgacgcgcttatggccgaggtcgacaagcttattgaggagaaataaatgacccgagcaatgtatatgtctaagctctatgcgccgacgctcaaagaggatccggccgacgccgagcttgcaagccatcgtctgctgcttcgtgccggtatgatccgcaaggaggccgccggtctgtattcctatctgccgctcgcttggcgctcgattcgtaagatcgagaacatcgtgcgcgacgagatggacgccgccggcgcccaggagctcatgatgcccattatggtcgatgccgagctgtggcgtgagtccggccgcatcgatgcctatggcaaggagctcgtgcgctttgacgaccgtcatggtcgcgagtttgtgctgggccccacgcacgaggagaccgtcacggccctggtgcgcaacgagctgcgctcctataagcagctgcccgtcaacctgtaccacattcaggacaagttccgtgatgagttccgtccccgctttggcctgatgcgcggccgtgagttcatcatgaaggacgcctacagcttctctgccacgcaggagagtctgcaggaggagtacgacaagatgaagcaggcctacgccaacatctgcgagcgctgctacatcaaggctctgcccgtcgtcgccgattctggcgagatcggtggcgatacctccgtcgagtacatggctttggctgacgccggcgaggcttcgctcgtctactgcgacgattgcggcttcgctgccgatgacgaggctgcaagcaccaaggtcgtcgtgaccgagggtcctggtgacggtacgctcaccaaggttgagactccgggcatgggcaccattgaggctgttgctaagttctttgggttccccgagaacggcacgcgcaagtcgctggcactcatcgacgccgagggcaagccggtcgtggccattgttccgggcgatcacgagctcaacgattgcaaggccgagcacgtctttggcaagggctatcgcatgatgaccgacgaggagcttcaggcgaacggtctgcacaagggctttatcggaccggttaacctgcccgatggcattcgtctggtgtgcgatgagagcctgcgcgagtccaagcagtgggcctgcggtgccaacgaggtcgattatcactttaccggtgcctgccccgagcgcgactttaccgtcgacgagtgggccgatctggtcaccgtcgtcgccggcgatccctgcccgcactgcggcaagccgctctctgctgctcgcggcatcgaggtttcccaggtcttccagctgggcaccaagtactccgaggccatgggtgctacctttatggacgaggacggcaaggagaagccgcttatcatgggttgctacggcgtgggcgtgtctcgctcgctcgctgccgtcgtggagcagcacaacgacgagcatggcatcgtctggccggtctccgttgccccgtacgaggttgcggtgattccgctcgaccccaagaaggaggagtgcgctaccgtttgcgaacagatcgttgatggcctgtgcgccgagggtatcgaggttgtcgtcgacgatcgcgatgagcgtcccggctttaagtttgccgacaatgaccttatgggcttcccgtatcaggtggtgctcggcaagcgtggccttaagaacggcaccgttgagctcaaggaccgtgccacgggcgagcgcgaggacgtggcgatcgacgaggtcgtcgccaaggtcgccgagcttgtgaaggctgcccgccgttaatcggcgatttcgcttgtagttcgatatacgggacggccccgcatttctccagataggggagatgcggggccgtccttttatcttgtcggcgcgctcaatcgctaaaaggaaaaaccccacagcccatgcgagctgcggggttttcctttgtgcctccgatgcgaaatgaatcgctcagatattactgataatcgacgacgtcgatccagttcttaaggaactcatcgttcacgttgcgcttacgagcgagctcggaagcggcaacgatgctcgtccactgacgcacgacctgcatgggcatgtcggcgcggtcgcagtagagctccaggtaggcctcggcctgatccttgctgttgagggcaaagagcaggtaggtggtggcaacgtcggcagcaggggagccctgggtggcgtgtgcccagtcgcagacgtacagctgaccgtcgtcgccgacgatgacgttggaggggttgaagtcgccgtggcaaaccttgaactccttggtcataccgtccagacgctcctgaaggttgtagcgcgtggtggcattgagctgatcaaggctgtcgatcatgcgggcgaacttgtcgcgctgacggttgagcagcggggaggtgtagccgtggatctcgatctggaggtcgacgaacatctcgaggtactcaccgaagcgctggggctcggcagtcatcttctcggcaagggtagtgcccggaaccttctcggtcacgagcgcccagccgttggcgttctcgagctgggaaacctcgagagccttggggctgcggatgccgcactcattgatgcgggcaagattcaaagcctcgttgaacacgtcggagacgggcttggtctcgttaaagaccttgacgatcttgtcgcccaggtcgtaaacgaccttgttgccacggcggacgagctcggtcttggaatcgggtagcagcatggttgcatcctttcaacgatgcgatagaagcgacggcgggggtgtgtgaaacacccgtgcacccccgccgttaaaaaccgtgctagaactagcagacggcgtaatcctgaggctctcggccgtagtaggcgtccaggtagagctccttgatctcgctcatgagcgggtagcgcgggttagcgccggtgcactggtcgttgaatgcctgctcggtcatctcgtcgagggtgtcgaggaagtacttctcgtcaacgccgtactcagcgatggtgtgcttgacaccgatgaagtcgcagagctcggtgagcttggtgatgaagttctcgaagacctcacggtcgtccttgccgtcgatgccgcagtaacgagccatctcggcgtagttgtgcagcgcgttggggtaaggatactgagagaaggttcccatcttgacaggagcctcggcggcgttgtaacgcatgacgcgggtcaggatgacggcgtttgcgaggccgtggggcagatggtggaaagcgccgagcttgtgggccatggagtggttgaggcccaggaaggcgttaccgaatgccataccggccatgcaggatgcgttgtgcatctcctcgcgagcgtgcggatccttggcaccgttggtgaaggagctcgggaggttctcgaagacgagctttgcggcgcgctcggagaggcccttggtgtaatcggaagccatgatggagacgtaggactcgatggcgtgggtcatgacgtcaataccggaagctgcggtgaggcccttcggggcggtcatgcagttgtcggcgtcgacgatagccatgttggggagcagcgcgtagtcggcgagcggccacttgatgccggtctccttgtcggtgatgatggcgaacggcgtgcactcggagccagtgcccgaagaggtcgggacggcgacgaagtaagccttcttgcccatctcggggaaggtgaagatacgcttgcggatgtccatgaagtccatggccatgtcctcgaagttcgcctcggggtgctcgtacatcatccacatgatcttgccggcgtccattgcggaaccgccgccgacggcgatgatgacatccggctcgaagagcgtcatctgcttggcgccgcgacgtgcgcactgcagggagggatcgggctcaacgtcgtagaagcagtcgtgagcgatgcccatctcatcgagcttggcctcgatggcacgcgtgttgccattcttgaagaggaactggtcggtaacgatgaaggcgcgcttcttgcccattacggtgccgagctcgtcgagcgcgacgggcgtgcagcccttcttgaagtagaccttctcgggtgcgcggaaccacagcatgttctcgcggcgctctgccacggtcttgacgttgatcaagtgcttcaccccaacgttctcggagacggagttgccaccccaggagccgcagcccagggttagagacggcttcatgccgaagttgtagaggtcaccgatgccgccgtgcgaggacggggtgttgatgacgatgcggcaggccttcatgacgtgctggaacttagcgatcttctcgctctgtgccgggtgcacgtagagagaggcggtgtggcccgggccacctgcgaggacgaggtgctctgccttgtcaacggcctcctggaagtccttggcgtgatacatagcgaggaccggggagagcttctcgtgggagaactcttccttctcgggatcggtggaggtgacctcggcgatcaggatcttggtcttggcgggaacctcgatgccggcgagctcggcgatcttggcggcagccatgccggggatgcggtgatcgagtgcgccgttcttgaacatggcggcacgcagggcgtccatctcggcaccctgcttgacgaagtagcagccgcgacgctggaactcagccttgacatccttgtagatggagtcgaggacggtgacggactgctcggaagcgcagatcatgccgttgtcgaacgtcttggagtggatgatggagttgacggcgagcttgatgtccgcggtatcgtcgatgatgaccggggtgttgccggcgccgacgccgagtgcgggcttaccggaggagtaagcagccttgaccatgcccgggccaccggttgcgagaatgatgtcgacgtcgcgcatgaccatgttggtcagctcgatggacggcttgtcgacccagccgatgatgccctcaggagcaccggccttgacagctgcgtcgagaacgagcttggcggcggcgatggtgcacttggcggctgccgggtgcggggagatgatgatggcgttacgggtcttcaggcagatgagcgtcttgaagatggccgtggaggtcgggttggtggtcgggatgacagcgccaacgataccgatcggctcggcgaccttggtgatgccgtaagcgtcgtcgcgctcgatgacaccgcaggtcttggtgttcttgtaagcgttgtagatgtactcagcggcgtagtggttcttgatgaccttgtcctcgagaacgccacggcctgtctcctcgatggcgagcttggccaaaggaatacgagccttgttggcggccatagcagcctcgtagaagatcttgtctacctgctcctgagtgtactcagcgaatttagcctgggcctcacgcatagatttgagtttggcctcaagcgcctccacgttgtccacgatggcgggagtagtgttttccggtgactttttcaccatttgtgtctccttgcgatcggagatttaccctacgccttgcatgatagcaagaaataattcggtaaacggtcagattcccgtaaaaggcatactaaaacgcttcaatcaaatgaaccgtttcaactaaattatgctacttagcgtaggaaagatcggatgctttgcgccttgtaggtgccctgaagccgtattggccagcatttggttccagagggtttttggcttaaaggcgtcgggttatcgagaacgacttttgcatattcatatgttagtagttgtcgtcttacgatcagttggtagtcaataaaccaaaaaggcgccctccgtaggggagggcgcctttggtaagttctatgtgaacgcgaggtctttgacccggagagtccgaggtacttgttggtaagaccttatttaggagcgcgcaaccttgccggacttgaggcaggtggagcaaacgttcatcttgcgacggtgaccgtcgacgacgacgtaaacgcgctggatgttggggcggaacttacggttggtgacgcggtgagagtggctgatggagcgaccggcaacggggtgcttaccgcaaacttcgcaaactttggacataactgaccctccttgggcgacaaacgaacatgtcgcgttaacaaacaagcctgaactatagcacagaagcagctccctgtgcgtaatctacacagagatatttctcttttggcgatagtgcccacgccacggccctggacgtagatccgatttgcgtgcagcagaggggattatgccagctcgcaacaaggttttcaagctcgtcccacaaatatatataggtttattgagcgttgggctccgtttacggattgctccgtatttatgctcgcaattaagctcgaggttggctacactatcccttgaccattaaaggggtacgagatacccacatggaattacatagctgccatagagcagcccttccttgtgggtgtctggtccgctttgagcggtcgggcatctatttttttgactgtgtcaacagtcaagacatgtgaggaaggagatcgatgggcacgacttcccccaaggcggtcatcatggacgagaccgccgtcaaccgagcgatgacccgcatcgcgcacgagatcctcgagcgcaacgagggctgtgaagacctcgctctggtcggcatcgtcacgcgcggcgaccttctggcaaagaagctcgccgaggcgatcaaggagatcgagggtgtcgacgttccgcttggcagcctggacatcagcttctatcgcgatgactatgcgaccaatttcgctcccgcgatccacgctaccaacattcccttcagcgtcgacggcaagcgcgtcgtgctggtggatgacatcctgtacacgggccgtaccattcgcgccgctctggacgccgtcatggatctgggccgtccgagccgcattgagttggcagttctcgttgaccgcggtcaccgcgagctccccatctcgccggactttgtcggcaagaacgttccctcgtcgcacgaggagaacgtgcacctatatatgaaggaagtcgacggccgtaccgctgtcgagatcaacgacgtcgcgccgggctcccacgtgggttctgcgccgctgggaggtgagtagtaccgtggcgttcaaccataagcacctgatcgacattaccgagtactccgaagaggacattaagctcatcctcgagaccgccaaggcgttctccgaggtcaacgagcgtgcgattaagaaggtccccacgctcaagggcaagaccatcgtcaacatgttcaacgagccctcgacgcgcacccgcagctccttcgagctcgccgagaagcgtctttcggccgacagcctcaactttggcggctcctcgacctccacggtcaagggcgagagccttgtcgacaccgtcgagaccctcaacgcctacaagatcgactgcatcgtcgtgcgcgacaagcacgccggcgcgccctacatcgtcacgcagaactcgcccgcgagcgttatctgcgccggcgacggcaagcacaaccaccccacgcaggccctgctggacctgtataccatctgggagcacaagggtgacttccacggtctgaaggtcgccgtcgtcggcgatatcgcgcactcccgcgtgtgcggctcgctgatccccgcccttaagatcatgggctgcgagacctacgccgtcgcccccggcacgctactgccgccggcgcccgaggtcctgggctgcgaccacgtgacgagcgacctcgattccgtcctgcccgagctggacgtcgtctatatgctacgcgtgcagcaggagcgcctcgagggcgcaccgttccccacgattcgtgagtaccacaagctcttcggtctgaccaaggatcgcgagaagctcatgaagcccgatgcgatcatctgccacccgggccccatcaaccgcggcgtcgagttcgactcctatatggccgaccacccgcaacgctccgtcatcctggagcaggtctacgccggcatctgcgtgcgtatggctatcctgtatctgctgcttggaggtgccgataatggccttgcttcttaagaacgcccacgtcgtcgatccgtccgtcgagcttgacggtgtcgtcgacgtcctgattgacggcgacaagatcgccgaggtcggcgagaacctcgccgccgagggagccgaggtccgcgacctttccggcaagtatctcgtccccggcctggtggatatgcacgtgcacctgcgcgagcccggctacgaggtcaaagaggatatcgagagtggcacccgtgctgctgccaagggcggcttcaccggcgtgtgcgccatgcccaacaccgatcccgtcaccgataacggcactgtcgtggagttcgtcaaggcccgcgctgccgaggtcggccactgccgcgtctatccgtcgggcgccatgacccgcggtcttaagggcgaggccatgtccgagatgggcgatatggtcgcccacggcgccgtcgccttcaccgacgacggtcgcggcgtgcagggcgcgggcatgctccgtcgctgcatggactacggcaagatgttcggcaaggtctttatgagccactgccaggacgaggatctggtcggccacggtcagatcaacgagggcaaggtctcgactcgtctggccctcgagggttggccggctgccggcgaggagcttcagatcgcccgcgacattgagatcgccaagctgaccggtgccaagctgcacatccagcacatctccaccgctcacggcctggagctcgtgcgtgccggtaaggccgccggtgtccaggtgacctgcgaggctaccccgcaccacatgttcctgaccgagaacgacctggacgagacctacaacacctcgctcaaggtcaatccgccgctgcgcaccgacgaggacgccgaggccatccgtcagggtgtcatcgacggtaccgtcgacgttatcgtcaccgatcacgctccccacaccccgtgggagaaggcccgcgagttcgagcttgcgccctttggcatgatcggtctcgagacctcgctgtcgctcgtgctcaccgagctggtcaacacgggcaagatgagcatggctcgcatggtcgagctcatggccatcaagccgcgtgagattctgggcctcgaccaggttcaggtcaaggcgggctccgttgccgacctgaccgtgttcgacccctccgcaacctggacggttggcgaggacggttacgagtcacgcgccgagaactccggttttgccggccgcacgcttaccggtcgtgccaccgatgtgtttgtcggcggtaagcagacgcttgccgacggctgcatctgctagcatagccttatcgcttttatgcgcggtgcccttgcggtgccgcgctttctattcgtttggaccatgcaaccgcatgggggattggagcgtctatgcccacaccttccactgcacgcatgcacgacttcgaggtcgtctcgaaccgggagattgccgacggcatcttctcgctcgtcatctcggcccccaagcttgcaagtgcgctcaagcccggtcagtttgtgaacatcgccgtacccggcgatgcgtcctcgctgcttcgcgtgcccctgagctactaccgcgccgacgccgaggccggcaccgtcgagctgtggtacgccgtcgtgggcgacgatacccgtcgtttgtcccagatgggccctggctccaagtccaacctgttgggccctggcggccgcggctggcttgttcccgagggcaccaggaaggcgctgctcgtggcgggcggcatcggtgttccgcccgtgctgtgcctcgccggcattcttgtcgagcagggcgtggatgtcgacgtttgcctgggctttggcaccgcttccaaggccgtgggtgtcgatgagttccgtgcgttgggcgccacggttaacgtgtgcaccgacgatggcacgctgggcacgcacggtttttgcaccgacccggcagccgagctgctcggcgagggcggctacgactatgtggccagctgcggccccgctgtcatgatgaagaaagtcgccgctgccgctgccgaggccggtgcgtactgcgaggtgtcgcttgagcgcatgatgagctgtggctttggcgcctgcaacacctgcaatgtcgaaacggtcgacggtatgaagggtgcttgcatgtgcggccccgtgttcgatgcttccaaggtggtggtcttctagtgggtaccgtgaacatggccgtcgatttcggcggcgtcaagatgcagaaccccatcaacaccgcagccggtacctttggctacggttggcagttccagaacttctttgatgtttcccagctgggcgccatcaccaccaagggttgcgctgccgagccctggcccggcaaccccgcgccccgcatggccgagattcccggcggtatgatcaactccgtgggccttcagaaccccggcgtggccgcctttgcccgcgagtccggtccgtggctcgagcagctctccaaggacggctgccaggtcatctgtcaggttgccggccactccgttgacgagtttgtccgcgcactcgagatgtatgtcgaactgtgcccctgggctgccggctacgagatcaacgtgagctgccctaatatcgccgccggcggtgccgccatgggctccacgcccgagggcgcctcttccgttatggctgcctgccgcaaggtgaccgataagccgctgttcgtaaagatggctccggttaacgttgccgagattgccaaggccctcgaggctgccggtgccgacggcctttcggtcatcaactccatccagggcatggccatcgacgtccatacccgcaagtcccgcgtggccaagcccaagggcggcctttcgggcccgctgtgccaccacatcgccgtgcgcatggtctgggaggttgcccaggccgtcgatatccccatcaacggtgtcggcggcgtcatgacgggcgaggatgcggccgagtttattctggccggcgccacctgcgtgtcggtcggcatggccaacttcgtcgatccgtgcgcttcgctcaagatcgcgcacgagctcgaggcctgggccgagtctcagggcgtgaaggacatcaacgaactggtaggtgcgttcgaatgctagagaccgatgcccgcgaccgtgttatcgtcgctctcgactgcgaccgtgagcgtgcgctcgagcttgcccacgagctttcgggccatgccgcctggctcaaggttggcatgacgctctattacgccgagggtcctgagatcgtcaagacgttcaaggatttgggctttaaggttttcctcgaccttaagttccatgatattccgcatcaggttcgcggcgccgcccgttcggcctcgcttgctggtgccgacctgctctcggttcacggcttgggttcgggcgccatgctcgctgcctgccgcgagggtgccgaggaggcgcgcgaggaccgcgccaagctcgtcgccatcaccgttctcacgagcatgaatcaggatgccttgagcgagatcggcgtcgagtcgcccgtgtccgaggaggccgcccgcctggcaaagctcgctcaggccaacggcatcgatggcatcgtgtgctcgccgatggaggctcacgacatgcgtgagctgctgggttctgatgccctgatcgtgactccgggcgtgcgtccggtgggtgccgcccttggtgaccagtcccgcgtggcgacgccttcccaggctatcgagcgcggcgcaagtcatattgtggtgggccgtcccatcaccggcgccgacgatccggttgccgcctttgacgccatcgtcgccgagctggtcgaaaacgtcgcgtaaaagattcccccaagtcaccacttttgggtctcattagcacaaaatagcccctgtgcctgcgtaaactttcccatcctttgtgtggaatcgcaggtcaggggcttaactttgggcgcagtatattgcactttttgcgggtatcgtctaacctatggagccgcgattgggcattttgtacgttctacgtgctaaaatgccaattattgaatcagatataacccaactacttggaggtacgaatggcactccctcagcttaccgatgagcagcgcaagcaggctcttgagaaggctgctgccgcacgtcacgcccgcgctgagcttcgcgagcagatcaagaagggcgagaagtccctcgagtccgtgctcaactccgatgaccccatcgcttcccgcatgaaggtttccaccctcatcgagtctcttcctggttatggcaaggccaaggccgccaagatcatggaggagctcggtatctccgctacccgtcgcgtccagggcctcggcgtccgtcagcgcgagcagctcctcgagcagctgaccaaataagtgagcgctcaggattccaagctctttgtgatttctggaccgtcaggcgcaggcaagggtacgctcgtcactcgtgtgcgcgagcgccgctcgaacctgggcctgacggtttcggctaccacgcgagcaccacgcaaaggtgaggtcgacggcgtcaactacttttttctgacgcgcgaggagttcgaccgccgcgtggcaaacggtgagtttgttgagtgggccgaggtccacggtaactgctacggcacgttggtgagcgaggtccagtccaagctcgcctctggttcgtctctgattttggagatcgatgtccagggcgccctgcaggtgaaggagcgtttccccgaggccgtgctgatctttatcaagccgccttcgcttgaggtgctccgcgagcgtctagtcggtcgcggtaccgagacgcccgagacgattgagctgcgtatggcaaacgccgccgatgagcttgcccttgccgaccgctacgacgacgtcgtggttaatgacgatctcgaccgcgcgaccgatgagctcgttcgcgttctcgatatgcatgaaaggatctgaggtccgtgtccgttgtaaagccttgcattgacgatcttctggagaagaccgatcacaaccgcttcctgctcgcttcgcttgcctccaagcgcgcctgcgacatcaatagcatgctgcgtggccagcacaaccgcgtgcttgccgtccaggatgtcgatgacatcaccatcgggctttccggtgccgataccatctcgatggctatggacgagattgtcgacggcgacatctcttacgacgaggcccgttacgagaaggcgctcggccacaaggttgctgaagcctaaatggcggctcgcgtctgcctggtccactatcacgaggttggactgaagggcaagaaccgcgcacattttgagcatatcctcatggataacattaaggcggctttggccgccttttccgtgaacgccgtgtctcgaatttccggttatatcctcgtgacctttaacgagcatcaggccgatgatgcggcgcgtgttattcgcaccgttcccggcgttgctcgtgtgtctttggcgtatcacactaaccgcgacccgcaggagtactgcgccgccgccgtcaaggcgctgcgcgagtttggttccttcgattcgtttaaggtgcacgctaagcgctccaataccgactatgagctcacctcgattgacatcaatcgtcaggtgggcgaggtgttgtgtgaggccttccccgataaaaaggttcaaatgcacgaccccgatgcgatggtgcacgtactggtggtccagggtagcgtttatgtgtacgcgcgctccgagcgcggcgtgggcggtctgccggtgggttctgccggcaaggtcgtgacgctgctgtcgtcaggtatcgattctccggtggcgacctggatgctcgcgcgtcgcggcgcggtgtgcgtgccggtacatttctccggtcgtccgcagacgcccgatacgagcgagtatttggtgcaggatatcatccgtgcgcttgagccgggtgtccagatcggccgcctgtacgtggtgccgtttggcgactgccagcgtgagatttcggtcacctgtcccagtaaccttcgcgtgatcatgtatcgccgcattatgtattcggttgccgagcgcatcgcgcatatcgagggcgctaaggccatcgttacgggcgaatcgcttgggcaggttgcctcccaaacgcttgagaacatcatggctgtcaacgaggccgtgaagatccccgtgttccgtcctctcatcggttcggacaagcaggagatcatcgcgcgcgccgaggagatcggtacgttcgatatctcgactgaggccgctcccgactgctgcacgctgtttatgccgcgccgtcccgagacgcacgctaaactcgatgccgtgcatgaggcctgggagttgttcgatcacgaggagatgatcgagcgcctgctcaagcagaccgagtacatcgacttcgagagcaacacgtataaggcccctaagaccttaaaacgcaaacattcggagcttgctccgcgtgagatttaccaagatcacgagtaattttgtgcatagaccgacgatgcgtctgcatcgtcggtcttttgctatctgggcattttgcggctaagtgttcatttgctgacgtgtgcctgaataaatggacagtatttcgcaaggttttggtcggcttttggtttgaccgcgaaaaccggttttggagaatggctgttgcaggactcttttcctgacacgatgttgttgggaggttttgctatggcgcagcgcgaacaacacgaacgggtcaaacggatggaccgcttggcggacaagctgctcggtcataaggcagtggtgatggcgatactggtcgtcattgcgatggcgagtggactggcgatggcgaaccttggcggcggtgccggcagtgtgtcgtttgagcacactgatggttcgggttcgttagtggagccgggatccggcgatgcctcgagcggaaagacatccgaaggctcttcgcctaaggcgtctgccgcggcagaggtttatgtcgatgttgatggcgccgttgtgtcgcccggtgtatatcgtctcaaggacggcgcgcgggtggctcaggcgattgatgccgccggcgggctggcgcccgaggcagacgttacggggctcaatcgggcatctaaggtcgtcgatggacagaagattcacgttccaacggtaggggagcagcaggcgtccattgcggaagctggtgttgatggtggggcttccgcatcatcgggcgtgagtggcgtaacaggcctagtaaatatcaatacggcaagcgcggcagagctgcagacgctctcgggcatcggtccctccatggcccagtcgattatcgatgagcggacaaagaacggtggttttgcctcggttgacgatctgatgcgtgtgtcgggaatcggcgagaagaagcttgccaaaatcaaagattccatctgcgtatgagtgcgaccgagcgcgagcatgtgatgcctccgcggcctctgatgccgtggacgatggccctgtgtgccggcatgtgcatgagctgcgccttggtgctcaacgtggccgccgatgcgctgctgtgggagcgggcttcggcggtcgggccgctatgggccattcccgttacggcggcggtattcgttgtgctggctcaatcttgtgcgcggcttgccccttggaagcggtggctgtatgccgcgtccgtcggtctcgtggcgggagcggtcgtctcggcgtggtgggctgtgggcgtgctaagcgcctcgaaggcgctcgacggtcgagcggcaagcagccttgagtttgtcgtgcagggtgacccatccataaacgacgacgtgtattcctatacctgcgaggcacgcacggacggtaagaacttggcaatggttcgcctatcgtgcgacctcgagctcaaggtcggggcgcacgtgcgtgttatcggtcgcgtttcacgttttgagaacgatgcgtatggacgatcgcgcgtgctccgaggcgaggtgcgcaaggttaaagtcgttcggattttgtcggtcgatgaagactctccggggccgctgcttcggctgcgaaatgggctgcttgcgtccatcgcgcctgcgaccgacccggcgcgtgcactcatagccggtgtcgtctgcggtcgttcggccgagctgcgcgcccagccggcgggcgactggttttcggtgacgggaacggcgcatcttatcgccgtctcgggcagccatttggcaatcgtggggtttgtaatcgagggtgtattgcaaaagactcggtgttcacgcggtcttcaacgggcgatattggcgataacgcttgtgggctacgctgcttttacgggcgcgtctccctctgccgtgcgcgcgtgctgcatggtgttcgcgacgcttgtcgtaaacggcgcggggcggcgccggcacggcgcatcggcactcttcgttaccatgtccatctttgtgttgctgcggccgacggttctgttcgagatgggctttcagctttcatgtgccagcgtcttagccattctgtgcttttgcccctatgcgacctacgctttgggtgagctgagtgttccgtcgggcgttgccagcatgctttccgtcacgctgtgctcgcaactggcgacacttcccattaccattcctgccttcggtacgttctcgctcattgctccgctcgcaaatgcggtcctcggtccggtggtgagcgcactgctcgccgtatcgatcgtgctggttcccttttcgctcctggcgccgttgcggacttgggcgctcgttgtgcccatgattgccgcccgttgcgcgctgttctttgagcagctgtttgccgccgtgccgggtgcatccgtgagcgtgccgcccgatagcatgtggatttacctagtgccgtgtttgctggcggttctgcttgtctggtggccgcgtccccgtgcacgtcctatggcggtggggcttgcatgcctggtgctcttggctgcgattccgtacgtctactgggatcgattcgctccgccttcggtgacggtgctcgatgtgggccaggccgatgcgattattattcgccagggcggcgcagtggcgctcgtcgactgcgggctcgacgagcgcgtggtggcggcgttggttcgcaataacgtgcaccatatcgatgccgtctttgtgacgcattgggatgaggatcactggggtggtctgcctgccgtgctcgaacagttttcggtcggtacgattgccgtggcggcggatgcgctggaggatgctcctgccgaggtattgaaccgacctggcgtggagtatcggcaggtgcgccgtggggatacggtcgatatcggctcattttgcgcccgcgtgatgtggccattcgagtccgtggatggcgagggaaatgaggactcgcttgtcctgctgctctcatatgttcaggaaggcaagggcctgcgtatgctcctcaccggtgatgccgagatcgaccaagaacgggaattcgtgcaggaggtgggggatatcgacgtacttaaacttgggcatcacggctctaaggtttcagtcgatgatgagttgctggacgtcctgaagcccgagctttccctcgcgagtgcgggcgaagggaatcgatacggccatccgtccgatgcctgcatcgatgccgttaaggaagcgggcggcgtgttcgcgtgcactatcgaacacggcgacattaccgtcacgccggctgcgaatggctttgcgatgcgatgccagcgaccgtgacgacgtcgttggcgtgtggtgggcccctgggctagaatggcacggagcgaatacgaaggcctgcgggaggggagcgcaatgtccgaaaccggtctgctgccggcatatctgattgtcggtaccgacggagtcaagcgcgatcacgccgtctcgcgtatgaaagcgcgtctggaaaagtcgggtatggttgagttcaacctcgacgagcgcgacatgaccaaggaccccgatatcgagtccattatcggatcgcttaacacctttccgatgggcagcgagtttcgcctggtaatccttgatggctgctcaaagctcgccaaggcggtctcggagccgcttgtcgagtatttggcgagtcccagccccacaacggtctgcctcatcattgctgactcgcttgccaagaacacgcgcctgtataaggcgatcgccaagatcgacaagaaggccgtgatcgattgctccggcaccaagcgctgggagcttccgcgccgcgtgcagcagatggcgacgcagcacggcaagtcgatctcgacggcggccgccgaggagctcgtctcgcgttcgggtgaaaacactcgcatgctcgataacgacttggctaagcttgcccagatggtcgaggcgccccagattgagcttgccgacgttgagcgctggattgtacgtacggccgaggttcaaccctgggactttctcaatgcggtctcggcccgtgacatgcgccgttcgctcgagctcttcaatctaatgcccgccaagagctacgtgtggacgtacacattgctgtgcggccgcattcgcgagcttatcgttgccaaggcgctcgatgcgcgcggacagggtcgtgagctggccgcaacgctcaagctccagtcctggcaggtcaagaatcacctgacctgggcacgtcgcttttcgatggcagagctcgtcgcagcgctcgagggtgccgttgatgtggagctcgcgctcaagggttcggccgattctgagaccgcgcttttactctggattacgaacatcttgagaaaatcgtgatgatacctgcctatttgacaaattcgttctatccctttgagggggagcgtgctatagtaggcgcttgcatgacctcaccgtgtctcagaggtgtcatacattttttgcaaggaactcgaaaggaactccagaagtggcaaacatcaagtctcagaagaagcgtatccgcaccaatgaggcagctcgcatgcgtaacaaggctgtcaagtccgagctcaagacgctgaccaagcacgtccagtccgccgtcgccgagggcgacgccgagaaggcccaggctgccctcaaaaccgtcaccaagcgtctcgacatggctgccgccaagcatgttatccacaagaaccaggcttccaaccgcaagtccggtcttgccaagctcgtgaacagcatcaacgcctaagttgtaaatttcacaccacacagattacgcgcataaatggagcctgttttatggaacaggctccattttttgtaccgctcgggtaagatagtccgcatgaatacttcaattgacatttcccacatccgcaacttctcaatcgttgcgcacatcgaccatggcaagtccacgatcagtgaccgtatcctcgaactcacccataccgtcgacgaacgcgacatggagtcgcagctgctcgacaccatggatatcgagcgcgagcgcggcatcacgatcaagtccaatgccgttcgcgtgtcctatgacgccgacgatggcgagacgtatcagttcaatctgatcgatacgccgggccacgtggactttacctatgaggtctcgcgctcgctggcagcctgtgagggcgcggtgctcgttgtcgacgccacgcagggcgtcgaggcgcagaccgtctccaacgcgacgctcgccatgaacgccaatctggacattgtgccggccatcaacaagatcgacctgccctcggctcatcccgacgaggttaagaccgagatcgaggatgacctggcgatccctgccgatgatgccgtgtgtgtctcgggcaagaccggcgagggcatccacgatctgctggagtccattgtctttctgatttctccgcccaagggcgatgcgaatgcgccgctcaaggcactcattctggattcatacttcgacgagtatcgtggcgtcgtcgccacggtgcgcatctttgacggctccatcaaaaagggcgataccttgcgcatgatgcaggcaaagggcgactttttggtcgatggcgtgggcgtcaagcgtcccgccgagacgccggtcgacgcgctgacggtcggcgaggtcggatacgtggtcacgggcctgaaggaccccgaggccgttcgcgtgggcgacacccttacctgggcgtcgaacccctgccccgagccgcttcccggttaccgcgaggctaagcccatggtctatacgggcctgttcccgatcgataacaaggactacgagaacctgcgtgacgcgctcgataagctgcatgtcaacgacccgtcgttggtgtgggagcccgagacttcggtggcgctcggctttggtttccgcgttggcttcttgggcctgctgcatatggaggtcgtcaaggagcgcctggagcgcgagttcaacctggacctgattgccacgagcccttcggtggactatcacgtctacaagaccgacggcgagatgattgatgttcgcagcccgcaggatctgcccgaggctacgcgcatcgagcgcatcgaggagccctacctcaaggccaagattatctgtccgcccgagtatacgggtgccgtcatgcagctcgctatcgagcatcgcggcattacaaccgacatgatccatctcacgagcaaatcggtcgagatgcgtttcgacatgccgcttgccgagctcattctggacttttttgaccagctcaagagccgcaccaagggttacgcctcgctcgactacgagttcaacgaatatcgcccctccgagctcgtcaagctcgacatcctgctttcgggcgacgaggtggacgcgctgtcgtttatcgtgcacaaggataaggcttatggcctggcccgcggtctgtgcgacaagctcaaggaaatcattccgcgccagctgttcgaggtgcctatccagggcgccatcggcaacaagatcattgcccgctctaccgtcaaagcgcgccgcaaggacgtgctggccaagtgttatggcggcgatatctcgcgaaagcgcaagctgctcgagaagcagaaagagggcaaaaagcgcatgaaggccatcggctcggtcgaggttccgcaggaggcctttatggcgattctcaaggtggacgagtaggtccatggcactttctgaatacagcaagcggttgcttggcgcctatgccgagcagccgttccttatggctcccatggcgggcgtgaccgatcccgcctatcgcatcatgtgccgccgtcgcggtgcccatcttgcctatagcgagatggtgagcgtggcgggccttgcctatgccagcaataagacgtggcgcctggtactgccggccgatgaggagcagcagatctgcgtgcagctctttggctccaagcccgatcagtttgcgagcgctgttgctgccgtcgaggagcgtgtgggcgatcgcctgtcgctgatcgatatcaacatggcctgcccggctcgcaaggtcgtcaccaagggcgagggctcggcgcttatgcgcactcccgatctggccgagcagatcgtcgaggcggcggtgggcgcggcgcatgtgcccgtgaccgtaaaaatccgtaagggcttttacgccgaagaccgcaacgccgcgacgtttgcccagatgcttgagggagcaggggccgccgcggtggcggtacatggtcgctgcgccacgcagctctatacgggccaggccgattggtcggtcgtcgatgaggtggccgacgccgtcgagattcccgttatcggttcgggcgatgtgttctcggcagaggacgctgctgagcatctgcaaagctcgggtgccagcgcggtgtttatcgcgcgcggcatctacggcaatccatgggtgttcggcgatgcccgagcccttgcactcgatggcacgccggttccttctcgctcctcggttgagcgcctggatgccctgcgcgagcacctgacgctcacgcacgagctgttgccgctcatgtcgcgtgcccgcacgtacgcaagctggtatctaaagggcatgccccatgctgccgcctggcgcgctcaggtggtgcgttgctccacatacgaggagttcatggcactggtcgatgatatcgagcacgatgtggtggcctgtgaggccgcacttgccgccggcgagtcggtgcccgctcatccgttggaggcctaacggtggccgttgccgcgctgtacgtgcatgtgccgttttgcgcccaaaaatgccggtactgtgactttgactcacgcagttttgctccgtgcaacatgagcgttgcgctcgatacctattttgagcagttgtatgcgcgcctcgatgcttttggcgacgcaggcgcgcttgcacagatccgcaccgtctatgttggcggcggcacgccgtcgctggcgggggagcgtttggtagaatttgcccggcgtatctctgcgtggtgcaagcctgttgagtttacctgcgaggccaatcccgaatcgctgaccgcagagcttgccactgcgcttgccggggtgggtgtcacgcgcgtctctctgggcgtgcaaacgctcgataacgccgaacttaccgccatcggccgcattcacgatgccgatcgggcgctcgctgccatcacgacggtcaaggacgctgggcttgtcgtgtcgtgcgacctgatgtgcggccttcccgggcagaccgacctaagctggcagcgcacactcgatggcgtgttggcggcggcgccgcatcatgtgtcggtgtacccgctcacgctcgaggagggcacgccgctctatcgcatggcgtgtcgcgacgagtcgctcgagcccgacgaggattttcaggctgcatgcatggatgcggcgcgtgagcgcctgagtgcggccggctatcacccgtatgaggtggcaagctacgcgctcgacggccatgagtgcgcccacaacattgcctattggaccggacagggctatctgggtttgggccgctctgccgccggtatgctcgacgccgaggatttcgatcgcttggccgggctgtttcccgacgtgcttgctcgcggcgatgcgtatcgcgtgcgcttggtgcaacgcgacgatgccgcgacgacgtttgatgccgagtatctgtcgcagcgcgaggcggcggccgaggatttgatgcttgcctgtcgcatgacgcgtggcattgggcccgatctgttggttcgctcggcaagcgtgatcgctgcagatgagttggcggcggcctgcgaccgtgcggtcgagttgggccttgccacctgggtgcccgatcatattgaaggacatgcggggcgcgtcacctcgaaagacgttatcgcaggtcgcgtccgtgctcgtttagcgcccactcacttgggctggctcgatggaaatgtgctgttcgagctgttttggggtctagcctaggccgctcgggtagaattaccgcaatatatacgctgctgtgagcaggaggttgccgcgcatggcgacgatgaacgaaaaagattactacgagattttgggtgtctccaaggacgccacctcgcgtgatatacagaaagccttccagcaaaaggcccgcaagctccatccggacgtcaacaaagaaccggatgccgaggaaaagttcaaagaggtttccgaggcctatgctgtgctttcggacgagcagaagcgtgcgcgctacgacgccatgcgctcgggcaatccctttgccggcgctcccacggcttcgccctatggcggcggttacgccggcagcgcgggctacggcaatccctttgagggcggctttccctttggtggcgcctggggtcagccgcgtcgcgggcaggctgcctataatcccgagaacggcgccaacgtcgtcgtcgatattaagctcgacgccaaggaggccaagggcggtgcccgcaagaccgtccgctatacgcgcttcgatacctgtggtcactgcggcggttcgggctctgtttcgtccgagcatgcacatacctgtccgagctgcggcggtcgcggccacatcgatgtcgacctgtcctttctgtttggtgccggcacgttccagtctgtctgccctgagtgcggtggctccggtaaggtcgtcgccgacccctgtcccgattgcggcggcagcgggcgaacccgtgtgacctccgagcagacgattgagtttcccgccggcacgcacgatggcgacgaggtccgtattggcggcatgggtcacgccggcaccaacggcgcctctggcggtgatctggtcggtcgggcccatgttgaggccgagcgcctggaaggcaaggcccgtaccggtttttacctgatgggcatcgtggcgccgtttttggtgctatcggccatctcgggcgtgttctcggcctttgccgtgatgtgctttattccgtttgccatgggcctgttcatggtgctctcggacggcgtgctgcaccgcagcctgctgtggtggaagcgcggcgcgatgcagtttgccaacggttttgccaacggatttatgtttgcgctcgtgtcggtttggtttgcgagctgctcgcaacgtgccatgctttcgccctacgcaatgcaataacatcaaaccctctgtttgcggccggcccagcttgggtataggacgcactgtgacaataatgaaagtcggaaggattcggtcgtgtcggaaaatagggattactacgaggtgcttggcgtcgacaaggatgccgacgcgcggacgattaagcgcgcgtttctaaagaaggcccgtaccgtacacccggacgtttcggacgaccccgaggccgaggctaagttcaaagagctcaacgaggcatattccgttctttccgatgagcagaagcgtgctaactacgaccgttacggcactgccgacggccccggtggctccggctacgtcgatatcaacgatatctttggtggcatgggcatggacgacttgttctcgtcgttctttggcggcggtgccggcggtggcgcccgcagccgtcgtgagcgtcgtcgcggacgtgatatggccatctcgctttcggtgacgctcgaggaggcggcgctcggctgcaaaaagacaatcagctatgaccgccttgctccttgcgaggactgcaatggcaccggtagggcagagggcgcacaggaaaagcagtgcggccgctgccacggtacgggctacgtcacgacggttcagcgatcgtttttgggccaggttcagtcttcctcgccttgccccgactgccatggcgagggcacggttatcgatcatccctgcgagacctgcgacggtcaaggccgcacgccttcgcacgaaaagatcgacatcgatattcccgccggcgtttcgaccggtcgccagcttcgtgtgagcggctttggcgaggccggccttcgcggcgagccttcgggcgacctgattgtcaacgtgcgcgtcgccgaccatgagcgctttaagcgcaacggtgatgacctgtacctggtgagcgatatctcgattgcgcaggctgcgctcggctgcgagattgaggtcgagggcattatgcccgacgaggtcgttaaggtgacggttcccgccggcgcccagtacggcgacaccgtgagcgtcaataattacggcatgccgcgcattggcggtggcggttcgcgtggccgcctgatcgtgcaactgcgcgtggtcgttcccaccaatctttccaataagcagcgcgagctgctccgtgcttttgccgatgagatgggcgatgacgtcgcttctggtaagaagtcggtgaccgaccgtatcaagagtgccctcgacgatatcctcgattaaggagcccgcgtgctcgcaccccatatttccgtcgtcaacctcggctgccgtgtcaaccgggttgagtctgaccgtatcactgccgatcttatgcgtttgggctttgctattgtggagccccaggatgccgatctgatcgtcattaacacttgtgccgttacgggcgaggccgaggctaagacccgtaaggccgtccgtcatgcgctggcccatccaaacgagccctatgtggtcgtgaccggatgcgtggtcaatttgcatcccgaggagctgtcggagctttcggatcgcgtgattgccgagccgtccaagatagatgtcgccgaacgtgtttgcgaggtgctgggtgttgagtccgatagcgttcccgcctgcagcgatggcgaggtggtcgatacgctcggtcgctctcgcctgggcgtgaagattcaggatggctgcaaccatcgctgcacctattgcattgtgtggaaggcgcgcggccccgagcgctccgtgcccgtcgagtccgtgctcgagcaagttcgcgaggcccaggaggccggcgtgcccgaggtggtgctgaccggtgtgaacctgggtgcctacgatggcaagagcgcgaccgacgagcacgtcgaaatcgatgagctgctcgaggccatcatggagcgcacgtctattccgcatgtgcgcatttcctcggtcgagcccatggatatctccgagcgcctgcttaaggttatggcgcgctacccgcagcgtatcgccccgtttttgcacctgcccgtgcagtccggctgcacggcgaccctgcatcgcatgggccgtccctatagcgccgaggcctttgaggacacggtgcgtatgattcgcgccaacttgccccaggcgtccctttcgtgcgatgtcatcgtcggttttcctggtgagacggacgaggagttcgaggagtcgctggcgctgtgccgccgtgtgggtttctcgcgtatgcacgtgttccgctacagcaagcgtcccggtacccttgctgccgacatgcccgaccaggtgccacccgaggttatggccgagcgcagccgccgtatgcgggccgccgcacaggagctcgctattgccgacgctcgtcgtcgcgtgggcacggtcgagcgtgccgtgctcgagtatggtgacaacctgacgctcggctcgttccatcatgcccgtcttgacgatacctgtggacttacagccccgtgcctgctcgatgttgctatcatcggagtcgatgattccggcttggtccatgcacgcagggaggttcatggaagcctcgaagattagacttaccgttcccgagggtattgacccctcgcgcgttttgggtgccggcgacggcgtccttcgtgcgctggagagctcagttcgcgcccacgtggtcgcccgtggcgacagcatcgccgtgagcggtgacccggacgaggtcgaactggtcgcgcgttttttcgaacatgcctttcgtgaggctgcttccgggcgcacgctttctgccgacgatgtctctcgctgcctggccgtattgcgcgacggtgagcacgaggctacatcgcttcgcgatgatgtgctgctttcgtatcgcggccgtgtcattcgccccaagacgctcggtcaaaagcgctatgtggatgccatccgctcgcataccatcacgtttggcctgggtcctgccggtaccggtaagacctatctggccatggcgctcgccgttgccgcgctcaagcgtcacgaggtgggccgtctgatcttgacgcgtccggttgtcgaggcgggggagaacctgggctttttgcccggtaccctcgaggaaaagatcgatccttacatgcgtccgctctacgacgccctttttgacatgatggatcgcgagcgcaccgatgagcttatggagcgtggcgtgatcgagatcgccccgcttgcctacatgcgcggccgcacgctgagcgatgccttcgtggtgctcgacgaggcgcaaaataccacgcccgagcagatgaagatgttcctgacgcgcctgggttttaactccaagtttgtgattaccggcgacctgagtcagcgcgacctggtgggtcgtcgcggcggtcttgccgacgttgagcggattttaggccgtgtcgacgatgtcgcattttctcacctcgagcgtgccgacgtggtgcgccatgccttggtggggcgtatcgttgaggcatacgatgcttatgatgatgtacgcgagaagcgcgtgcacgatcgaaaggagtcccgttgagtgtattgatcagcaacgatgccgagctcgatacgctgctcgacgcgcaggaggtagagcacatctgcgaggtcgtgcttaccgccgagggcgttgagcgtgaagttgagatttccctttcgtatgtcgacgaggacgagatgcacgagctcaaccacgagtggcgcggtatcgaccgtaccaccgatgtcctctcgtttgaatgcgactcggcctttgatgaggatattcccgcagacaagacgctcgagctcggcgatatcatcctggccccgcaggtcattgcccgtcaggcccccggctttggcaatagccctgccgacgagtgccgcctgatgctcgtgcatggcatgctgcacctgctgggatatgaccatattgaggacgacgaggccgaggtcatggaggcccgtgaggacgtcatcctgcgcgatctggcgctcgagcgcggcgaggaccccaagctggtccacgtcggccccatcaccaaccacgcccacgactaggagccgtctatgattcccggatcgaacaaggaccatccgtccttcttaaagtcgttctcctacgccatggagggcttcgtcaccgccgtcaagaccgagcgcaacattaaggttatgctcgcggcgggcgtttgcaccgtcgttgccggctgcattgtcggcctcgacattgccgagtgggccacagttatcatctgctgtggcttggtgattcacggcgagctgtgcaataccgctatggaggcgatcgtcgacctggcgacccaggaacttcatccgctggcaaagcgtgcgaaggatatcgccgccgcctccgtatacgtgctttccatcaccgccgcgattgtgggattgctggtatttgcccacgcgctcgactttatttagaaagggatttccatgtccgacaatatgcagcctatcgatgaaactctggatgacgagtccctggatgcggtggatgccgaagcggccgaggcatacgaggagatcgaggagttcgacccgtttgagggcatgagcgacgaggagctcgacgccctgtgcgacgaggacgacagcctcgcgggctttggagacgttgagcccggtttccgcagcggcttcgtggccctggtcggccgccccaacgccggcaagtccacgctgctcaacgcctgctatggcaaaaaggtcgccatcacctcgcctgtggcccagacgacccgccgccgcatgcgcgccgtcgtcaaccgtcccggctaccagctggtctttgtcgataccccgggtattcacaagcccaaggacggcctggggtccgagctcaacaagagcgcgctgttcgagctgaacgatgtcgatgtcgtcgcgtttttgattgatgccaccaaaccgatcggcaggggagacgcctgggttgccgagcgcgtcaagagcgcccgttctaagaaggtcctggtgctcaccaaggccgatgaggccgaccccgcgcaggtcatggagcagcttaaggcagcgcatgagcttatggaatacgacgacgagatcgtgacctcgtcggtgaagaacttcaacgtcgacgccttcatcgagaccgttgcccactttttgcccgagggcccgcgttggttccccgaggacatgggtaccgacgcttccgatgagacgctcgttgccgagtttgtgcgcgagaaggtcttgcgccgcacccgtgatgagatcccgcactccgttggcgtgatctgcgatgcgctcgagcagaccaagaaggtgctgcgcgtgcacgccaccatttacgtcgagcgcgagggccaaaagggcatcatcatcggcaagggcggcgagatgatcaagcatatcggtatcgacgcccgtcgcgatcttgagcgcatttttggcacgcaggtctttttggagttggacgtgaaggtcaaggccggctggcgtgacgacgaggcccagattcgccgctttggctataacgccgaggactaaggacgcgcggcgcgcatggcaggctcccggacatatcgcacgaaagtgctcgtgctcgataagactaagctcaaagagaccgacctgatcttgacgatgcttgacgagcgggggcggcaggttcgtgccgtggcaaagggcgcccgcaaacccggcggacgcctggctgcgcgctgcgagctgttctgtacggtagatatgctgctcgcacatggacggtcactcgacgtggtttcccaggccgagcttatggaggcgccgctcggcgttgcgcccgattacgagacgacctgcgccgcaagcgcgatcgccgaggtcgcgcgcgtgtgctcgttcgaggacgccgaggacccgtttacctttgccatcacgcagcgagcgcttgccctggtgggcagcgggctcgacacggcgcatatggatctacttgtggcggcatatgtctttaagctgctgtcgcacgttggctatcgacccgatttttcggcctgcgtgctgtgcggagaccccatgctgtcgtatttttcgccccaggcgggcggcctcatgtgcgggtcgtgcgcgtcgagcgttccaggtgccgaactggtgtcgaccggtgaggccgcatggctgcgcgccctcatgtccatgaccttcgatgcgcttttggccgagcgaatcgacccgcataccgcagcctttttgctggggctttcgcatgtttgggctgcgacgcacaccgatcagcgcctccgtgcgatggaattcatgttgggtcggtgatgatgcgcaggcgcgggctgcttgtggtaacataccgacctgttggtacctcgaccttggttgctcgctccaccggcggcttcccagtccgaggcgaatcgagtcgcccgatggcgacgcaaaaagaaaggtgaaacaatgactgtttccaaagagcgcaaggcggagctgactgcccagttcggtaacaccccggtcgacaccggcaaccccaaggttcaggtcgccatcctgtccgagcgcatcaaggagctgaccgagcacatgaagtcccatcagaaggacttccacacccgtcgtggtctgctcatgctcgtcggtcgtcgtcgtcgtcttctctcctacatcaagaagaacgacatcgtcgagtaccgtgagctcatcaaggctctgggcatccgcgacaacatccagtaggatttgtacatgctaagagcgtcctgcgcagcggggcgctctttttgtgtaagggcgcgaacaatcacgctctgaagcgtggcgggggcagggggtccgcgtcacatgagaagcccgcaggcaaggggcctgtggggtaaaggagaacaatgacactcgtatccaagacctttgagctgtacggcaagacctacacctttgagtcgggcgagcttgccaagcaggccaccggcgcctgcctggtcaagcagggcgacaccacgatgctcgataccgtggtcgtctccaaggagcgcaagaactatgacttcttcccgctgaccgtcgacttcaacgagaagatgtacgctgccggccgcatcccgggtggctacctcaagcgtgagggccgtcccagcgagaaggccacgctcaccgcgcgcatgatcgaccgtccgattcgcccgagcttcccggacggcttccgcaacgaggtgcacatcgtcgctacctcgcttgtcgccgaccaggtcaacccctttgacgtcatcaacgtcatgggtgcttccctggccatgacgctcggcggcgtgcccttcgagggcccgcttgcctgcgtgcgcatcggccgtaacgtggagaccggcgagtttatcgtcaaccccacctacgaggagcgcgagaactccgatctggacttggagctgggcggctccgccgacttcatctcgatggtcgaggccggcgccgaggagatctctgaggacgacatgctcgccgccatgaagtttggccaggaggcccttgctgccttctgccaggctcaggatgagttcgtcgccgagtgggagcaggtcaacggccccatcgtcaagaaggagtacccgctcgaccagcccgtcgaggaggtccaggagcgcatcttcgcccactacgacgagatggcagccgccttgcgcgacgccgacaagctctcccgtatcggcaaggtcgaggctctgaaggagtccatccgcgccgagttcaccgaggaggagcaggctgcttgggagcgcgagatccccgtggcgctcaagaagctcgagaagaaggccatgcgtactatggtcgtcgagaccggcgagcgcgtcgacggccgtgccgccgacgagatccgtcccatcatggtgaaggacaactacctgccgctcgttcacggctccggtctgttccagcgcggccagacccaggtgctctccgtcctgtcgctcggcatgctcaacgagggccagcgtctggataccatcgagcccaccgagggcaagcgctacatgcaccactacaacttcccgccgttctgcaccggcgagactggccgcatgggcagccccaagcgtcgcgagatcggtcacggcaatctggcagagcgcgctctgcttccggtgcttcccgacgagaacgagttcccctacgccatccgcgtcgtctccgaggtcatggagtccaacggctcctcttcgatggcttcgacctgcggctccacgctcgcccttatggacggcggcgtgcccattaagcgcccggtctccggtatcgccatgggcctgatccaggaggagggtaagaccgtggtcctgtccgacatccagggtctcgaggacttcctgggcgacatggactttaaggtcaccggcaccaccgagggcatcaccgccctgcagatggacaacaaggccaccggcctcaccttcgacatcctggcccgcgccctgcagcaggccaaggagggtcgcgccttcatcctgcagaagatgctcgatgtgatccccgagccgcgccacaccacacgcagcaccgctccgcgcatcgtctccatccaggtcccgaccgacaagatccgcgacgtcatcggttccggcggtaaggtcatccgcggtattcaggacgagaccggcgcttcggtcgacatccaggaggacggcaccgtctttgtcggcggcaccggcgagtccgtggaccaggccgtcgagcgcatcaagctcatcatcaaggttcccgagccgggcgaggagtacaccggtcgcgtggtctccatccagcccttcggcgccttcgtcaacctgctgcccggtaaggacggcctgctgcacatctctcgcgtcgccaagggccgcgtggagaaggtcgaggacgtcctcaacgtgggcgacgaggtcaaggtcgtcgtcatcgaggtcgacgatcgtggcaagatctcgcttgatcgtctggataagcccgaggccccggctcgcgccgagggtgcttctgagggcgacggcgagcacttccagcgccgtgagcgtccgcgtcgcgagcgctccgagcgcagcgaccgtccgcgccgtcccggtgacaacggaggccgcaagcctcgccgtcaccacgacgccgagtaacagccgtacataagcagctcaacaagggcgactcctaagggggtcgcccttttgctattctcggcggggccgcaggtaaagtttcctgctctacagtcctgctcgcacggagagcatattaagtgctttcctttgcgtgcggaactcgcgataaacttcatatgcgtccctcccgggcgcaagcaaaagggctggttaatgccgctcgctatttagttagacagtctattcagtagtcagattacagatctgtagatagccgcagcagcatcttcccagataaaaccgaccaaaataaacctgtctctatttggcaggtttcccgtggggcgggcactgatgaagtttatcgcgagttccgcacgaacaggaggccacttaatgtggcctccgtcgtgagcaggactgtagagcaggaaacttcatcagtgcccgccccacgggaaaccggcgggatggaccagttcagatggggctttgatgcatgggtggtctgttggtgggcaaatgggtatcatactgaggttactgcgtcgactctatgatgcatgtttgtacgttcccggcggtcggtttgccagaagcgccccgccggttgttccagacccgtttcgaagaaaggaaaccacactaacctatggcagctaaaaaatcatctcccttgaagatcattccgctcggtggccttgacggcatcggcaagaacatgacggtcttcgagtgcggcgacgacatggtgctcgtcgacgccggcctcatgttcccggatgactcccagcccggtatcgacctggtgcttcccgactacacctatgttttggagaacgaggaaaagctccgcggtatcgtcgttacccacggccacgaggaccacaccggttcgcttccgtatctgctgcaggacctcaacaacaaggtgcccatcttttcgagcaagctgacgcttggctttatcgagggtaagctttctgagttccgcatccgcgcacccaagttccgcgaggtcaagggcggcagccatgtcaacctcggcggcatctcgctcgacttcttctcgatgacgcactccatccccggcgctctgggcgtgttcatccgcaccaatcagggcaccgttatgcacaccggcgactttaagctcgaccagacgcccatcgacggcgtcacgcccgactatgccgctatcagccgctttgccaagcagggcatcgacctgttgctgtccgactccaccaatgccacggttcccggctttaccaagtccgaggccgaggttggtcccaacctgctgcatgccatcaagaacgccccgggtcgcgtgttcgtcgcttcgttctcgagccatatccatcgtttgcagcagatctgcgatgccgcccgcaagtgcggccgtaaggtcgttgtgaccggtcgttccatgctcaccaacacccgcgtcgcgcgcgagctgggctacctcaacatcgacgatgccgatatcatcgatgccttcgatatcgataacctgcccgacgacaagatcgtcgtcatgtgcaccggttcgcagggcgagccgctgtcggccctgtcccgcatggccaatggcgagcacaagacgctctctatccacgagggcgataccgtcatcctctcggcaactcccgttcccggcaacgagaaagccgtccagcaggtcgtcaacagcctggccaagctcggctgcgacgtgtgggataagaaccgcgctcttgtccacgtctcgggccacggtagccaggaggagctcaagctcctgatggccatggccaagcccacttactttatgccggttcacggtgaggccgtgcatctgcgcgcccatgcccagcttgcccgcaagatgggcatcaaggacgatcatatctttatcctcgataacggcgacacgctcgagatgcgcggcggtatcgtcaagcgcggtacgcccgtcgagtccggcgtcgtctacgtcgacggccttcgtatcggcgataccgaccccatcgtcttgcgcgatcgtcagaagctcgccaatgacggtatggttaccgctgttgccatcgtctcgcttaaacacaagaagatcgaggccatcgagttctcgggccgcggcgtctcgtttgccatcgacgaccagttctctgaggatgcctccgcgtccatcatgaagacgatcgagaagggcaagttcagctttacgagcagcggttccgatgctattcgtaaggccgtgcgcgattcgctctctaactttatctggagccgtacgcgcacccgtccgatgatcatcccggtcgtcatggaggtttagtttggcgcgtggatctgcacaaaacgccaaaagcaataaggccaataaccaaccggcatctgctaagggtgccggttcccatctgcgtgccaataagggccacgaggcggacttcgacgattttgagcctttggttgagccctcggccaaccgtgatatcgccggcgtggtcatcgccgttttggcgattgcgtccttcattgccgtgatttcgccggcgaccgcacccgttacggctgcggttgccggtttctaccacctgggctttggtctgggcgcctacgtgctgccgatcgtcattttgctgtttgccgccacgctctttttaggcgaggactcgccgctcaacgtacgctctgttgcgggcggcgccgtggtctttatcgccgtcgtctccattctttcgctgatggtgccgggtacgagtgtctcttgtgaccttatgttcacgccgcaaaatttgtccgcctcgggtggctacatcggtgcgtttattgcgagtgcgctgcagaatgccctgggtaagcctatcgcgatggtagtcctgttgggctttgtcgtcgtgggcttggtcatcatcggcttttcggttggcggcgttttgcgctctgctcgcgaccgtgcggccgattttgccgagcgccgccgtgccgatgtcaacgccagcccgtggggtgacgacgaagccctgtcggtgcccggcgttgcccgtccgcacctgagcattcttcgtcaaaagggccccgatgcggccgtgactacggttatgggtagcgaagtcgatccgattctggacgatgaggacgtggacgaagatccgtttgtcgacgtgtctgaggccgtggaggccgagcgggccaagacaacgctgttgccgcgccgccatgccaagaagggcaaggctgcgcccaaactcaatacgagtgagcccgacccgtcttggtccgagagcgagattgagctcaccgagggtgatgacgaggacgacgaggctccgattgagaccgcaaagacaactttgctgccgcgtcgccatgcaaagcgcgaccaggtaaccggtcagctttcgatggaagacgaccccgataagatcgacgagtccgagccgccgtttgccgtgaatcctgtctcggcagcacctcagatccccgacttcttgaagcatcccaaggttgccgatgcgcctgccttgagtgctgtcgaatcggctgcggccagcgatgggggaacggacggcggcgccgcagataacgagggcgaagaagaggacggcctcaaacttccgccacttgagattctgcatgccaacccgcagtcggcttccgctgcgtcttcggacaaggagctggagcaaactgccgagtcgctgcagtcgaccctgcttgagtttggccgcagcgcccgcgtggtcggctggatcgccggccccacggtgacgacctttaagctgcaacctggcgagggcgagcgcgtgagcaagatttcgagcctcgaggacgatatcgcgctttcgctcgcagctcagtcggttcgtatctttgccccgatccccggcacgtcgctcgtgggtatcgagatccccaatcgcaagcgccagaacgtcaacctgggcgacgtgctgccctatgtgaagggcggtccgctcgagctggccatcggtcgcgatgccgagggtacgccggtcgtcgccgacctcgccaagatgccccacctgctgatcgccggcacgaccggttctggtaagtcggtgatgatcaactccatcatcacgaccctgctcatgcgcgcgcttcccgaggacgttcgcctgatcatggtcgaccccaagcgcgtcgagcttgcgggctataacggtctgccgcatctttacgtgcctgtagtgaccgagcccaagcaggccgcgagcgctctgcaatgggccgtgtccgagatggagcgtcgcctgaaggtcttcgagcgtctcaatgtacgtaagatctcgacctataacgaaaagcaggccgccggcgagtttgaacattacgataacccgccgcaaaagatgccctatctggtcattatcatcgacgagctctcggacctgatgatggtcgccggtaaggatgtcgaggcctcgatcgtgcgtattgctcagctgggccgtgccgccggtatccaccttatcgtggccacgcagcgcccgagctccaacgtggtgacgggcctcattaaggccaacatcaccaaccgcatcgcctttaacgtcgccacgggcatcgactcgcgcgtcatcatcgaccagatgggtgccgaaaagctcaccggtttgggcgacatgctgttctccaaggtcgactggggcaagcctcgtcgtattcagggctgctttgtctcggacgatgaaatcaacgagattgtcgagttcgtcaagtcgcaaagcgagcccgactaccatgaggagatcctgtcggctgtggcgcccgcttccatgtccatggcgggtggcggcattgtccgcaccggagttgccgagccgcaagacgatgatccgctcatttgggaagccgcccatattgtggtggaatcgcagctgggctccacatctggcctgcaacgccgccttaaggttggctatgcgcgcgccgggcgtattatggacatgctggaagaaaagggtgtcgtcggcccgcccgacggttccaagccgcgcgaggtcctgttggacgaggaggggcttgccgcgctggagtctgtcgacgccgagatggcacgtgaagatcgtgagtttggaggattctgatggctgcacgctttggtgacatgctgctcgagcagcgtcgccgaatgggcctttccattcagcaggtcgccaacaccatcaaaatcaggccgcagatcatcgagtttttcgagaccggtaactttgcttcgatgccgccgcgcggctatgcgcagggcatgatttcgagctatgctcgctttttgggcctcaatccgcgcgaggtcgtcaatgcctactttgacgacctgatggcatacgaacgcgagacgtctcagcagggcggtcgttttcaggacgccgctggctacgtcaattcgcgctcctcggtcgataacgggcgcttcctgatggttcagggcggtcgttcgacccgctatggacagcgtcctcagcaggccggttatattaccgagacgggttcgggcgaggagattcgctcacagcgtgaccggttccgcagtacgccgatgcctgaggaccgtgcgcttcccgctgcccgcggcgtggcgcgtgaccctcgtgccggctacggcgacggcggctattccgatcgcggttaccgtggtgcctctacgggacgctctcgcggtggctatgcggatgccgataccacgcaggtaacgccgcgtcttcgctctcaatcacagccgtatggccagcgctcttcggcttcgcgttcgggccagcgtggctatcaaggccgcggtgagcttgcgctccgctcgggtcagcgcagccttcagggccagggcggctatcgcggccgttccgatagcaatcgcggccgtatgcctcagggaagcggccgcagcagttccggtcgtggacgcggcggatcccgtactcctcaaaacaacgggctcgatccgcgtatcgtctacgccggcatcggtgccgtggtgttgctgctgattgtgctcatcgtggtgcttctgcgcggctgcgcatcttcgacgcccgagaccacgcccgagacgcccgctgctaccaagacgacgaccaagaagtcttctaagaagtccgaaacggtcgacgaggacgaagacaccgatgaagcgacggatgcgtcgactgattcggacgctaccaagacgacggccaagaaggaagagaacgaggtcacgaaggtcaaagtttccgttgccaagggaaagaccgcgtggattgaggtcaaggtcgacggcaagtcggtctatggcgctcaggcgactggcccctttgagcaggagtacacgcccgagtcctcgatcgagatcaccacgtccaagccttccgatgttaccgttaccaagaacggtgaaaaggtccgttacgataccaagacctcgggcgtggctcgtgtgacgatcaccgttcctaagaaggagacgactgattccgagaatggtgaaagttctgatggcaccgacaccaccgatggtaccgataccaccgaccgcaccggtgcccagtccgcggatggcgccgataccgcaactgacggtcagacgcccaccgattctaccgactattcgtacgatagctactaagccgctcgtacgcgaaaggaaacatcatggctaaagattccagcttcgacgtcgtgtccgaggtcaacatgcaagaggtcgacaacgccttccagcagaccacgcgcgagatttcccagcgctatgaccttaaggattccggcgccacgatcgagctttcgaagggcgacaagctctttacgatcaacgccccggccgactttgtctccaagcagattatcgacgtgctgagctccaagctcatcaagcgcggcatcgacctcaaggctgtctcgtgggatgctccacaggcggcgtcgggcggcaccgtgcgcgtgctcggccatgtcgtcgagggtatcgaccaggcgaccgccaagaagatcaataaggacatcaaggaccaaaagcttaaggtcaaggtgaccatcgaggccgacaagctgcgtgtttcctctgcttcgaaggacgcgttgcagaccgtgatccagttcttgcgcgaccaggactacggccagccgctacagttcaccaactaccgctaatatcattcgaaaggaccgctctccaacatggatacaccgttgggctccgtgctctacatcaccctcgggtgcgctaagaacgaggttgacaccgaccgcatgcgttctcttttgaccgccgcgggctacgaagaggcattcgacccgcaggatgccgatatcgccatcgtcaatacatgctcgtttctcgcctccgcaacgtccgagagcatcgagaccacgctcgagctcgccaacgaggttcaggacggcgttcgttcttgccccatcgttatgtgcggctgcgtgccgtcgcgctatggcgacgacctgcctgacgagctgcccgaggtcgctgcctttgtgaaggccgacgaggaggacggcatcgtggcggtcatcgatggcgtgctgggtgtcgagcgtgagatcgcagcctatatcccgcaggtcaagcgtaccgtcgagggcgccgttgcctacgtcaagatttccgatggctgcaaccgtttctgcagcttctgcatgatcccctatattcgcggtcgctatcattcgcgcaatgccgagagcattatctccgaggtgcgcgacctggttgccggcggcgtgcgcgagattgtgctgattggccaggacacgggcatctggggtaccgactttgccgacgaggacgtcaccgagggctcgccgcgcaatctggcgcagctgctgcgtgccgtcgccgaggccgtgcgcccgcacaacgtctgggtccgcgtgctctatctgcagcccgagggcatgaccgacgagcttatcgatacgattcgcgatacgcccgaggtgctgccctatatcgatatccccgtgcagcactgtgacgcgcgcatccttaaggccatgcgtcgctccggttcgcgtcaagagctcgaggatctgttccgcgatctgcgtgagcgtatccccggcatcgtgatccgttccacggccatggtcggcttcccgaccgagaccgacgacgagttccgcgacctcatcgactttatggacaccgtcggcttcgactacacgagtgtctttgcctactcgcgtgaggaaggcagcctggccgccaagatggagggtcaggtcgacgaagaggtcaagcttgagcgcgcccaggaggccatggatctggccgagtcgctcggttttgccgctaccgccgcacatgtgggcgagcgcgcccaggtgatcgtcgacggtatcgaagagaccgaggacggcgccgagctgatcggccatgcctggttccaggcgcccgattccgatggcgctgtgcacttggacgccagcgaggcgtccgtgggcgatattctgactgtcgagtttaccgatagcttctgctatgagcttatcggccatgttgtggagtaggagagcgtcgtggcaaacgagagcaataaggaactgacgagtgtttggacgcccgccaatatcgtgacgtgcgtgcgcatcgtctttatcccggtgttcatgattgtgtcggcgctgtctcacacgagtgttgccggtacggattggagcatcttcgacggcccgctcgccgccgccgcttttattctgtacgtgattctgtcgtgcaccgataaggtcgacggctatctggcgcgctcgcgcaacgagatcaccgatttcggcaagttcttggaccccatcgcggacaagctgctggtgttctcggccctgctgctgttcttggattttggcgcggtgaccgtgtggtccgtgttcattatcctgttccgcgagctgctggtgagcgctcttcgcatggtcgcgagtgctgctggtgtggtcgttgcggccgataagctcggcaagtacaagacggcgaccacgatggtctccatctgcggttatctgtgcgtctttgcgatggccggcttgcaccttggcccggtggcgctgacgctcggcatctactcggtgtcgcgcttcctgtacgccgttgccgttgtcctgaccgttatctcgggcgcccagtacttctggaactgccgcaagatcgtcttttcggtctaggtcctggtgggtatgacggactcttttgagcagatttccgcacataacgaggagctggcgcgcgatattgtcgagcgcgcgagcgctcggggcgtgacggtttcgacggctgagtcgctgacggcgggtatgatcgcctcgacgattgccgatatcccgggcgcctcggcggtgctgcgtggcggtgcggtgacctattgcgatgagatcaagcatcgcgttcttggtgttgagcaggagacgctcgaccgctataccgcggtgtcgcatcagaccgcgcgcgagatggcggcgggttcgctggagctgtaccagagcgatattgcagtgagcgcaacgggttatgccggccccggcggtggcactgaggaagatccggcgggcactttctatattggctgggcgtatcgctccgccgatgggggcgtgccggtcgtggactctgtgcgctgccactatgagggcgaccgttcgtgtgttcgtgcccatgcggtcgcggaggcattgggacgcattgcccttgtgctcaactctatggaatagacgtgttttaaggggcctccgggccccttaattgtggagatagggacctcagaagaatttagcgtttgtgctgttcatgggtgtatttttgcctgccttgttcatttttggtcctttgtggtcaagcatttggtcagtgtttggtcggcgtttggttgggttttggaaaggtcggctgcatatgatttatctgaacggttgaccacgaacagccgttcgtttattatcgatgcaggttgttaagaggagggctattcatggccaagaattcaggtcccgtacgtaccgttcatgctcgcacgacgggtaaagagcgcgatgagatgatcgccaccaccaaggccgagatcgagaagaaattcggccagggttccatcatgaggtacggcgacggtggccccgagctcgaggtcgaggccatccctacgggcgctctggcactcgatgccgctctgggtatcggcggtgtgccgcgcggccgaatcgtcgagatctacggtcccgagtcctccggtaagacgacgctttcgctcgagatcttggccgaggcccaggcaatgggtggcgttgttgcatttatcgatgccgagcacgcgctcgatcccacgtatgccgcgcgcatcggcgtggatatcgacgaggtgctcatttcccagcccgatacgggcgagcaggcgctcgagattgttgacatgctcgtgcgctccggcgccatcgatgccatcgtcgtcgactccgtcgccgcgctgaccccgcgtgccgagatcgagggagagatcggcgacactacggtcggtcttcaggctcgcctgatgagccaggcgctccgcaagctcgccggctcgctgtccaagtccaacacgacgtgcatcttcattaaccaactgcgtgagaagattggcgtcatgttcggcaaccccgagactacgacgggcggccgcgcccttaagttcttctcttcggtgcgtatcgacattcgccgtatcgacagcattaagcttaaggacgaggttatcggtaaccgcgtgcgagccaaggtcgttaagaacaaggtggcagctccgttccgttctgctgagttcgacatcatgtacggtacgggcatctctaaggaaggctcgattctggacatggctgtcgagtgcggcatctgcaagaagatgggctcctggtttgcctatggcgaggacaagctcggcaacggtcgcgaggccgccaaggctttcctgcgcgaacaccccgattgcgccgacgagattgagcataaggtccgccttgcctgcggacttgagtttgatgacgatgctccgtccgaggtcgagctgaccgatcagcctgcgcctgaggagtttgacgagctttacgccatcgatggttccgccatgctcgatgatgacgacgagtagcggttacgctcatgtcgtatacggtgaccgaggccacggtcgtctttcccgataagaaggcggcctcctcgttctcgagcgggtatgcgtccaaaaagccttgcgcacatatcgattgtgagcttgagggcggttttgagcgttctatttggattcccgtgcgggtcgcgcgcctgtatgtcaaaaaccgcccagatcttccctgtgattgggacaactttcgtgaggcggtgcagctcatcgagcgtaaatgtgcacttaccatggtgaccgagatgttatcgcgccgcgaccatgcgacgggtgaggtccgtgacaagctggcttgctacggctttcaccagacagcgattgatttcgccgtcgagcgcgccaccgagtatcgctttttagacgagaaccgcttttgctcgtactttatcgaggaacgcaaacggcgtggttggggacagcgcaaaatcgagaccgagctcaagcgtcgtcatgtcgtgctcgatgacattcccggttatcccgaggaatattttgccgtcgaagacgatttggcgcgtgcgtcagccctgctcgccaagcgacgtgttccagagacgcgcggattcgaaaaactggttcggtttttgatgggcaagggcttctcgtatcacatcgccgccgatgccgttaaggcacgcctcgatgccgaatgcgaggaatgtgcggtttaggcatatgcgttttgtggtcctgccgttcaccgcgttttagccgccgtgctggggccatttatttgacagttgttgtggttcaacgtacgataaacactgtcatttgctttgtgatatgtgctcatctgtgatgagtttgtttatatgtttatctgtatccgacccgcataagctgcgcccatattactcaaatgtcgcgagccgttcgtaaggatggttcgctttgttgtgtaacgaatccataaaaaggagtgagcatgcctatcatcgcagcgctcgttggcatcgttttgggtgccatcgccgccattgccttcatgcgcaccgccaagcagggtagtcttcacgaggccgacgaaaagattcagtcggcacacgcacaggctgagtccctgatcggtgatgctaagcgtcaggccgagaccctcaaaaaagaggctctgctcgaggctaaagaggaaatcatcaagaacaagcaggcggtcgaggccgaggacaagcagcgtaagaacgagattcgtacgctcgagaaccgcgtgatgcagcgcgaggaatccctcgatcgccgcaacgacgctctcgacaagcgcgagcatcagctgtccagccaggccggtcaggtcgagaagcgctcccgtgagctcgaggagctctgcgcaaagcagacctccgagctcgagcgtattgccgaccttacccgcgaggacgcccacaaggagctcctcgataaggttcgcggcgaggtcacccacgaggctgccacgatcattcgcgagtccgagcagcaggttcgcgccgagtgccacaagaccgcccaggagattctgtccctggcgattcagcgctgcgctgccgaccacacagccgaggtcaccgttacctccgtgcacattccctctgatgacctcaagggccgtatcatcggtcgcgagggtcgcaacatccggaccttcgagcaggtttccggcgtcaacctcgtgatcgacgacacgcccgagactgtcgttctttcgagcttcgacccggtccgtcgtgagaccgcccgtgttgccctcgagaacctcatcgccgacggccgcattcaccccgcccgcatcgaggagatgtatcacaaggctgccgacctggttcagcagcgcgtgcgcgaggctggcgagcaggctgccttcgataccggcatccacgacctgcatcccgagatcgtcaagacccttggtgccctgcgctaccgtacctcgtttggtcagaacgtgcttcagcactccctcgaagtctctgacctgtgcggcgtgatggcttccgagcttggcctggacgttgtgaccgccaagcgcgccggcctgctgcacgacctgggcaaggcaatcgaccatgacgtcgagggcccgcatgccgtcatcggcgccgagcttgcccgccgttatggcgagaagcccgttatcgtccacgctatcgaggctcaccatgccgacgtcgaccccaacacggtgctcgatgtcctggtacaggccgccgatgctgtctctgcctctcgccccggtgcccgtcgcgagtctgccgagaactacatcaagcgtcttgagaagctcgaggagatcgccaactcccatgatggcgtcgagcgtacctatgccatgcaggctggtcgcgaggtccacgtcatggttcagccggacaagatctccgatgcccagtccacggtcctggctcacgatatcgcccatcagatcgaggaagagatggagtatcccggtcaggtgcgcgtcgtcgtgattcgcgagagccgcgctgtcgatatcgctaaataacatgagcgacgcgaacgagctcatctcatttatcgcgtcgatgtcgggggagggcaaccttcgcgtcgaggagaaccttggcgagggttatgtccgcctccgcgtttcggaggccgagaggcgccaggcaaagcacgacattcagcatgtcgaggatatcgtcattgaaatgctccgtaatgctcgcgatgctggcgccgacaaagtctatctcgctacgaccaaggaagatggcgtccgcacgcttgtctttctggataacggttcgggcgttccgcaagatatgcaagagcgaatcttcgatgcccgtgttacctccaagctcgagagcatgaagatggaccgttggggcgttcacggtcgtggcatggcattgttttcgatcaagcagaacaccgacgaggcccgtgtggtcacgtccggtgtcgatcttggttcagcctttaaggtgagcgttgcggccgaccgcctcagtgagcgtgccgatcagtccagctggccccaggccgtcaaggatgaggacggacgttatgtctgtgctcggggcccgcataatattattcgcgctgcttgtgagtttgcgctcgaggagttgcgtggttgcgatgtctatcttggttctccgtctgagattgccgcgaccctttatgctcaggcgtcaagtcggctcgatacgtcgcgtctcctgttcattgatgacgagagcgagcttccggttgttgatcgtctaggccttgcctctgatgccgaggactttatccgtatttgttcgggtttgggtcttgaaatgtccgagcgcacggcccatcgcattttggcagggcagattaagcccgttcgcggtgtgactgcgcgtctgctgcgcgagcgtgactcatcctcgcatgcgccggctcctgtcgatctcgcgaaggatcgtcgtgggctacgtattgccaaggatgacatggcacagttttcgcgtgctgtggagcgcgactttaatgaccttgccgcccggtactatctcaacctttgcggcgacccaaagattcgcgtttcgcgtgatcgaatcaccgtgacattcgatcttgccaaagaggaatagtgcctttaccgagtccactcggtacgatacagttattgcagttaaaacgtacttttaaacgcaggagtttcttcatggattgcctgaaggtatcaagcaaatcatcgcccgcgtccgttgccggcgccatcgccggcatggtcaaggatggtgtgcccgtcaacatccagtgtgtcggtgccggtgctgtcaaccaggccattaaggccgttgctatcgcgcgcggttttttgattccaaccggttttgatatttcctgtgcgcccgtgttctccgacatcctcattaacggggagtcgcgcacggctatccgcctttctatctacgttcaccagatcaatcgggctgctatggataacgtcgtcatggatgatgttaagcctgtggcatagcttctgcttgcctcgattcgcctcccttccatcgttaggacttatgcacatggaccagcgttccgtacgcgatattcttgccggtaaaacctactttatccgcacctttggctgccagatgaatcagcacgattccgagcgcgtgagcggtctgcttgattcgtatggctgtctcatggcgctcgatcccgagcatgccgatatcgttgtcttcatgacatgctgtgtgcgtgaggccgccgattctcgcctgtacggccagtgcaattcctgtaaaagcctgccgccttcgccttcgggcaagcgtgtggttgccgttggtggttgcatcgcgcagcgcgatggcgagggcctgctcaccaacgtcgataacgtcaatgtcatctttggtacgcattccatcgcacatgtggcagagctcattgccgaggcgttccttgatggcaagcatcatatccgcaccaatgagcatgaggatacggatgccatgagcatgccgtggcatcgcgagacccagtatcacgcttgggtgcccatcatgacgggctgcaataatttctgtacctattgcatcgttccgtacgtgcgcggtcgcgaaaagagccgctccttcgaggagattgtcgacgaggtgaccggtttggtgcgccagggcgtgcgtgagattacgctgctgggccaaaacgttaactcatatggtcgcgatctgtttggcaagccgcgttttgccgatttgctgcgtgccgtgggcgatacgggtgtggagcgcatcttctttacgtcttcgcatcccaaggatctgctgcccgagaccatcgacgccatggccgagacgcctgctgttatgccgcagctgcacctggccgtccagtcaggttcgacgcggatcctcaaagagatgaatcgccgttatacacgcgaggactatctgggcctggtcgatcgcattcgcaaccgcatgcccgatatcgcgctctcgactgacattatcgttggcttcccgggcgagactgaagaagactttgagcagacgctttcacttgccgagacggtccgctatgcccaggcctataccttcatctattccaagcgcgccggtaccccggccgcagagattgacgatcctacgccgcatgaggttattctcgggcgtttcaaccgcctggttaaggttatcgagaccacggcacatgagtataaccagggtgaacttcatactgtggttccggcgctcattgagggaacgagtaaaaagaacgacgcggtcctgctgggcaagagtcccaagaatcagaccgtgcatgcgcctatccccgagggttacagcatcgatcagcttgttggcaagatcgttgatgttgacgttgacgttgccaagacctggtatttgtccggctccgttgtgggcgagccgcgctaatggtttcttccggggcaggtctttccgccgttgcgatcgtcggtccgacggcggttggtaagagtgatgttgccgaccgtttggccgctcgtctttcgtccgaagtgctgtcgtgcgatgcgatgcaaatctatcgtggcatggacatcggtaccgcaaagatgacgcccgatgagtgtacggcgccgctgcgtctcgtcgacattgtggagccgggtgtggcatattctgctgcgctttatcaggctgacgctcgcgcgcatgttgaacgtctcattggttcgggttgtctgccggttttttgcggaggtacggggctatatctcaaggccgccctcgatgagatggactttccctcgggtgaacttgaggacgatcgccgtgtgggctatcaggagcttgccgagcgtattggcgaggaagaactgcatgccctgcttgccgagcgcgacccagaatcggctgctgttattcatccccataacgtgcgccgtgtgattcgtgcgctcgagatgcatgatgatggtatctcctatgcacagcaaaaaagtcagtttagtgttccgcgcgagcattatcatgctctatggtttggtctgacgcgtaatcgcgaggtgctctacgagcgcattaacctgcgtgtcgatctgatgtttgaacagggtcttgttgatgaggttcgcggtcttatggaccaggggctgggagatgccctgacttcgatgcaggcaattggctataaagagatcattgatgctttcaatggcgtgatttctatggatgaggctcgcgaactcatcaagatgcgttcgcgtcgctatgccaaacgtcagctttcgtggtttaagcgcgatgaccgtatcgtgtggtttgatatggacgagtttacgatcgatgaggtcgttgaggacatcctgcatcgtattgaggctgcctaatggcccgtttcccccttgttcccacggcacccgagcccgagcgtgccattttagttggtgttgagtggcgcgacaatgcatggccgctcgatcgttcgcttgacgagcttgagcgcctggcccatacggctggcgcccagtgcgtggcgcgtttgtcacagcgtctggttaagccgtatccaaaatcgtttatcggttccggtaaggttgaggagctttgcgggctcgtgcatcgtatggatgtcgatgttgttatcttcgacgacgatttatcgccctcgcagcaatcctatttggagaaagccgtgggcgagccggtaaagattatcgatcgtacagcactgatcctggatatctttggcctgcatgctcagacgcgtgagggacgcctacaggtacagctggcgcagcttcaatatctgttgcctcgtctgcgcggtatgtggagccatcttgccaaggagcagacgcgcggcggcatcggttcacgctttggtcagggcgaaagtcagctcgaggtcgaccgtcgcctcattcgtaataagatcgctgcgcttcgtcgtgagctcaagcaggttgaacagcgtcgcgatgtccagtccaagagccgcattgagtcaccggcgtttcgagtcgcgttagccggttataccaatgccggtaaatcgacgttgcttaatcgcctgaccggctctacggtactttcgcaggacaagctgtttgctacgctcgacccgacgacgcgttcgtatcgcctgcccggcggtcgcggcatgacgattaccgataccgttggctttattcaaaagctaccgcatggtctcgttgatgcctttaagtccacgctgtctgaggttcttggtgccgatctgatccttaaagttgtggatgcctctgacgaggactacgagcgccagctcgaggcagtcgatcgcgttcttgacgagatcggtgccggcgagcgtttgacgcttacggtgttcaataaaatcgatcttctcgatagcgttgatcgattgagtttccgtcgtcgctatcccgaggccgtgctgttctcggcccagacgggcgagggactcgacgatctcgtcgaccgtattgctcgtgaggcggctgccaccgatgtgttgctctccgctgatatcccgtatcgcgagggcgccctcatcacgctggtgcatgaacagggaacccttttgcacgaggaatatcttgagggcggcgttcgtattgttgcgaagctgccggctcgcatcgcgccgcggctcaagcgttatcgcaccgagtagacgagctccaaaaagcccagaatagtgggctgatgcagtagataaaaggggagtgcgtgacgtccaaggctggcgagcgccgggatgggattggcgtaggcccagcttgggacggtcttatcgattccctgcgctatgtgtgcggcgaagtatcctgcaagatacataaagaaaaacgggatgatggggtagtaatcacctgaaacaaacccagtgctcggaaatcccagccacgccaggtaggggacaggatagatcgttttggggatactccaggtgagggcgaacaacacaaggcatagggacatgccccatctcgccgatatcttcttaaggacgggatcggtcaacgccacgatgccggtacatgcggccatgcagtagatgatgccaaaattaacagaatcgtcaactgagacaagtgttgttgccaaccagacgacgagtgctgctaaggcgtatttggcggcacgtttgatattgttgcgcgaaagggtgcacatccaacccgcgataaacaaaaatacccagctgatgctggcgcgccagatgtcttgaaagacagtctgggtaaaccagggcatatcccagtcgtacaggtaggcaagatcgtagcaagcgtgaaaacctgccattgaaatcatcgtaagcccgcggacggtatcaaagatggtgatgcgtttttgcattacgagaaccggcgcatcaagccgacgactttgcccaagataacgggattcgttgcatagataggctccatggtgtcattctcaggctgcaggcgtacgcgtccctgctccttgtagaacgtcttgacggtcgctgaaccatcaatcatagccacgacaatttcgccgttcatggcactcttttgttcacggacgatgatgtaatcgccattgaagataccgacattgatcattgagctcccatgcacctcaaggataaaggaaccctgatcagtggcgatttcggtcgggatagtaaatgtgtcttcgatattctgctcggccagaatgggaatcccagccgcgacgcgaccaacgagcggtagtgagaccgttccgcgaggtgcggtggtctcgtcagatttagaaattgagacagaggaaccgtcctcgttaaagagttccagagcgcgcggtttggtggcatcgcgcttgagtagcccgcgcgcctccagggcagatagatgggcgtgcacggtgctgggggaggaaaggcccacggcagaagccatctcgcgcacgctgggcggataacccttctcctgctgatattccttgatgaagtcgtaaatttgctgctgacgcttggtaattttgcgagccatcagggcatcctctctacccatgtcaaacaaatgttcgaattttgcttgacaggaacaactgttcgaagataataataaccgaacattcgttctcgcgctagacatttttgtccgcgcggcttgataaaactgttctcagcaaaacacgcgagaggagaacatgatgaacgcaacgaatatggtccagggaaacctcgcccttaagctcgagacgtctgcagaatacacttttacggttgttcagggtggctgctccggctttcagcctttgaccgtaaagcctgctcgcaatcagcaggctgtagccgcgccgggccgcgttgccctgaaggttccgacgattgtcgccgttgccgttgcgcttacgctcttctttgtcctcgctacgtcggtctttagcgctcgtcacgccgcgtatgccgagtccgtttccaacgttacctatgagaccattcgcgttcagtctggtgattctctttggtcgcttgccgaggaatatccaatcgaaggcctttccacgcaagagacttccgacatgatccgtaacgtcaatcatctggagcatggttcgctcgccgccggtgcgcatcttaaggttcctgctcgttcgtaatcattatcgcgctgcgcatggtacccttgttatcgtttaagaggaggtaccatgcgctgtcccaaatgcggcaaggcacatacccgcgtcgttgattcccgtatgcaggagtcaaataacaccattaagcgtcgccgcgaatgttgctcgtgtaactatcgctttacaacgttcgaacgatgcgaagacccaatcgaggtcattaagtcggacggaaccaagcagcggttcgatcgcaataagctgctcgtcggcttgatgcgcgccactatcaagcgcgatatcgacactaagaagctcaatgagattatcgatgacatcgaggtcgagctgcgctctcgcacgctgacggccgttacgtcccatgagttgggtgacatggtactcaagcgcttggccaagatcgacaaggtggcgtacatccgctttgcctcggtctaccgcgatttcaaagacgtcgatgagtttctgcaagagctcgacaagctaaggtgattccatgtccaacattaccgtcaacataaagcgtctcgaccccaccgtcgagcttcccaaatacgcccatcccaccgatgccggcttggatttgcgctccaacgaggactgcattctgaagcccttcgaacgccgtctggtctctactgggctggccatcgccctgcccgatggctacgccggcttcgtccagccccgaagcggtttggccatcaagcagggcctgtctatagtcaatacgccgggcctcatcgacgcccactaccgaggagaactcaaggttatcctcatcaacctggatccctccaacaacatccaaatcaacaaaggcgaccgcatagcccaactcgtcatccaagaagtccccacggtcaacctcatagaagtagaagaactagacgaaaccgaccgaggcaacggaggcttcggctccagcggcgtcgcctaggggcgctcgtatccctcccgcccggggcttacctatatcattccatgctcaaacattctcgcgtcgcttcgctcgctgcgaaactgcgcgtggaacgatataggtaagccccgggcgggcggctactcgcttgaaacaatatttacttttctagtaagccgatgcgacaaaggggctgtccctttgtcgcatcggcttactgtatttatattttcctgttttacctttgcaggttctaatggaggggataccgaagtagctgctagtaagtaaacgcagccgctctgccggagccgcccttatatcgttccacgcgcagtttcgcagcgaagcgagaatgtttgagcatggaatgatataagggcggctccggcagagcggcggacattcgactagcggatatgcgcgggctttcctccccagtagaagcggcagaaggctcgtttacgtttttggggcttacctgcaagctccatggtggcgatggcgatgtcctcggctgcgtgtggacggcgcaggacttcgccattgatgagcagtgccttgagcgactccggatgatcgtggagatggcgcaacgtcacgatgagttctcgtgcggtggtgacatgcatgctggcgcccatgccggtgagcatcgtggtgtttgccttttcctggccataggacttgcccagcaggatcatcggcagatgcgcgcacaggcactcggtgacggtgagtccgcccgatttgagaattgccaggtcgcagccgtgcatgagggccgccatgtcgtccacgtagtctagaaccgtgacgttttcgagcttcatggcgtcgaagagcgtcttgagtcgggtggcgtattctttatccttgcccggtaaaaagacaaagtgcatgtcctcaaagctgcgtaagaaggggagcgtgtggtccatcgcggcgcggaaacgcacgtatggttggggtaaactggcaccggccatcaccaatacgacggttttgtctatggggagattgaacttgctgagctcatcttcgcgtttgtaatctgaatcgaaaccggctcggatggggatgcccgttatgcggatctttgactcgggaaccttgcgcgggcgcagcgtttcggccataaactcgttggctacacagaataggtcggtgtccttgtggggccaaaagccttcgacttcgtaatcggtcggcacacagatgaccgggtaatcgatacccgtaattacgcgggcgcccacggcaacattggctgctgtgatgtgcgttgcgaccacggctataggcctgcggcgacgaatatattcgttgaaggcggggaacataatacgcgaccatgccgtgccgccaccccagagaagatgtcccgtaagcgtatatcgccaggtcaggtcgtaaatggggcgtgtggctcccgtaaaagaagccgcggtcttattgccgtcgaatttaatacgtccaaaatcaaggatatcgagcacttcaatttcaatatcctcagggattcccttggtgccgcggataagttcaaatgcttgtgcaatcgcgttggcggcggctttgtggcccgatccaaccgatgcgtgcacaatggttactaggggtttttgtgcaggtgaaacggtcatttgctccggttggggagtggcttgcatgggcaggggagcgctattgctcatctgcgtttgatccatcgataactccccttcagctttgttacgcgatttatcattgtagtgcatgagtgtcatgttcacgtaaatttgggtatgagcgcaaagaacgccaatctttcgacaggaggtctcttcatgactacccatcagccgatcgatgttgcgattatcggtggcggccctgcgggctatgctgcggccatttatgcggcgcgctccaacctaacgacgaccgtgattgaacagggcatgtcgggagggcagatcgccacgaccaatgaagtcgagaactatccgggcattccgctcttgagtggcgccgaactcggtgagcgttttcagcagcatgcagagggcctgggagcacaggttacatggagcatggttacgggtatcgattacgatgccgatgcagcgctgtttacggtgcatcacgatttgggcgatacgtcggcctcgagcgttatcgcttgcatgggtgccacgccgcgatctgctggttttgttggcgaggatgcgtatcgcggtcgcggcgtttcgtattgcgcgacgtgcgacggcatgttctttcgcggcaagcaggtttttgtcatcggcggcggcaatgctgcctgcgaggaagctctgttcttgtcagaaatcgccagcagcgtgaccatcgttttgcgccgcgatcagttccgtgcccccgatggtgtggttcaaaaagttcttgcaaaagataatatttcagttaggtaccaaactagtattgtcgagctctcgggcgaagccatgccaacgacgattacctttaaggacaatgcatccggggaaactcacaccgagtcatttgtccctggctcgtttggtatctttgtctttaccggaacgcagccccattccgagctcgttgagcatctagtcgatctggcgccggacggcggtattgttactgatgattccatggcgacccgcacgccaggtctatttgccgctggcgacatccgttccaagcgtttacgccaggttgtgactgccgtttctgatggagccatagcggcaacgagcgtatacgcgtttctccgtggataagtacgataatatatcttatgtaaggttgctatctttaaaacaaagtggttggacggtgcatcaatgtgctgtccaaccacttttacttgccggctatatggtatgaaaaactagataacctagaatacaatatagctaatgaacggaggatccttatgaaccacgccaaacgcgttatcccgatgtccgatacatcggtcagcattaagcctgaggatattcagcccactgtgctgcccgatgcatttattcagtccgatatcgtgcgcaaacttaatacgttgagtctgccgcgctataaccagttgcccaatgtgacgctctaccgcgaccaggttattgagtatgttgcgctgtggatggagccgctgtccatttgcgttgagcagcctgtcattacgccatcgatgatcaataactacgtgaaggtcggcctggtgcctgctccggtcaaaaagcaatatggccgcgagcagattgcccgcctgatcgctatctgcatctttaagcaggtgctacctattgctgcggtgcaggcactctttaacattcagcgtttgagctacgatgccccgacggcctttgattatgtggtcgatcagctcgaggcatcgattcgttcggcgttttccgtcgagcagacgccggttcccgatacggcgcatcaggtaacgcgtgagtcgctgcttgtgcgcagcgcggtttcatcctttgtttcgaaggcttacttgatgagctatctcaagttcaacgggtttaatagctagccgacgtataaaacgggcgggacaaagagccatctgtcgctttgtcccgcccgtttttttgcttggttggactttatttgcccgaagctacgcccatgccgtagccgatgatcaggccgtgcatctcggcgtaataggaatccaggccgttgcagggcatgatgatggtcttggagcagggccaatgttcgactatgcgatcagtaagcgcctgggctccagcttcgttctcaacgtgatcgatgatgacctcaccgcccgtaaagccctcggcttccatagtgtcgatgatcttgttgagcatcttcttttcgccacgcgtgtgcccgacgagttcgattttaccggcctcactcgccgtgcccaaaatgcggatattgagcttgttggcaatgacgccggctgccttagggatacgtccggctttggcgaggttttcgtaattgcacaaactgaagaggattttgctgttctgttcaaggctatcgaagtatgcgcaagcatcctcgaatgagacattcggattgcttgcaagatagcggtcgaacagcaagaaaatgaggtccattttgccgccagctgcgcgtgaattgactagatgaatctgtcggtcgggctcctcggcaagaaccatatcgcgagccgtggctgccgcgttgtagctgcccgacacgccctcagagatcggcatgcagatggtcttgtctgccaatttgaagagctcggcccactcccccacgctgggacaagcgctcgaagaggcattcgtctccgcctgaacagcgcagttgagctcatgaacatcgagcgaaaggtcatcgacgaattcacgctcccccactcgaattttgaggggagcaaatgcaaaggtggtatggggtgcgatcggttgccaatcgcggaggttgcagcttgaatcggagataagtgcccagctcatagagggtcctttctaatcgttcccattcaattatagccatcttgcagaccgattgggccgctatctagtattcaaaactagatagcggactgcactaaaggcaaaagaatggaccccatgactcaaagccacgaggtccatatccgtttgctttatctgaatacttagtagcgcacgaaaatgtagttgttgttcatgccggcggcaacggagctgatgataacacccgtgttgtagtcggaagcatgaatcatctgaccaccaccgatgtaaatgccggtgtggtacgagttgaccacaacgtcaccgggctgcggatcggacacacgcgtccagcccataaaggtgcccgtggtgcccaggcggcaatagcgaccagtgaggcaatagctaacaaaaccagagcagtcgaaactgttcgggccaattccgccccaggaataggcgcaaccaagcttgctgtatgcacgcgagacaacagaaccgccatcgacggactggctcggagcagaaggcgtcggagccggggcaggcgtggagggctgcggtgtcggagcaggtgccggcgtaggagccggagtgttgccgccctggttgttgttattgctggtctggccaccgttgttggtgttctcggtcgcaccggcagtctcgttgctcaccgtggccttctcggcggtactggcgttgatgccggcctgcagcgcggcgttggcctcggcctcagcggcaagctcagcctgcagctgtgaatccagagagtttacgacgttctgtgcttcagcctgctgggcgttaagctcgtcgaccttcttttgcgtggtggcgacgttcttttcctgctcggcctgcttatcggtgagctgctgtttgagctccttgacctcttgaatggtctgagcctgcttatcggaaactttgccgtagtagaacagacggttgagcatatcgctcaggtcatcgacgcccgtcagaacctgaagcaggctcagaccgccggttttgtactcgccggcgacataggtcgagagcttggcctgaccatcggcgatctcctgctgcttttgcgtgatctcgccagcagtctgatcgagcgcctgcgtctgcgtggcgagctcatcgtaaatctgctgagtttgggtaccgatctgctcgagcttcgtacgagcagcggcaaggtcggatgcggtatcggcgtaggcaggagccgcgaggcccaagcccaaaacacaagcgagggttgccgtagcagcgcagcgtgccatgtttttgtgcgtgtttgctgtgcgcatgtagcttcctttccagtaactaagggtaacggctagtccaccgtcaccaggctaaagagctccacatcgtcattagacggtgtgagcttctcgcgcgggttgagaaacgcaagctcaaggatacaaccgtaaccgacaagctttgcgcccatatctcgcaccagtttacctgttgcctcgacggttccgcccgtcgcgaccaagtcgtccagaatcaacacggtatctttagagctgatagcgtcggcatggatctcaattgaatcggtgccgtactcgagctcgtagctctgacttacggtctcgcgcggtagcttgccaggtttacgtgcgggaacaaagccggcgccaagggctacagccaccggtacgccaaccataaagccgcgagcctcgggacccacgaccttggtgattcccatgccggcaaagtgctcggcgagggcatcggtcatggctttgagcgcctcgggattgccaaagagcggcgtgatgtctttaaagatgactccgggctcgggatagtcggggatgtcgacgatttgagattcgaagtcgtacattgcatgacctttcaatgggttgccggataagcggcagctgttatttgcccgcggtggcggtgccggattgcgaaggggtgacgaccttgagcggctttacgagggaatcctcgtgcgaagccggcgcgcctatctcttcgtttttggccttggttgactcggagcgagtgatttcctcatcgagtgcatcgatgtcggcgtcctcgaccacggcgttgagcgactcaaaaacgcggttcttgagcagcgcggtgtgcacgccctccgtcaggtcgtgaagcttcttaaacgcacgctcgagcttggcgtcgcgctcgtcatcggaggtgtccatgccgagcatgctcacgagcacctgctcaaacatcgaggactcgcggttggcggaagacacgtactgacgcaggttgcgcggctcgatatggaagcgtgacagctcggagcagtagcggatgatcgggaaatcgcgaccatcgacgagctcacgattttgcggactcttgatgatgcgaatgaggtcgttctcggcgagcgagcggataaacgaaatctcgacgcccagcatatcgggaatggtctcgataggatgcagcttttgcttagtctccttgggctccgtcttgagcggaacatcggacagcaagcccacctcgtaagcgagcgttgacaggtccgtggcgttttccaagcgctgcttaatcacgttgagtggcatatagcgggtcttctgcaggtgcagaatgacctccaggcgatcaacgtcctccttggagtactgacggtatcccttaggcgtacgatgaggggtaatgagcccctcatcctctagaaatctaatttttgagttcgaaagatcggggtatgcgcctcgaagtaggttgacgacttggccgatactcagatagttgcgttcggccatgccctactcaccggtttcgatgcgctccggcgtgctctcgtggtagatgagcgtaaacgtaccgatctggacggaagaaccgtcgtgcagcggggctgcattgacgatggcaccgtcgacccaggtgccattgagcgagcccaagtcctcgatgcgagcgccgaggccctcgcgaataatgcgcgcgtggctgcgcgaaacggtcatgtcattgaggaagatgccgttcgcgggatcgcggccaatggtggtcacgtcatcctcgagctcaaaagcggcaccagtctgcggacccttgacgatggacagaacgggggcggtgatgcgcacgttggccatgaggtcgggaacggtgacgtcgcttgaaggcacgcggaatacgcaggtagcgtcagcagtcttatcattctgaggcatattgttaaccatgttgtccatgacaacccctaacttatcgcggacgtgccgcaaataatgaaccgtacgtaatcataccccaacgaatcagtcttcgatttcagggttcagaaagtcgatgtcctcgtcctcgggatgcgtgagagcctgtttaatggccgctccgcccttaatggagtagatgacagcggtgagcatggagaagatcacgccgccgtacacaaagaagatgccgaggggcatcgagcttccgttgaggcccgggaaggccgtaagggctgaaggtaaaagatgcaggccgtcaataacggggaacccgagcagcatgagcgagaagccggtcatgagcagcgctgtggcaatctttccggggaagacaacatcgatggggcgacggtgataatggcgcacgataagcgtgccgatgcccagatagatgtcgcggccaataatgagcacgcagacccagatgggcagctctccgcggaccaccagccccaagacgccggtgaacagcagcgcacggtcgcaaatgggatccatgaccttgccgagccatgagaccgtcttagtcatgcgagcgatctgaccgtccatccagtcggtggaggcggcaacggcgtagataacgatggcgatgacgcggttgttgtccgtcacaaacaggtacagaaataccagggtgaggatcaggcgcgtaaaggtgatgaaattggagatcgtaaagatcttattcgacgggtaatcggaagtgccgataagctcctttttgatcttctttttgatgcccacaggactcccccgctggttaacgacaaaactttcgatactatacccgttccggcgatgtctatccagcgtaagcatagagagtccagacatgtggagggcgcttttaggcggcggggatttcgcattcgtgtacatcagcctccaaacatgtcgaaaaatgtcgattttggtggctgatgtacacgttttgattcggtgattacatcgagcgggaacgttgttgctttaagcaaaataatcatggtgattaaaacaaaaaaggtcaggcactaggtgcctgacctgcaaacttctggtcgggacgactggattcgaaccagcgaccccttgacccccagcgaggtcagaatgaccctgacctgtgcttattttgttaaaacacgcgcagatagcgcaagtagcgcatttccgcatttgcatattttaccagctcagcgcggtctgtccagatagcatattttcggcttcgaggagcgcggtgcagccgatgatttaatcaacgggggtaggagccccgaatcgtcgcctctccgggttcccgcaggtgggcccgcctgtttctaatcaactgcggatttaggagcagacatgcagaacgagaaatgcagcaataaaaccttacgcgtatgcggagccggcggcgtgaggaagaacaagggcaaatggcaggctgtcgtgacggtggccgacgagatgaccgggaagaaggtccagaggaccaggaacacccgcgtgccctgtctgaagcagagcgcgcggggaaaggcggcggcgatgcgcgtcctcgcggaattcaggtcggaggtcgagctggaactcgccgaggccgaggaggcgagggccgctatcggcgccgggcttcccgccgaacagcgggatgactacgccgcgctgccgctttccgaggcgctcgagaagttcatcgacttctgcctggagatgaacaggatcaccccgacgacccgcgacgactaccactacagcgccctgcacatcgagcgagacgagctgggtctggtccccgtgaacgaggtgacgaccgacgacgtcaacgcgtggtcgaggcgcaggatcgccctgggcacggcgccggacacgctcaacaagtcattcaagctcggcaagcggctctacgccgtcctgctgaagcgcagcaacgacacgatcgggaggaacccgttcgacggcgccctcgcgcccagggtcattgccaggcccaggaacgcgctgcgctccgacctcgtgccgaagctcaactcggtgacctcgatgatgccggactcgaccttcaggcgggcggtcgtgctcgccctgcacaccgggatgcgcatcggcgaggtctgcggcctgcgctggtgtgacgtcgacttcgagtcggggctcatcacggtcaggcactcggtggcctacgtcaaggacaggggctccttcatcaaggacaccaagaaccacgacttgaggacgatccccgtcgatccggtgggcctgctccccttcctgaaagagatccacgagatcgattcgcagaggctccgggaggcatcggccctcggcctgcgcgacctcgcggacagctacgtcgtgtcgcggccggacggctccttcgccaccaccagttacatccgcagggcgttcaagacgttctcggagaccaacggcctcatgggcaccaacgacgagctgatcacgttccacggcctgcgccacccgtatgtcaagcacacgacaaaaatttttagcttgcgcttgatggattttcaagcgcaggcttatcctgatgctcggcgaaaaactcgcggagcttgtcagcttcatcggggaggacaaagccaaagccctgtccgtccactctgcaatagaaagcaattttcatgactgccacctcaatcaaaaatgtcctggattttgtatgcgatctcaatgcgcttgtcggggtacaccagcaccctgtcgatcagcagctcggccagctcggtggtcagcgtgtccgcatcgaaaattgccttggacgcttccatgcggctgtcctgccgtgcctgttcgtcccgtttctgcttcgcctgtgccaatactgcggcataggcgtttttcgttttcaaaagcagctcgtcacacgcagtcttttccgccttgtaggtgttcaggtcaatctcgcccatgagatagcgttcatacaaggcgcgcttaccgtcttgcagtgcctcgatctgctgctcatattcggtgcgttccggtacggaagcatccacccggagcgtaccgtcaggggcaagtggcgcggcggcttccatctgctttttcagcgtcaggaataccgcctgctccagctctgcggcgttcaggcgcatcttgtggcagcggctttcttcgtctgcttcggaatggcggcagtaataatacgaggttttctgcatggtgcgggacagtgcatggccgcagcagccgcagaaggctttgcccttcagcgggtagtcccgcttctttttgttgggctgtgaaaagcggagctgactggcctgcgcggtatcaaacacggctttctcaatgatggccgggtgatggtcggggatgatgtaccatgattctctgtccttcaggcggcttctgttgccgcctacttcgagaactgcccgcttgccaatcacatacacgccggtgtagcgttcgtcctccaaaatgcggagaatggtggatgtactccaaatcccgtgacagcgggaaatatcgtgtgtgtgattgcctcgcgccgctttgtactggccgggggtggggatgtttctgcggaacagctctcgcgtgatggcggtggcgttgatgccctcggcggcaagctggaagatgagctgcacaacggcagcggcctccgggtcaggctccattctgccatcggcgcttttgcggtagccatagggacagattttgctctgatactcgccgcgctgcatcttggcgtacttggcgctcttggtcttgatggacatatcgcggctgtaatattcgctgatgagatacttgaatgctacgtccatgccgccggtgtcacccttgaatttgctgctgtcaaaatcgtcgctgatggaaatgaagcgggtatggaacagcgggaacacgcgctcgataaagtagccggtttcaatgctgtttcgcccgaagcgggaaaaatccttgacgatgatgcagtcgatttgattggcccgcaccagctcaatgagcttctgtacctgcggacgctcaaaattcgtgccgctgtacccgttgtcgatgaactccatgatctccgcgttcagggcttccggcatggaggccgcatattcgtggaggacaagactctggttttcgatactcagactgtcatacttgtagtcctcaatggagaggcggatatagagagcaatcacatatttctgcattgttccagcacctccgcataggtttcaaactcgctctggaaacgatagcgcaccgtgatttgcttatcatgggacacctcgatgcggtcgatcagccgctcgatgagtgcgccggtcagcgcccggtcggtcttgatttgtgcggcatcctgttccagcacccggtgctgctctgcttgagcatccatcgttcgcaggccgtcctccaactgttccatttccacggcgaggtcggcaatgcggctttcgtacttctccttgtagtcaaagtattcatccttggtgagaacgccttggacgaggttttcatataaactccgcacgatactgcgaagccgctggatttcctgtttgcggctggtgatcttctcccgcagctcagcgcggtcagcggcctgccggggcagctccgcaagagagagggtgtattgccccagcgccgtatcaagcgagtcctgaagcatatctgccaacatatccagcaacgcatcctcgcggatggtcacgccggggcaggcatccttgctgattcggctctggctcagacaatggtagaagtacacatcgtcggacttcttgcggatgtttctctgccggtgcaggctgccgccgcaatgggcgcagaacaccttgcctttgagaagattcggcgtgtaggctttgacctcccgtgccttggcgcggctggcggtctgattgagtatttcctgcaccgccgcgaactgttcccggctgatgatggcctcgtgggtgtcccgtaccaccgtccattcctcggcatcggccttgacctgccggtgatccacggttttggtctgcccctgaacgagatctccggtgtagacctcggagcggagaataacgccgactgttcgggtttgccacttgccgctgccgagcaaattttcgtgggtgatcttgccctgcatcttcttatagtggctgggagtgagaacgcccgcttcattcagccgcacggcgatggtattgaggccagcgccctcggaagcccagcggaacatccgctgcaccacaacggcggcaacagggtcgatgataagctggtggcaatcgtcctcggctttcagatagccgtagggagtacgcgccccgatgaacttgccgtccttcatggcctgccgctgctgcgctctgatctttcgcccaatgtccaaagcgtaggcttcgtttatcatgttccgcagcggaatgatgataccggaatgggcgtcctccggggcgacggtatcgaagttttcattgaccgcaataaagcggatgttgcggatgcggaaatactgctcaatgtagtagccggtgtcgatggtgttccgccccaaacgggagaggtctttcacaatgacgcagttgacgtgaccagcctcaatatctgagagcatctgctgaaagcccggacggtggaagtttgtcccggtcgcgccgttgtcaatgtaggtatcgtacacgctgatctccgggtactgctccagatagcgggcaataatcatctgctgggtttcaatggatacgctgtgcgtgtgggtatcctccaccgaaaggcggacatagatcgcggcgcggcaagcggcgtcagcctcctgcacggccaccgcagccgtttcttttctgcttttccttgccatgctcagcccacctttctctgttcgtaatctttctgctgcgctgccagcgccagaagctgcaacgcctttttgtattcgtcctcatgggtaaaggtaatatccagctccttcttcccacggacgcggatgctctgtaccatgtgaatgagcgccctgcggtctaaggtttccagcgtggagaactgcgtaaactgtgaaatccagcggttgcgctcactccggttttccagcacctccgtgagtttttccttgagaacgcggacgctttctcggatgtcctcggcctgcttggtgtactttgccttataggaagcgtattcttccttggtaagcataccccccacaaggctctcataaagccgtgccttgaactccagcacctgctccaaccggcgctcgttgtcggtgatgtggtcgctgtattccttggcaagcgcctgattgatgctggtctggtcaatgccggtcagcagcgcctccagagaagcaatattgccgatataggctttcaggctgtcccgcacacagtcgatcaggctgctttctttcagcatgaccggatgggcgcagccctttttcttgccggttggacaataatagtagtggtactccttgccgttcgcacggttggtcttgcgggtcatgcggcttccgcagcacccgcagatcagaataccggagaacaggtaaaccgtatcctcgttgggagaagtccgggtatccagtcccttaatgcgctgcaccagctcaaaatcctgacgggcaatcagcgctttatgggcatccgggacgcgcacccactcggaggcggggcgctgctccatctgcttgatcttgtaatgcggcgtaccctgtttgccctgcaccagcgttccggtataggtttcgtcctgcaagatgcggatgatggtggttgctgaccacttgcagtcggctttgtccgcgtagccctttttcgcgtagggcagaccgttgttcttcttgtacgccagcggggagagaatacccagccggttcagctcagatgcgatcttggaggcgcttgcgccctccagccgcatacggaaaatgtcgcagacaacgcaggcagcgtaggggtcagggacgagcaaattcttgttgtcctcggctttcatgtagccgtacaccgggaacgcgccgacgaaatcgccattgcgccgcttcacgtccagagaagaacgggtcttgatggaaatgtcccggcagtaggcttcattcataatgttcttgaccgatacggtcagatcatcgccgctgtcgtgggcggtgtcgatgctgtcggtgatagcgatgaaacgcaccccgtaggccgggaatacccggcgcagataccggcctgtttcgatgtactcgcgccctaagcgggagaggtcttttacaatgacgcagttgatgttgccatcggtgacatcctgcatcatttccttgaacgcggggcggtcaaagatgatgccgctgtatccatcgtcgatcttttcggaaacgacctcaatatccgggttacgctctacaaagttttcaatgagcttgcgctgattggaaacgctgtcgctttcgctggaatgatcgtcggtgtaggacaggcggatgtaagcggtagctttgtatttaggcatgaaaaagcactcctttctcccggactgctcccgcatgaaaagagtggttatctggctattaggttttcatccttttccacaccgatcatagcactctctgcggaaaaaagcgaggatgtcgctcagcgcaaaatgccttgcagacattcctccaacgtaacgccgttcccggcaaagcaggcgtttaccacaaaatcgccgcagcggaagcggtaaggatttttgatctggcggataaaggcgacaatgcgttcttccttgggaagatttttgtctacggatacttcccggatgtccaccagttcatccgtgtggatttgggtttcgtttggcgtcggctgcatcatggcgatctcctttctcggtttggtgggtttcctcaaggtcacatgaatgcgctgacggaaaggccgtcagcgcatggtatctgactttgagaggcggctgcgcgggtagaattggagccacataacataatggcgaataccggcgcagccgctctgcttgtccatttgagaagatccatcctatttgccacgcgccccggatagtgggcatgatgcaggccgcccttggcagggctgtcataactccacgataccgctgcctcaaagagctggcgcataccgcagggttccccctcaagtctgtgggagggcgtgagcaagtttcattatccgccgcgctgtcatcgcgcccgatttgccgaatcgggtctaaggctgcgtagatcgctcggatggcttttccggaatcacctccttgaagccatcgtcgtggcggcgcaccttatgccgctatcacgcgggttttgtgcctgcatcatggtctattcagttttcaacgttcaacgaaaggcttcgtggagaatgtcccttcacctatcgccgattttgggccacttttgcaaggtgtttttgaaaaacctcagaaatattttttgatttttctgattgctgctgtaatgttgagagaaatagcctgatgcgacacgccttcgacttttccaatctcgtcaatcgtcattccatccacgaaatacatccacatcctgcggaactgagtgtccgtcaggtgcttcctgatttgcgtaaccttttgggtgctacggcggatttccgccacccggtcatgcgcctgctccatgcagatatccgcagcgggaatagatgctgcttcctcggaaagctcgtccagtgcaagggtatgattagcgtagacatgatcctctttctcggaagcatgatagtctgcatccgacagggacttccatttcagaaattcttcctcgctggcaaagtcctcgcgggtcaggcggatgatggcttcgttggcatccatgtaaacgatagcgttggggtctttcttgttcagcgcatagctgctctttctgttaaacataatatgtcctccgtttcggtgttgggtgggtggtgaaccagaccaacaccggcggagaacgacagccgacaggaaaacgtaaaaaggcgctcgaacaggcatgatgacctgaacgagcgccttgcgtgcgagtgaaaacatgagtaacgaatactgtaccgggaggggctaaatcacggatgaaccaaaccgcataaaaagagagctgcaactcgctttcgtgagtgcagctcgtctgggggatagccgcgtgctttttgaagtggacggctaatcggtgcttatgcttttttacatgaccgcgagcggccttagcagtatctcctgttcatccgtgacatcataaaattacctccaactcgctgaatgtgatttgcggctcattcaatgtgagcttcatgtgtatttaagtgaattgaggctcactctacaatgtagtagaggtgatttacaatgaactttcttgacctgttcgcccaaaagcttcgcgaaaagcgggagcagaaaaagatcacgcagcgcgaattagcggaacggcttaatatgtgtacccgaactgtcattgagattgaaaagtgcaagagcaatccgaaatttgaaacggttgcgctgatctcagaagaaatggacatcagtctggatggaatcgtgttccacgatagagcgccgcagaccgttgccaagtgcgttcttgattactttgcaggaaagggtgaagaagagtcgcaacggtacatagacctgtgcatgagcgcagataagctgaagtgatgtacaggggaaaacaaaagggccgatgattgtctttcatgtagagcagccagtgggcttatattttccccactggctgctcttgtccgcacagttggaacgacgggcattagtatcctatttttcctgtttgtgtgcatcccggatcttttcaaaggtgtcctgactgatggcgtgttcaatccggcaagcatctcgctctgcaatttcagggtcaacgccagctgcgataaattgctctgtaaagaactgatgccgctcataaattttttcggcaacattccggcctgtttcggtcaaatgcaaaacgtaatcactatctaccgttaaaaagcccccttcacgcaaagccgacaccgcatagcttacactggcttttgaaactccaacacgccgtgcaacatcaatagagcggacagcaccgtgattcttttgaagaaccagcacagcctccagataatcctctccggacgcatgaatcatcactattgtctcctttatgcaaggctccagccggaggactttttacggatatttacaaaatcctgataaatcccggcttttgccataagctcgtcatgggttccctgttcgctgatccgtccatcggagatcaccaaaatctgatctgcctgacggatggtattcaggcggtgtgcaatcacaagcaatgttttaccctttaccagttcattgattgcctcctggatatagctttcattatcggtatcaacacttgcagtcgcttcatccaaaatgacaatcggtgcgtccttcaaaatgcagcgggcgatagagattctttgcttttcgccgccggacagagtagcgccgccttcaccgatgactgtctggaatccatctggcagcgccatgataaaatcatagcagcgggctttttttgcagcctcatagacttcttcctcggtagcgtccggtttacccatgctgatattgttgtaaatggtatcctggaacaagtacaccctctggaaaaccatgctgatctgttccatcagttcggcgagaggtacatcccgaatatctgtaccacggattgtcactttgccggatttcacatcccacagccgcgccagaaggttcgcaatcgtggatttgccaccgccagacggtcccacaagtgcggtcatggtattcttctgcatagagaagctgatgttgtgcaggacttccttgtcctgataggcgaaggccacatcgctaaattgtacttctggctgatccggctgtgcctgtgacagaatatgttgatttccgttatcgggaagttcgggctcgtccaaaacagcttcaatgcggtctaatgcggcattcatcacggtcagtcgggttgcttctccataaagagctttcagaggtccaaagagatcaaagacaaacagcagcacgcccaaaagataagccagggagagtacgccttcctgatgtaaaaaaacggataaaccgaagatagcggcaatacccacgccatagagaatgtttaagccagtggtccacggtgtcattttctgctcaaacttcgtattgacatcccttgattttttgaagttttccgttaattcgtcagatttttctccgagcagattgtaacttttgataaccccaattccttcagcaaaagacaagaccgcatccgtcaaattctcgctttggttttgacgcccgacagcctccttgaaggaaaccttattcatatattttgcaaccagcgatgccagcaaggtaatgattaccgcaatcagcccaagtctccaatccagtacgaacataaaaacagctaaaaccaaagtagacagcatatagctcatcatgttgccaatggtactcatagaaacttcctcaatgaaaaccatatccgtactgagaacagagctgattttgccaatattccccgatgtaaagtaacccatcggcatttttcttaaatgatttcccaactccatccgtttatcagcaaagatcataaatccagcggcactttgcagacggtcgctcaaatagtgaaccactgtctgaaccactacaacagctaataatccaagtccgacaaacagacaggtctttccagtcagcgtattatcagcaaacccggcaaagacaataaacgccatgaagatcggcattttggagagaatggactcgacaaatgcacatagaaatgcagcctgaatacggcttttatacctcccggagaggttcaggattcttgaaatcaatgcaaacatttatcttccctcctttgcagtagatactttccactcggcgctgtcctgagccgctttccacaacttttggtattctgggcaagcttgaatcagctcctgatgttttccggttgccaccatctttccgtgatccataacgcatatttgatctgcgttcattatagcgggaagtttgtgagcgataactaccaaggtttttcccttcaccagctccgcaatagcagcctccattttttcctcattttctggatcagcataggccgtggcctcgtcaagcactacaatcggggcatccttcaatattgctcgcgccagggaaattcgctggcgctgccccccggaaagcattttccccgcatcgcccgccatggagtgaataccttgcggcagcttttccagaaactccatacactgggctttcttcgccgcctccattacttcctcatcggtagcatccaaacgtccaagacggatattttccagcagggaggtgttaaacaggtactgatcctgagccacataggaaatgcggctgttcaatgcctccaggctcatatcacaaagtttctgcccgccaatggaaatgctccctttctgcgggtcatagtagtggatcaacagttttgcaagggtgctcttgccagaaccggattcaccaaccagggcagttttttgtcctgcttttgccacaagggtaatatcgtggaggacttcgttttccgctattatcggtttcccatctgggccaggctgtgtcgtttgatacgcaaaggaaacatgatcgtaagaaatgttaaaatcctgtccgtggaaatcatcctcagcagcttgcagcggtgccgcatttaacatctgttcaagtgccgtgatcttataattcagattcggaatcgtctccataaagcccagtgctttcaggagaggaatcccaatgctgagggaaaggcagaggactaaaatcaaatcaggtaaagtgcttatgccacagagaacaaaccatgccccaagaggcaaagtcagaataacagtgcagggcagcagacttccgtatatcgccatccagggccaggcggccttataccatgccaaggtataatcccgatagtccgttacatccttgcggaagttctcgtaagattcactctcccggttgaaaaccttgacaacctccataccattgatgtactcaatgatcgtgttgttcattttctgtgcagactgatagtagggacccatgcgcttcattccaacagagtacataatgaccatggagagcaggctgatcgggatagaggccaaagacataagagccagtttccagtccgcacaaaacatagcaacataaatcaccagcgggatcagcaaatttgcgataccctccgggactgaatgagcaaggagcaattccaagctgtccacatcatcgacaaacagctttttgattgtccctgtccctttttcctccacaatgccaaggggaagtttctcaaacttctcttgcagagatacccgcagccggaacaatgtgttatatgctgctttatgagaaattgataatccccatccatataaaaccgcctgcaaaacaagacagatcaaaacccctataacacgcaataaaacaaattctgtctcaacagaatcgcccataaccaatggtgaaatgacctgataggccagcacaaaaggcaggacgcccataagaacgctgaccagtacgacaaccgtggccacatacatatttttcttatatggccctgcgtactcaaagatttttttgaacataagccctccttatattgagccgtactgtctgtgcttcaaaaacaagaggccgccaaagtaaagcggcctcttatcattatctttctgtccagtcaaggcggccctgacattcataatttctaaaattcactggcggattcggaaaaaatccaaaacctttttactgccggattcgtccaatggatagctttcttttatttgccctttttccatatggactacatacgaacatcccgccatcaccaactccggatcatgcgtaataacaagaagcgttttgccctgatccgcgagtgacttcaaactccgcgcaacttcccacatatgtttgagatcaagcccgctggttggttcgtcaaacacaatgatctcccggttactcacaatggcagatgcgatcgctacccgctgtttttgcccgccggaaagagaaagcgggtgcctgtctttatattccagcagatcaaactgtttaaggatttcatctgcaacagtttcatcctcgttgtccatgctcagaagcacttcatccatcacgctttcggtaaatagctgatggctggtatcctgcattaccatgtagcaatgtttgagccgggctttccaatcaagggttttcccgtcaacctgcaaaaggccacacttcttttccagtccgcaaatacagcgggccaaagtagattttccagcgccattcaggccgataatggcaatcgtttctccaacaggcagttcagcactcggaatatggaggctttccggttcccgctttttatacgcaaagcagaaattttgaaattccatcagtttagctgtatgcgcctgatactgattcgcgggtttcaacttcgagagagaaaacggccgcagccccatttcttttcgagtgctatccgataaactgtcaaattcagcaggcgtgtattcccgttcaatctccccatcttttacatacagcacacgatctgcaagatcgtgaaggtagtaaaggcggtgttctgcaatcagaattgttttgccctgctttttccagaggctcaagacctgccgcaggtcatcaatagcagccatatccagattagaagatggttcgtcaaggaccataattcccggtagcaatacacttgatgaagcacaggctattttttgcttttcgcccccggacagagcaaacacgcttcgccccatcaaatcttcaatatgataatcggaaactgtacggtcaatccttttcaggatatcttcctggggatagcctaaattttcacaggcaaaggctaattcactatccgtatccacgttgaaaaactgacttttgggattctggaatacagatcccaccatagcagccaagtcataaagcggcgtatctgatacgctttttccgtccagaaggacatcaccctctaaattgccctcgtaataatgaggcaccagcccgtttaccaaacgggtaatcgttgttttcccacagccggattctcccgtgagtaaaacaaattcccctgtgtttatggtgagattgacatttctaatccctccgccgctggattcttcaccataagaaaaagaaacattttgaaaatctatcatggcaaaatccctcctgcggaaattatcggggaagcaatcgcccaaaacactacaaagcaacaaaacaagatcagcaccacatcggcaaaattgaatttaagctggcaaatgtttgtgcgtttgacaggagcaccgaggccacgggtaattgccgcagcggaaagttcctcaccgattttcacggagcaggtaatcatcgggatcagcttatactccaatatttttgaagattttttccctccaagtttaatcccacgcattttcatagcgtcactgattgcttctgactcctgaaagacagttggaaagaagcggaacatgaccgttaaggggatcgtcacttctttaggcatatggattctttccatgccggaaatcaattcactgaccgttgttgttttcactgcataggcagcaatcgcaacactgggaaggattcggcagaagaatcctgttgtaaacagaacgaggaaattcaatattcccgtaaggtgcggtaaaacataaatttgaacagcataaaaagcagaaaacacagcaatatagcccacagcttttgcacattgtttcgaggtaagcagcaatatagccggaaccgtacaaagaacaaggcggatcagccccatagcttctccgcctgttccacccatgacaaaaatgcttatgatgaagatgagcaacagttttgtacgcggatcgagccgtaacccttgttctgtttttttgctgagcagaatttcccgcgccattatgcaataccggcacgctggaagtgctttttgcaaatagctttcccaatcacacctccgacaaggccaaacacaaagcaggcaaccagcagaataggcgcaatccacataggcatatatgtattaagggtagctgcatattcagcgccgtatccttcagtcaacattaccatatagctttcacggttcaggaaaatgggagcaaagttgccaaacacccagatgctgaacacgccgcaggaaagaactgtactctttgcacttttgtagtccgcctttttcaggatcacgtcggccaacaggccgccaacgagaccagttaccatagtaagatagccgttgccgaagaacaccatgattaggccaatcaggaaacccatgattgcagtcatcccgaattttttagcctttgtaacatacagcatataggggatgccgccaatcaaagggcacagtaccgccatcagcggaataaaaatggggataaagccaagcatcgccaccagcataacaatcacgacatagatgacggtgtagatgccgatagtaattaaatcttttccctcaagccgggaactttttttctgggaactcataccagtatcctcctctgagaaaatgaaaatgtggtgtggttagagtgttctaaccacaccacgcattttagcaatttcatgtccaatatccaacccaaaagcaatttcattctacccaaaatcggtatttattttgggtatgcaaagcacctatttgattcggctggcctctcgataatcttttggcataactccatactttttcttaaatgcagcagaaaagttgctgggctttgtataacccacaagaaccgctatctgcccaatgttcatattgctctccaataacaatcctgcggctcgctctaaccgctgctcaataacatacgcatgaaccgaaatgccgtacatcatggagaatccccttgataatttagagacgctgatttgaacctgccttgccagtccttcacagcttggcgcaaaggcaagctcgctgtcaatgattctctttgcctcgatgatgcaatcacgttcactttttgatatgcagcagtattccggcgagaggattcgcagctccaacacttcgctcaaatatactgacagcaattcgtggattttgctttccagaaacagatacccaagcccaccccgataatgtgtaaagtcttgtaactctgcgaaaatatgctccatatagggcgttatgctcacctttgaaattccggtcagcagtttcttttcatagacggtaatctcgccatcctcgaagtagtcctgtaataaacgtttgaaatatggaacgggaattttgatgttcttaaaatagaagtcgctgttttgcgcataacagagagactccattttcccgtgtccacggtaaatgcaggattctccctttgcaagacaagcgccctctctgctgcctgcaatattccacgacacgccgtcgttcaggcagaacagcatttgaatatagtcctcgctgttaatcccgcgcacattcatgtcagaaaaataattcatcttccagtctgaaacaacggcaccctgttttgtcaccacctgcgcaatttgtccggttcccatatcagaaggaatcgggatcgttacggtctgcggtgaattggagagcagatcccgatagaggttgttcatgtattcgcttgtcattggatgccctccttttttcggttagcagtgactaatgtactaatatagtttacacgatttacgcctgaaagtcaattttcagcacgaatgcaagctgctacagaaaaaatcagggacgttcccgcaggggcagagtgccatgtcgcgcagttcgggtacgacgaggcgcagacgcagacacggtcaaccggccgcgtgcgaggcgaagcgttacgctatatgcggcatcgaaaaccacggcttcagaggggttacgaacgggaacaagaaactggcaagcaatgcaaagcggtacccactttgcgaaaacaggcggattccgtttacacggagcccgcctgtttcatgcttgttggggcgctgccccaatccccgcagaacacaaaatgtgtgttctggaacgcaggataaatcctgcggctgcgcgattttgcaaatcgcttgtgggcgggtagctcagcgctgctccgcctctttttcccgtcgttcattcgcttcctcctgctccttgtccagctccagaatacggtcgatattggctttggccgtcagcagctctttcatttcctcacgggcttttcggtattcggcgtaggccgctttcttctccgccagcagctcggcgtactcggtattcagcgccttgatggtgggcagcttcttgaagcccagtccatcaaaatagtcctttgcggccttgtggatcgtgatctcgctttcatgctctgcaagaaatttcttggagtaccctgccttgcgataggcaacgtaggtatcgcgggtcttggcgtaattgacaatatgctcccgcagcaccgcaatctcggccatgcgtttttcagcagatttgatccttgcggaaagctcattgaagtgagcggacgctgccgccgctttctccgagagaacggcgtaatctaaaagctcatggtcttgcagataggccaccgtctgtgccatctgtttcaggttgaacaacgtcacccaacgcgcataaccggcacccttgccagcgcgtaatttggcctgaatgtccaccagcagattcccgctgcgcttttgcggtttgactggcggtgcggcgctctttcgcggcgtatgcgccttttcacctgcaatcaccgcgcggagatctgcgggagtatagccgtcaccgagggtatccatgcgaatggactttttctgttcgccgcctaacagggacgggactttcttgcccttgatctcatacccggcctgccgcagctgctccagcagcgtttcaaagctatcgggcttttgtgtcagcgcatcgtcaatggccgcgcagattcgctcccggtgggagggcttctttttgtcgcccagccacttgttgtagctcttgccgtggcgctttggattctccacgatggagtagccattctcgatgcagatggtatcgttgagccgccgcacggcgcggctgctgccccaaaagtttctgaatttccgggtctggctgagtgcggtggagttccagatcacatgattgtgaatatgggctttgtcgatatgggtgcagacgatataggcgtgattgcccttggtgaagcgcttggccagctcacagcccaaacggttcgcgtcctctggtgtgatctctccgggaacaaaggattgccgcagatggtaggcgatcacatcatcctcgccgcgcactctgccggtcttttgggtgtattgatttttggcgaaaaggaactcggcatcggcgatcctgctgtcgcactgccagcttgttatcagcctgccgccgtctgtcttttgcggatttttggtgtagtcgatgatagcgctgatggcctgtcccaccgtgcggcctttgccggtgtggagaggcatcaggcgtgtggttgccatgttggacacctccttgaaaagtaaaacggcctgccgaagcagaccgtttgaaatgtgttaatttgcaagaggtaaaagcaaactgatagttcgacaaactggaattttcaaattagtctttgcaaataacctttgaatcttcaccatcaattacaattccctgacggttgttaattgggcatagattcaaatccgaaaactcagtcattattttctcggtaactttcttaaatggtgctgtaagataatgcggaagaacatagaaatcaatcaaatcaatccctgcatcatcttcttgtgagtagtcctccggcttttcatccatttgctcgatatattggatgcttggagcgcatataatcgcacctgccgattcaccaatcatcagttttccctttgccaattctttcttcaacagctcatccgttcccgttttacggagctggtctataaggaaaaaagaatttccgccggtaaaatatatcacatccgcatcttcaaaaacagactgtatcgttgaataagcctccgttgaaatatcaatttcagttacgattgctcccaactttttgaataattttcgagccgagccgacataaccggtgtagccttcacgcagcgaagctgttggaataaatgcgacttttttattttcaatttcttcctttatcagacttcctacacttgaaaagtgcgaacataaaaacagtttcatcaatattctcctttatatataaattccgatttgctgctctctattactcccgtgccagttcatataggctgcggatggattccatgaccgtatgccacgacaggtcggcggcataggaaaacttcttctgataagcccgccacagcttttccatgttcgggtcggcctcaacttcatcaaaggccgcaggcgcgtcggcaagatacttctctgtaccgcgtttcctggccgttgcaatgagcgccgcacggagatcggctgggacgatgctctggccgtggagctggctcagaatgtgcagatcatagaaatctctcatgcgggtgttggtggtggcgcgggacacgacagtttccagcttctcagccagaacagtttccagattgtacgccaaaatttcaatggaacgatcctccagcatcagcttgaagctgtaacgcacttcgcggggcgtgatggcgtcgccggtggaaatgtcgatcttgagcggcgttatcacgccgtcaaactccgtttccatgctgacacggatgcccggatactcggcctcgtccatgatctcggaaatgcgcttcacccggaaccccacgccatcgtccaccggtacggagatgatggaggcaatcatgttctccacgtcctcgatgccgaccgtcgcaccctttacggtcgcgtcaatgtccatcgtggagcgggcgtcaaggccgaccattgcagccaccagcatcccgcctttaaggatgaacttgtcccgatattccgaaagagaaatgcgctccagaaagcgctccatcatgtaattgcgcatcaggatttgcgcatctgcggatttgtccttggagagattgcgtatcaggtctttgagctgccgtgcagtcttaatcataagagtacctccaaatactgccgaagcagtttttcaacacggaacatctgcgcatagcgcatcagcttccgcaagtccttgtcttttcgttttgcgtattgcttgagtgcatcctgaaaggtctgcatctcgattccactgcggctgcggatcagatcgcagatggtacgctccatatcatagacgggaaccgggttgccaaagggcgtgttcatcgtgacgatccccacatcatgcaattctttcttgatggtgtagaccttgatgccgtctgcttgcaggctggcaggattgtagccggtcttgaccgtgatggaatacggattcggctcccggtcggtcaggtcatggaaaaacagcgcgctttcatgggagaatacggcctgcgcacagcgaaggtgcagcaggtacatggcgtccgtccatgcgtcaggcgaaacataaacaccgtgcgcggcctgctctacgccgtgctgcttggcgtaggcgtaaaacgtggacttggaaataccgatttccaaaacctgcgcggttttgacgatcccattgttttgctgaaaaagcagatcaagccggtcgtaggcggtcatgttatcacttccttcttgctaatattatatccgatattagcaagaaagtaaacaacgattttagaaaagcaagccgaggcgttcgccccggcttgtgttttaactatgaatgaagtttttcatggcggtgttcatgtcttgcagcttgccaagcccctgcacagccagcagcggaagtcccatcgggctgatcagaaacgccagcataaggaggatgatgccgttctttacggagtaggtaatcagcacggcgaaagccagcagggagagcagtccgcttgccagtttgaacacgaagccggagcaggacagcagccctgcgcacagccaaacgaacagggacaggataagcgacagcggcgcaaagagaattttcaggatgaacattttgcggcctccttttcacaaagtgcggtcagcgcgtcacgctctttggcgagcttttcttcttccttttcggtcaaatcacgatcaccgcccgtgatctccagctcgcggaagctctcataggcgtttaacaaagaatcccgcagcgcttcgggcgtagggcaaaagtccacggtgttccagtcctgacggtggttgtcaaaacccatgaccgtgtagcctctgctggtcaggacaacttcaaaatccgtatcgcggttgaggtagtcagaaaatacttttagcacaatttcgtttgtcagcatacgttccgcagctcctttccaagcagtcaaatctttttctgatattagaatactttgcccattggtgttttgcaaggatgcggcaaagtcatacgaatagttttcgccttttgcccgacatctaaccatatcacataatccttctttagtacagctacctgaactaattttctccagatgggaaatataatattggtacagttacagggacgggaggtgtggtacttgcagttgaatgaagccgtcagcaggcgtttggttgagctgatgcaggagcgtggcatgacgcagtatcagctttatatgaaaagcggcgtaccgaagtccaccatcggtaatcttgtgaactgcgcatacccgtctatgaagctgcggatcatccacgagctttgtcagggattggagatcgacctgagcagcttttttgcctcgccgctgtttgatgaaaacaatctggaaccgtagaagctccgatgctgttttgcgtcggggcttttgcttttgtgtgaacaggggcggcggagtgaccgccgcccctgcgacttatttcagcgccgccagcgaggaaacgattttctctgccgccgtccatatccgttcctgactttgctgaatgtcctccagatcggtttcgtagatacggcctgtttcgtgggcgcggcgggtgagctggttgaggttgttgctggaataccgaagcagggacaccagctcccgcagctccggaaggtcgagcttcaccacatatccgtcaatcgccatcttgcggagatacgccgccatgttggtggtgccgaactgcgccatctttgtttcgatcatttcccgttcctgcggcgtgacgcggaatttaagctgaatatcccgcttgcgttttgccatcgctcagcgctccggggctttggacttcgccgaaattttcggcgaagttgtttcaggcggctttttcagcttgtcccggacagaggctttctgccgctcctgcgcgtaggctttgcgggtctggctgagaaacagatcgaccagaccgggatggctgttgacggccagatagcagttgcggtcagtaccccatgcgtcaggattggcggggatggacatggcgtttgcccatgcccggttgtcgggagaatagcgcctgtcccaatccgcttgacagacggtgatggcaaggatatgaaacgcgcggtcatagccgaactgctgcaccacctgatcgaccgccgctgtatccagccggttatcccggtagtggtcacggatggcggtttcaatcgcttccttgcaggccgtgttcgcttgattggatgcgcggtaggcggcaagctcgtcatgctctctggcataggatgccgggtgtttgtaaacggggagatttttcattatcgtgcctccatttctttcttgtggggcttttccggtgcgccatgaacaggcggcgctttcagcctgtccagaacggaaggccgcgccgattttgcaatcgcctgctcaggctgcggctgtcccttgccgtccagattcagctccatatccaactcaatgagccgcgccgttttcgcggccagctcctgctcctgcggaaacggcttaccgacctcggcctttgccgccgcctgctggttatagaggttttcaagctgctcctgaacgctgcgcaaacgctccggcattttatccagcgcgttctcgatgcggacaaggttgcctctggcatccgaaccgagttcaacgcgatgggtcatccggcctttcagcgtcagcgtgtacgttttccacatggaatcaaaagcaacggacatggtaaagccgcgatagctcccgatctgtaccgggtctttgcccttaacctccttgcaggtgtccagcagcgcggcaccggcgttttccttatcggtgagccggtcgccgcgaatctccatgccgacaaagccctctgccgggagcggatgcgctgcgagggtctgcatatccgcctccagcccacgaacaaagcccttgtgttcttctatcttttccggaaagtatttcagcagactgtcctccaatcggaattgcttgctgttgtggtctgccttcataatttttagcttggacacctcaatgtccaaatccatacgctccttgatgcggggatcaccggcacacagcgccttgatctccgcaaaagacagcgccgtagcgtccacgtcctcacaggagcgaaccggggattttgaggtcatgatctgagagatgaatttctgcttgttctcaacggtctgccagaggtaggcgtcaaacgtcccttcggtcacatagcggcagacatgaacgagcttgttctgattgccctgacgctcaatgcggccttttcgctgtgtgagatcacggggacgccacgggcaatccaaatcgtgaagtgcgaccaaacgatcctgtacgttggttcctgcgcccatcttggccgtgctgcccatcaggacgcgcacctgaccgctgcgtacctttgcgaacagttcccgctttttgacctccgtattggcatcgtggatgaacgcgatctgttccgggggcataccggcgtcaatgagcttttggcgcacatcctcatagaccgtgaacggcgtttccgcactttcctccaatgaaatcgcgctctccagcgcatggatttccgggctgtccagcgtaccgggggaagcctttgccgcccgctgcgagggcgtggactttggcgtagaaatgtcgcaaaacacaagctgtgtcagtttttcctcctcgccgtcgcgccagtattggagaatgttcgccacgcactgattgaccttggtggtttcctcgtcggggagcatgggattgatgatgcgctggtcaagccccagcttgcgtccgtccgaggtgattttgagcatattgtccacatccgggctgaccgcaccgctgtgtaccttggacgctcgttccgagagggctttcaccatgtcctgctggatctgcgtgggtttggtggcgatggtgtgatacacaacctccggcgtgggtaagtggagctgatccgccgttttgatgtcggcaacctctttgaacagattcatcaattcgggtaagttgaaaaactttgcaaagcgcgtccttgcccggtagccggttccctccggggcaagctccagcgcggtggtggtttcaccaaagcggcttgcccagcaatcgaagtggcccatacccatctcttgcagccggtcatgctgcaaatagcgctggatggtataaagctctgtcatggagttggaaaccggggtgccggtggcaaacaccacgccgcgcccgccggtcagctcatccatgtagcggcacttggagaacatatccgaggatttctgcgcatcggtggtggaaagccctgccacgttgcgcatctttgtatagaggaaaagatttttataattgtccgactcgtccacaaacatcctgtctacgccgagctgttcaaagtaaatcacatcatccttgcggtcgctggcttgcagctttttcagccgcgcctccagtccctttttcgtgcgctccaagctcttgatggtaaagctgttgccgcctgcgagcttggtatcctgaatgccatcggtgatttcctcaatctgctgatgaaggagccgctcctgccgctccgggctgatggggatacgctcaaactgcgagtggccgatgataacagcgtcatagtcgccggtggcgatacgggcgcagaatttcttgcggttgtgggtttcaaagtccttcttggtagtgacaaggatgttggccgaagggtagagccgcagaaactcggatgcccactgttccgtcagatggttcggcacgacaaaaatggatttctggcacagtcccaacctcttagattccatcgcagaggctaccatttcaaaggtttttcccgcgccaacttcgtgtgccagcagcgtattcccgccgtacaacacatgggcgatggcgtttttctgatgctcccggagggtgatttccgggttcataccggagaaaacgatgtggctgccgtcatactcgcggggacgagtgctgttcatttcctcgttgtattgccgtaccagcgtttcgcgccgctccgggtctttccaaatccagtccttgaacgcatcccggataagctgctgcttctgcgcggcaagggtggtttccttggcgttgaggacacggcgctcccgtccgtctgcgtcctcaatggtatcgtagatgcgaatatcgcggaggttcagcgcatcctccagcagccggtaggcgctggcgcggtctgtgccgtaggtggtgaatgccgccacatcgttgtagcgcaccatgctcttgcgggaaacctgccattctgcggtgtacgggacatagctgatctcgatctgtccgcgcagatagcggggcgtttcaaaggtttcgtacatgaattgctcgatgtacttcttatcaaaccatgtcgcacccagccgcacctcaatctcattggcttcaaggtctttcggctgggcagcaatcagggcgtccacattcccagcgaagaatgggtcgcgcgctgccacgcgctgcgcggtacggagcttctgccggacgttgccggagagatattcgtccgccgtctgccagccctttgcccaatgctcgccgccgtcctgcaagtcaaacggaccactgttgggttccttgtaaatgacgcccttcaaatcctcaacaatctgcgggattttctcgctgccgcccatgagggaggccatgaagtcgagatcgacgcaggctctttctccgatgcagacagcaagggcttcgctggcggtatccacagaatctacgctgcgctgctgcttgatggtgcgcttgtggaacatatccgccttgcgctccagctttccgtcgtcgtccagcacttccagtgaacacaggaggtagtaagaggaatcgtcagagaacgcaagacggttcgcacggtcattgattaggccatgttttgcggagaacgcatcatagaggcggtttagctcggtctgcgcttcctgaatccggctttctgcgctgtactcgtccatttgcagggcaatcagctcattcacgcaatcccgcagcgcgaccatgcccttgacacgctcggcggcggtggcgttcagctccggtttgaccatgcggctgttttcccggtagtacacctcgccgtccaccacggtgtaggagtagtttttcacattggggtctgcggggatggacgtgtcgatctgttcgccctcgcccagctctggcagttccgcctcctgataggtgccgcgaatgtttttcacggcatcatggagctgatctgcaagctccagcccctcaatggggacaacggtgaaatcctgcttgccgtattgggtgctttcggaggtctgcctgcctaaaatcatctccgggtggtcaacaaaatagcggttgatagcaaagccatcctcgttctggccgaggtgtacccaatccggttcgatctcaatgggacggtcacgcttttggagaaagagaatgtccgaaaccacatccgtaccggcattggcgcggaacgcattgttgggcagacgaatggcacccagcagctccgcccgctgcgcgatgtacctgcggacttcgggcgattgcttgtccatcgtgtagcgggaggtcacgaacgcgatcacgccgcccggacgcacttggtcgagggttttggcaaagaagtagtcgtgaatggaaaaaccgagcttgttataagcccggtcatctacctgatattgtccgaacgggacgttgcccacggcgaggtcgtaaaagtcttttctgtccgttgtttcaaagcccgcgatggtaatgtccgccttgggataaagctgcttggcaatacgtccggtgatgctgtccagctccacgccgtagagcttgctgccctgcatctgctccggcagcaggccaaaaaagttgccaacgcccatagacggctccagaatgttaccggtctggaagcccatattgccgaccgcttcatagatcgccttgatgacggtagggctggtgtagtgggcgttcagcgtggacgcacgggcggcagcgtattcctccggggaaagtgtggcgtacagctctgcaaactcgtccgaccagtttggtttattttcatcgaacgcatcagccaaaccgccccagcccacatagcgggagaggatttcctgctgctccgggctggcctgtaagccctcaaactccagcccttgcaggagatggatagccgccatatttgcccgaaactttgcttttgcgccgccgacgccgagggcatcatcggtgatgtggaaattctgcgcgttgcggcggcttgccgccttgaagtcagcataagcggcctgctccgcagcggcgacgctgggaaagtcctgccactcgccgtcaatggggatagataccgcaggacggtgtgcgggaggctcgtcgatctcagcctgagagatggcatcatcaaaatcaggcacaaactcgcccatttccgagagtgccgctcggccttcctgctccagaatcagcgcttcttcctcgctcatggcgggaggttcaggctcggcgggttccacagagggcgggtcatgctccggttccgggatgtgcagcgtctggatttctatgtcgtagggcaagtgtgttttctcggcgggatagaacgcgacgggtttggtgatgggctgcggctgctcctgttcctgttcttcaacaaacgagcgtacaaacgcaatgtgttcagcgcggaagatgggaaagccctgcctgttttgaaaagtcacatcgcgcagagatacttcatctgcgccgaaattcacgctgtcaatgacaaacttccgtccgtcaatctccagctccatgccaatggggatatactccttggcatcggcctcgttgataacatcatagccgtcggtttcatttggctgcgcaaacacgaagctgtgtccatgctccagcagccgctttgcggcgcttgcccattgtccaaaatcatagccggtcacagcggtttcgcccataccgggaatatcgcgttgcagcaggcggcgattcaaagcgctggcggctcgttctgcatccgcgccataaaaaagcagccgttctccgacgcggacaccgatgagcttttcgggatgctctgcacgaagtgcctgatatgccgaaatattcggcgcaagctcacgaccctgatctgcaattcgtgtgaggacagcagaaaccggttcggttctgtgttccggatcgtgattgctctcgctggaggatgaaacgacgctgagatgcgcgacagtttcatctgcggaatcaacattatagagcttaccatcaatttccacgcgctgccccataaggttttgaaccgcttgcggcgtctccggggttggctgttctgtgtgctgcgccgcaatgacgcgctgcggctccggttcagaaacctcgaaatatctggtgtcgaggtagcgttcaaaggaattgcggtcgatgctgacaggttcctgtccgggtacgttcggtaacgtgtgccagacgtgatcttcatctacacgcgcgataacgccgactgctgctatgtggtctaactctatggatgaaatgcgatctccaatatgataagtatagccaagcggtgttgtaaacgccggaggggatagctcaattcccatatctcgtttgatgccatccaagtaagcaatggcgttattctgttctgcaaagcggagcgtttgttccccatctccgcagaaccgttccaacacctcatcccaaatgccggtaattccgccctcgccgggatgcagacgaatggagtatcggtcaggtgaaaataaccgcagtcgctcattctcatcgtaaaatttattctcgcggatgagctgtgccaaccgccgctgtacctgcgcccatgtgagcgtcaccggctcggcgtttcctacatggatatacatgggagttttgctatcttcccagccatattttgcagccagccatgcggcggtgctgcgttctcgcccatgcgcctgcatatatagtgcgacttcctgcttgccctttaggttgttgtgccaatccagaagcgcgttgtcaatgtcctcctgtgtgatctgatagggagagggtgcgaccgtcgctgccagcgtgggatacagttcctccaaaagctcctgatgcagccggttatggaacgcgggcatatcaaagtacaggcggacaagctggagatcatcagatgccgtgacaatacgacggatagcgtccgctccctccagataagcgttctggcggtctgaattgcggcaggcattgacaaaagccgtatctttggaaagcgcgttgccaacggtcagcttgtacccgtcaaacagctcccgtaccgtgggctgcggcgcgtcggcggcaggatcgcggatcacccttgtgccgtccgcgccgaactctgcttcataagcattgatggcctgttctgcctcgtggtcgatggacggaagcgtatatgccgtgtgttcatggccggaatcgccaatgcgcgaaattgttacatcatgcttttcccgcagcttttcaacgtatttctccaaatcctttgcagggaagccgcacatggtaacacggcctactccctccaaattgcggcgcgtcagctcaaggctgagatcatctgcaactgcccgcgcatcctcgccatacagctcgaagaagtccccaacctgatacagcacaatttcatcggggtgcgccgcctttacgtcgttatagtcgttataaaccgcgttccgcatggcgtcctgcgccatttccttgtcataggctgcctgctcatccggcgtaaggtagcgattcaaccgaaccagctccgagatgcgcgaagcgaccttgttccaattcatctgaatgtctgcacagccgttctttttcagcacaatgcctttgctgccgtgatcttcatagctgccgctttctctggatacggcatgggtatgcccgccgatgccgtactcctttttcagaaaatcggcattctccttgggagtgtgcgaagtctggaaaaacgcatagatgcgggtctttccaccctcaaagctgctcccgtttgcaagagaagccgcaatttcatcttcggtgataaacctgccggtttctggaatagcctccatatcggagcggaattcctttcgcggaagggacaaatcttccaaacgtgtgagaagtgcctgcgacttgtggtaatggaagcgcagcagcgcacggttttcgcggtaagcgtccatgaataccttgtattccgacaggagcctatcccggaacgccggattcagcagatcgtccgtcagacgctccgtttcctctggaaagctggtgctatggatattacccaagcaggacagataccccagcgactttgcttcatccgagaaatcgtgataaaggttccagacatccacagcaatacccagccgctcatagcgcggggcttccgtgacctcaagattggtggcaaatgcgccgccgtccagaagctcctcaatacgctccgccgcatctgcccagcctatcacttgggcagaacgaagatagcgagaggtatctccggttgcaatatggataccatcgtccccgtaccatgcggaaagcctgccgttatccgtaatcaggccgttgccgccgtagtaaagagctttcagaaatgccgcgcaatcctctaaaggtttttgcttggagaattccgcagcaattttcatccgcgctgcatccgcattaccgcccgcgcgcaggatgtggtcaatatcatcctgagaaatgaacatagaaaaagcggagggtgttacactctccgcttctgcgatggattgaatttgttctgcctctgaggggaagaaggacatctgcgccccagcaggggcatcgaacatatttagctgaacaccagttccgtgaggatcgtttcctcggcctgcgctttcagcgtgttcatcagccctacccacttcatcgggtcgctggctttcagcgattccgtcacgcccgccgacttcatcagctccggcatcatctgttccagccggttgttcgccgcctcgtcgatctcccgcagatgggggtacagcttctcggacagcagcaggctgttccacagcaccggacgatgctccttcaggtaatccttccgcatcctgccgtacttgcccagcggggcttgcggctgctctgtcaggctcaggtcgggaatcagataatccccgctgcgggtgtaggtcagttcgctcatggctttcgctcctttccgcgattttctcgcgctcataattcttgatggtgacttcgatctgccgcagcaccagctcgctggactggctgatggccgttccaagagcggcgacggtctgcggggtattgaaatcaaagacattcagaaaatcctcatgctcgaagtaatctcccggctgcatcccgcagcgggacagcagcgcataggtggtgctgacaacggcggcgttccgaaaagcggctccgatgttgaactcatcatagtcctccaaaaaggaaccgtcaacgatgccgacaatatcgcgccagttgtcgtgccagtattcatctacaagctgcgccgccacacgctccatctgatcggcaagtccgttttcaccggaaacgtcgaagcgctgttccagcgccgcagataccacctcacgatgctcctgccggtattcccaaagataagggcggcgagagttctcgccgccgctggtatcggaaacatcgaatacatatcggagtttgggttggtcgctgctggtatccacaagggcgatgcccttgctgcctcgccgcacatagcggcgcatctgcttattccaaagatcgtattccgcgcaggccgtggcttccgggcgctgggcgaaaatcatgagctgttcattgtaggggtacttatacagccttgcggcggtggtcagaaatgccgtccacttctggtagcttcccgtgatctgctccgccgtgcggtctgccatctgcgcatagagctgtactttactcggcatccatatcctccttttcaaaatcggggaacaggtcgagcgcgtcatattctgcgtcgctcatcctgcgcagctttgcgatggcgctgtccgtcagctcccgcagctccgtttcatccgcagcgaggtagccgcgcatttcctccagcgccgcgatcaagcccgtgcgggtaccggtgttgtagaggctcataagctggcgttcttcaaaggtgatgttcatatcaaagctccttttccgcgctctttttgggcgctgttttgtgtggacgttcttgggtcggttggcttttgagctgctccagcacagactttttcttttcccggtgtgccgcctctgccaaatccatcagggagatggacataccggccttgacctgtgcttcaaggtcggcgacggtgggctgtttggggccgttgttgataatgccgtcgatcatgccgtaatcatcctccatcgacatttcggcggctttcaggtaattctccggtttctgaaaggcgggcagctcctgaaatcccatgctgtcacagtagtgataggataccttgccgtcctgtttcagcgcaacgatgtcgctgacggagaggctgtgtcccacaaaatcgccggggcgctcgtcgttgaaaatgtagtagaagttttcaaggattctgccggtatcatcgtccgggtacacctcgcgggtatagatggcttcatagttggcagggtcaggcggcgcggccaaactgccgagattggcaaaacgcagctcgaccggcgcatcccggcgtagctggtagatcgccatagaatcggtgggactgttcaaaaagcgctgctccacatcgcggggaggaatatggcctttgaccgcatcccaatccggtcttgtgataccgaacattccgtcgtgcttgatgatgtcttcggcctcaaagaccatttcctcggcgttgtcgggatggagcatataaaccgtgatgtcatgctccagcagctccagcgcccggtctttggaaagcgggagcatatcgccgtccagatacccatagctgcgcatatcgtccaccgtcagcgtggggtcgggcatcggggtggcctgttccagctctggcgaagttggaagtgtgcctgcggcacgagaaccggcctcctcgtgaacaacctgattgtcgtccgatgacaattcgagtgagtacaaaatccctgcaaacttgtttgacaaaacttcaaacggcacggtcttatcatagccatgtgtttcgcagatacgaatcgcagccgccaaaagaaagtttacatcatcgtcatgtactgttccgctttccagaaggtgtagagtgtccttgtcgtaaagttcataggcatattttgcaccatcttctgttatgcgaagatgcttgctcccaccatcaaccgcataccaacgctcattagcgtcgagttcctttaaggaagtgtgacttttctgaaatgcctcaacttccaacagcagctcattcgctctgtgcgcgtattcatcgctctgctcaagtgtttcggacaggaagccttttatctcatctgctcctgtcaacagatcttcgtagaaatgctggaggcaatcttcctgacttgcaaattcgctgagaaaggcaaggccattcgcatcgagatacagctctgaaatgctttttgccaagtcagccgcagacatattgctgttctcttttaattggctttccgcttgctcggatttctccacagaaatgccgcgctccttgcaaatctccgcaaagtgccggtcaatgtccgtaatcagctcggaggcagtcttgttgatggtttccagactggcgcgaagttctttcagctccttgccctttgaccatgtggcgatatagccgaagctgttttctcccgtttcaatgccgtaatactggcagaccgcataggagatgctttcggcctcgacctcctcggtgttgcggctcttttcgccggggacaaggatcgtctcaccatcgtccgcaagctccgtcatgtgttcgtagtcgtggagcttggcgtgtgcaatctcatggacggcggcacataccgtctgcacctcgctcataccggcgcggatggtgatgctctgcgccttaatgctgaaaaagccgtccgtatcccgcgcaacgggctttatctccatcggaacgggagaagcacggcgcagcgcctccatgaaaacctcatactgctgcacattgccgctcagatcggcggcaagctggggcaagggctttccataagtctgcgacacatcaaagacggataccaccttgaacatagggattcggatttccttttcctcaatgatggccttgccgtccgcatccagcaccggcgcattggtttcggggtcggtcttgatttcctcgacctttttcttatagggagtgggagcgatgatgcgaatgcctttttcgcctttcaggacgttcctgccgaactgatcgcgccacttgttgaagcccgccacatgggtggcgtcggggcgctgcatatagatgagcatggtattattgaccgagtagcggtgaaagcggctcatggtggcaaggtacttccggtacttatcgctctcgaacagctccttgatgccgttttcgatgctgtcaacgatctcccgcatccggtctttgctggtttgtttttcagccatgatgatctcctttcagaaaaaatagcgcccctgcgcagaagaaaacacatcctgcacaggggcgattctccgcagatagacgttgtttttgagcttgcggatagaatgacgcagccccttgtgattccgcatggaaaaagccttgcggcacggggcttttacgccctctatttgcggaggttccagtattgttcacgctttcgtttggcgtcctgctttcggcgctcctgcttggcgcaggcggggcaatatttggcgcgattggaggaagaatagaccggcttaccgcagacggcgcagcgcttccccggcctttcccgcatcacgtcggccagcagctcatggtcggcgggaagtaccgcgtttcggaaccagttgcacagcagcgagtaggaaataccctgtacgcaggcgcaaggctctccatcatccagagcaaggcagttgccgtgatcgtaattacagcagagcttccgaatgagcttcttggcgcggcggagctgcttgtgatccatacgcggcgcatcagccattgtcgaacaccatcttatagcccgtgcgctgtccatcgtcctccagaagaacactggcatcataggttttcccggttttttccgagtagcagcctttcagcggggcgcggccatttttcaaaagcgcagcggcaagggattttgtcagcacctttttcttggctgtgaaaaagcggctgtttttccagagaacaaaggaacaggcacggttctcacagaaaaagcctttcggtgattccgtcacctcggctccgcagcggggacacttgccgactacctcacgcccggaggggaacaggacttccgtaccggggatgggtttgtaggtctgcaccagctcatgtagcatggcggcgatcccatccatgaagctgtccggggcgatttcgccgcgctcaatctctttcaggcggtgttcccattcagcggtgagctgcggagactggagctgttcgggcagaacggtgataagcgccgtgccggtagaggtgggcagcagatttgtgatctttttggacttcctgcgctccacaaaaccggaggacaccagcttttcaatgataccggaacgggtcgccggggtgccaatgcccttgcgctcggcatcatcaggcatatcctccttgcccgcgttctccattgcagccagcagcgtatcctcggtgaagtgcttgggcggcgtggtttttccggtcttgaccgatgcggcagatacggaaagcgtctgattctccgttaccaccggcagcgcaggcgctgcctctacctgctcctgctcatagcgcttccagccgggagtaagaacggttttgcccttggcggtgaagctctgaccggcacagtccaccgtaatgaccgtttctgcgtagcgatgtggttcatccaccgcacgaagcaagccccttgccgccagcttcagcacctcgcgttcgcccagcggcagagaggccatatctaccttttccgcgctgatggtgggaacaatggcgtggtgatcggtgacttttttactgctgcatacctgcttggcgcagatggtcggaggcttctccatgccgcagacagcggcagcggcagcgacaaggccggggacgctgccctccatatcgtcggtcaggaagcggctgtcggtgcgcgggtaggtacagagcttcttttcatagagcgcttggagatagtcgagggtctgctgagaggtgtagccgagaacgcggttggcgtcgcgctggagggaggtcaaatcgtagagcgcgggcgctttctcagacttttccttgcgctccacgcttttgacggttactgccttgcccttgcaggcgttggcgatggcgtcggcgtccttcctgtccttcattcggcctgtcgtggcgggaaagccgcaatcgagctggacggtgtagaacggttctgccgcaaatgcggagatctccgcctcgcgctgtaccagcagcgccagcgtgggcgacatgacgcgcccgatgttcaatgtgcggccatacgtcagggagaaataccgcgtggcgttgataccaaccagccaatcagccttggcgcggcacagggcagattgatgcaggccgtcatagtcgcgcccagatttaagctgctggaagccgctgcggatggcatcatcctccatggaggaaatccaaagccgcagaatcggcttggagcatcccgcaaggcagtaaaccgtgcggaagatcagctcaccctcgcgcccagcgtcgcaggcgttgaccacctctgccacatcctcccggcgcatcagctcccgcagaatgtcaaactgcttctgcttttcagagcggacgatgaagcggaacgaggtaggaatgatgggcagcgccgccagcgtccatttggcatcatcggcattgtaaatggcggcatcggccagctctgccagatgcccgaagcaccacgacacgatataccctctgccctccagatacccatcatgccgggattttgcacccagcacggcggagatgctctgcgccacggagggtttttcggcgatcacaaggcgcatggcgcagcctccattctctttacgtcacggtagcaggggcgaacgcagctctgtccgaagcgcttgcagccatagcagaagtgttccttggcagcggcgggagggctgtcctcccgtgctgctttcggcttctgcatcatcaggcgttccagcggattattggtgaagtatctcatgtgtccgtatcctccgtagtatcctgttccggttcgccctcatacggctcaaactcgtattcgtcctcgtcctcgccgtagtcataatcgtccagatcggcgctgcccttggtttgcggcttggcctttttctgcttgaagatgtagaacgctgcaccgccgcccagcgcgacgatcagcagaacgacaaggatgccgcccacgccgctctttttctccggttcctcggcggcgggttctgtcggctcagcggggacttctatctttgcctccttgcccacgcactcggtcatgttgaccgcacagacggggcaggatgtattgacggcaccggccacgcattttgtggtgcaggagcaagtggcgggcgtttcttcctcgccggtcagcgccatcaggtcggcctcatccacctgattcaagaagtggacggtttcttcgccctcatcgtcacggtcaataatcaggtaaaacacattgccgttcttgctttccagcgtaatgaactgttttccagccttggtgctggtgccaatatcgtcgatcagcgtcagattgccgtccggtgtcagcgcgtcgctgccgcccgtcatgctgccgacaaggagctgccagaggtcggccagctctttttcatcaaacggaagcgtaatgccgccgatactcacggtactgtcggcggcgtcggtgacggtcagatagctgccgtacacatagcccacacgggcaggtagcaggatttttacccaatcgccgtccctgccaatcacatcgaccaccgtgccgttggggagctgcgtaaacgcggtgttgtccagtcccgcgccggtgcggacgttcaggttgccgccgttggtcgtgaccgtgccgatctgttttgtttcctgcgtgcctgcggcgctgctttcgacggcaggcagcgtatcatcgggatagtcgccgctgctggcaaaagcggaaacggggagaatcccgatacacaagagcatcagcagcagactgataaaaatgcgcggtgtgttcttagtcatggttcaacgcctccttttccaaagtggccggtgcaggcgcggcctgcatacggcggaacagctcggcaaactgctccatcgtcatgccgttctcacgcaccatgccgatgatgtcggtgtcctccagctcacgaatctgcttttccagctcgcggttgcggccttgcagatcagagattttgcctttgttcttctccagctctccacggagcttcataattttcgggttcatatcgttcactctcctttacggcaagcgcccataacggtagaaatgggactgccaatagcttgaatttaagtttgtataagagatcggatcgccgcagtggatcatcatattgttgccaacatagatacccacatggctgacaccgggggtatcatacgttccggtgaaaaacaccagatcgcccggcttgacgttagcagaggatacaggcgtacagatattgcaaagtccctgcgcgcccagtctgcccacatcccaaccggaatgattgatgacccaactgacgaagcccgaacagtcaaacgaggtggagggactgctgccgccccaaacgtaggggtagccgagatacttttccgcttccttgatgatggcggcaaatacctcatcgtccagcgcctccgggggaatgtcgtagtcggtatagctgccctccacatacttgccgatgtagcctgaaccggggaacaggtcgggacggttgccgagggtggccatataggtggcgtacattccgagctgttcttcgctcataatgtagacgggaacatgagagagattgaagttttccagcgtgaccgtgcagatgtagtagtcatacggcacctgataggtgtccgtatgggtgttgccgtccgcgtccgtccatgtgtcggtttctgtgcggtagcgggtttccaccaccacatcctcggtcaaaatgtactggcggtcaaagagcatctggagcgtaccctgcacctcatccagcgtccattccccttgatgcagcgccgtaatcatggaaatgagtacataggggtcatgctcgatggtgtccagatcaaagtggtactcatcgtagtcatgggtgctttcgtaggtgtcgaggtagcgctgaagctctgcttccatcacgcaatactgcgcttccgcgcccagcatatcggcgtcctgcgacggataggtactggccgcgatcccggagccgacgccatccatcatcaccgagcaggaggacaggccgttgagcagaaatgccagcatcagcagaattgcggcggcaatggcaaagccgcgccggtgttcccacacatatttgcccgctttctcagccttttcagcggcttttttcgcggccttggcggtattctctgccgcctttgccgtagtctgcgccgcctgattgtgcttggcagcggcatactgcttcttaattgcctgcttctgctgccatttggaaacgggattgctggtggggctgtcgatctctgctttcttctggagcgcgtcaagattggctcgttccagctttttctctgcacggatggcagcacgataaggcttgagctgatgggcgcggtgggcagactgcaccagccgcccgccgctctccacggcttgctctaccttgtgcgcggcctctacgcctacattgtcatcctcgctctgccgcacctcccggtgaacctgagagagaacaaagctggcgggggcatcctgcacggcatgggtcagctttgagggcggctttttcttgtccacctcctcaaatcggagctgcgttttgaccttgccggtggcaggatcaaagccgcgttcctttttgaccacggttttcttggggattttcgcctgcgccttatccgccttggcctccgcttttttcacccgcttgatgggcttttccagcttcggctcggcaagatcggcgtcggaaaactgcaaacgcggttctcttttcatgccgacgccacctcttgcggtttggtggtcatgacgcggtacagttcggtgtccttcgggaagtggtcaatgaagggcaggatcgtgttgccgtagaacagcagcccctcgccctcgccggagtgggtcacataagaaagctgatgcggcgaaatgttgagctgctttgcgagaatctgccggtcgccagcggcctgattgagcatatagatgaaatcgctgttctcaaaaatgttctcaacctcgcggctggataacaggtcgtagggtagggtaaaggcgccttgccgccgttggcggtaggtttcctacaccctccctcggaaccggacttactcctctcgaagtatccggctccccattagtaattaacgtattgattagtgtctgtgtattctttcatggcacttgctacaaacaacaagcgttttccgccgcttctttttcatcacggtttcccaatcagaattacccaattcgtttaagttccgtataacgtgaacctcatacaaatcggcttctttacacccacatagttcacaaactctggcattgagccgttgtctaatagtggttttccagctgaatttctttctctgataaatgatgtcactcgcttcgtcacgcttacaatctgcgattttaacagggcgaacacgttttgttcctgctttagtttcataagggacagaccatgttttcccgtctttatactggcgaatgattttgcggatactggttttgtgcttattagcaatcgtctttaagcaactgtactccataagatagcagaagtagtccagcgtgtgataatcacaagccagattgtaatagttgcataatcctcttgcttcggcattgtactgttccacaatctcataatccgcaaggttgagaagtccggctcggtgtatcggctgaaactccccgttttccttttggcgaatgactttctttgcaaacatgaatttctcaatcttttccgtatggggaacagacagggcaactttcatgtgcagggtacgggattttctccacgttccgtttttcattctgtgacctttgacttcctgatttctgcggacgcaaatatcatatccaatgaaacggactttttcggagctgtgcgttatcagcgtcttttcctcgcttagagttaatttcagctctgtgcttagaaattcagcgatttcggctttcaagtcctcacattccgcttttgtgccgcacacacctgccagccaatcgtccgcataacggacaaaagtgaacttcttgttgtcggcaggtttgcagggcagatttctcatagctttcttctgtgccctatgctggtcaatcagttcttgtcttgccgcttcatcagcggtatggtcaatccaataagacagtctttttaattctttgcttgccgcatgatattccggtgtctgatatgcagacttcggcttatcaaagcgttctgcgatttcccgaaacttcttgtccagctcattcagatagatatttgcaagtattggagaacagataccaccctgcggggaaccgctgtaagtggcgttgtatttccaattctcgatatacccagctttcaaaaactggcgaatgatgttcagaaaacgactgtccttgattttcctgctcaaaatctcaatcaatttttcgtgattgatgttatcaaaacaaccttgtatatcgccctcgataaaccagaccacgcctgtgaagtcagaagaaatctgacggagtgcggtatgacagcttttacccggtctgaaaccgtgggagcggctgtcaaagacaggttcatagatagcttctaaaatcattctgacaacttcttgcaggagcttgtcacggaaagacgggatacccagcggacggagctttccgtttttctttggaatatactcacgccttacaggattggctttgtaggttccgtcctttagtgactggattaactcttttacatagaagtcactgaaaccgtctgcggtatcgttgtcgataccctgtgttgttgcacctttgtttgcataaagtttctgataggcggcgtagtaaatatcttcacgaagtaagtatctgtaaagtcttgtgaatacgccgtctttgtgttcgctggaacacttttcaatacgctctaaaatttcagatgttggtttcattgaggtttctcctccctttcattcttacattttagatgttactaactggctcccttcgccatgtaagggtcgttatccctctcggactactatggagcctccgttaccatatccggcaaatgagccagacttaggcaatccccagttagcactgtgcataggttagtgaagattgtcggatatgctttcggttcgttgtgacgtgttctcacgcctgtttcataacgtgttggcagttgtcccgccgtgaaagatgacgtgacagcgttatgacatgggtttcaggacttttcccacacctacaaaaaacaggaactggaaccttacattcgataaacccaatcttatcctcatatcttcttaacattaggaaacagtcgcacctaagtcctttggtgactattcctttttctgccatgcgctgttcccgtaaaggatttctccttagtcggtaaggcagattgtttcgcacactgccgtgtgcggcagtaccttagactgctttgcacagcgccctatctgggcgcactttgacattttgcgtgatgccggtggggattccgccccatttgcgatagcgcttccaaatctcgacgctgtacgaggccgtctgttcctcctttaagagaagatggaattcatcaagataatagcgggtcgttttatgggcggcgcggttgatggtcacacggttccagacctgatcctgcaccaccagcatcccaattttcttgagctgcttgcccagctccttgatgtcgtagcagacgatgcgactattcacatccacgttcgtgtgatggttgaacacattcagagagccggtgacgtagatttccaaagcagtggcgatgtactgcgcttccttttcatcctgcgcacggagggcgttatacaagtcctccagcagcggcatattctccggtttcgggtcattgaggtagtcccggtagacgatgcgaacgcagcggtcgatgatggtcttttccacaggggcaagcccatccttgccgccgacgatcagctcgcacagcgacagaatgaagtcggatttcaggctcagcgggttatcatcgtcgctgtaatccagattcaagtccatcggattgatgtagcagggcgaaccgtcatagcccttgccagtgggcgacagcttaatgacctgaccgtgcagacgctccaccagcggcgtatattcgccctccgggtcacagataatgatgtcatccttggggcagataagaaacgcattggtgatctcacgttttgccgagaatgacttgccgctgccgggagtacccaaaatcagaccgttgggatttttcagcagcttccggtctaccatgatgaggttgttggaaagggcgttgatgccgtaatacagcgcctcggagccagtctgaaacaattcctgtgtggtgaaaggcacaaaaatcgccacgctggaggtggtcaagccccgctgaatctcgatctgattcagccccagcgggaggctgctcatcagtccttcctcctgctggaagtccagccgggtcagcgcgcagttatatttctgcgcgatgctggaggtctggaagatgttgttgtcaagctgccggggtgtgtccgccgtgttgagaatgaggaaggtcagcagaaacattcgctcgttgcgggactgcaaatcctgcaacagctttttggcttctgcgccgtaggtggcaaggtcggatgggataatgtccatatcgtacccggcgcggacggccttcttctgttcctcgattttggacttgtcgagatcggtgatcttgcgcttgacggtcttgatggcgttgacctgatccacggactgcacatggagattgacaaggacgctgctctccatatccagaaaatcggccagcatccggtcattcagctccggtgccaaaatctgcacgaagctgatcgcacccagctttttgcccatgcggaacatcctgccggtcttgaactcaaaggagctgggcgcgataaagtccttggtggacagcccggagggagccagccagtcccacgagaagcggaacggttcctgctcgtccatccgcaggatgtcgtgcataacgtgcaggcgctcgaagccgttcagcggcgcagccacaacgcccaaccgcttgaagttgttcaaaaggtcggtttcgatgcgctccaaacggggcttggcggcgcggaggttgtcggcctcaacaccgaacgtgagatacttggtcttaatcaggccgttgttgccgcgggcaagctggttttgcagcataccggcgtactcggcgcggatgccgtcaaattcgtctccgcagggcgggatagaaatgctccgtgcaaaggtttcctgcgaagccgagaggttcacaaaggaaagctggaattgcacggagctgtcaaagtagttcagaaaatcgcaccacgcttcaaagatggcggtcttgtcctcattctgcgagagctggtagttgatgtcctgatactggatcgttttggtgtagcgcgtgtcggtcacacggcaaatgccgtccggccacatacgctgatacgggatgctgtcctgcgccgatttttctttcttatccgttcggttcgctcttgcgatggcggcttcgatctgttttcgttcggcgtgggtcagctttttcttttcggacaatttgatacacctcccggtctaactggttttgccgctccagaacggcataaaaattgttggtcttatacggacgctgcttcggccgctggaagcacacacggtagatgttgcggatgacgacctccagcggctgaccgttcttttcatacatggcgaacagcatggccgggatcatcaccaccatcatcaccatggcggcggggctggtgccgatgcttcccttgagcaagaagaaaagcggtacgccgatgagcgcgccgcttccgaagcaaatgagctgccgtttcgtgagattgaacagcaccttggtttttactttggttaagtccttcgggacgttgacataggccatagaaatccccccttacaagagcctttcatatcgaagtttcatctgcgccgggtacaaagcggaggcgggcttgcggctgcctgtccagcatttgccgcctgccaaacctgcgcagctccagccagcggcgcggagactgctgccgctctcgctatccagcgtataggtgatgatcttgcggtatcccattgcctttgccgcccgcgcggatgcggcatagaggatgctgcaagcgttcttctcaccagtggtgcaaaggcgattgacctccaatgtccagccatcatccagatgtcggctcacaggacggcctacgattgcaacaccgacaagctctccatccttggcacagccgatggaaaacttatgcccagcagttgccttatggtgccggtgatgcgaattgacaaatgcgttcgctgttgcaagcgcgacgggcgtgagtgtcagcatggtatcacccccgttaatgtgcattgaacacggacttggcaaggctgctggttttgaacaggcagaagcacagcagcaccgtgtagcccatgcaagtccagatggcgtagatgatgtcatccacaagcgcgatgttctgcaccagaacggcgtagatggcaacgcagacgatgatgagaaatgcttggaagcccagcgccagcagggaacggatgtagttctgtcccatgccgccccattccttgcccatcatggtcgccatcggaatgggggcaacagaggtgacgagatatatttcaatcattcttccgaatgtgataatgaaaatgcagatggtcagcgcccacatggtaatgccaacgaacagcgactggaaccataggccgaagagcggccccaattccatctccatcagccgatcctcaatgcccaccatgacgcttgaaatgtcgatgctggtatcgccgataatcagcccggaggcgctggcaacgacgctttgggcagcgtcaaacacgcccatcacaatcgtccatgtgtttgttacgatcaggacagcggcagcggacttgaacgcccacttgaagaatatccatgtgtccatgtcgttgaggttatttttgtcggtaatgagctggatcagttccagcgtcatcacaaaggcgagaattgcgcctgcgatggggacgatcacggtttccgacagattttgtatcatgctgaaaatgctgccgttccatgcctgcggcgataagcccacctgaccggagatctcggcaaccttttgattggttgcatcgaacatcccggacagattgctcacgataccgccgatgagcatttctttcagccattccgtgatcttatcccataagaaatccatagggttgccctcctttcgggaggatgccgcccgaaagcagcaccctccgtggatttatgggaagcaaacgagctgccgattagccgaacagaccggacagcagcggcacgagggtaatgccaatcaaagccaccccgccaccggccatcagctgcttcatgccctgagatttggcgccggggttgtcgttgccgtagccttccagcagattgatcgcgccccaaatgccgaggccagcgcccagcgccacaacgagggtctgaagaacaccaacagcagaattaaagaaagccataaatagtacctccgaaaaatatgtttttagattttggagggtacatttcttccacgaagtttcatcgagtcgttgtcaaatcaggctgccgccgtcaggcgacaggttcaccggaaaggtctgcctgatacacctcaactgcatcatccggcttgagcttgaggcgatgggacagaaaacgctctatgtcaaaggcgtatttcttgtcataatccgcggtgtagcggtagaggggatgcttggtgagatcatatttgttggacagaaacgggcggacgccgcgaagctgcaagatgcacttgccgccatccagcacggcaagctcatccacgctcatcagctccttgcccaatttctgatagttcagcgaatgggaaacctcgcggccacggctctcgccggtgttatagctgtcgatggtttccttgcccagcgccgccgccagctctttcagcgtaccgggttccttaccacccaaaaagatggaacagtccatgttgccgatgatcgtatccgcgctgtctttatacagggctttgagctggctctgtgcctgcaagacaaggcagcaggagatttctctggaacggatcgtcgctaccagcttctcaagcctcggtatctgcccgatgtttgccgcctcgtcgatcaggcagcggacgtgaaccggcaagcgcccgccgtacacatcatccgccttttcacacagcagattgaaaagctgggtatagcacatggaaatgagaaagttaaaggtatcgtccgtgtcggacatgatgatgaacagggcggttttccggtcgcccagcgtgtccagttgcaactcgtcataggccgtcagttcccgaagctcctgaatgtcaaagggcgcaagccgtgcgccgcaggaaataagtatgcttttcgcggtcttgccagcacttagcttgaatttggcatattggcggacggcgaagtggtctgacttgcgctttttcagctcgtcgaacatcaagtccaccggatttttgaagtcctcatcgtcctcacgcacctccatcgcattgataaattcaatgagcgtggagaagttctgttcctccaccggcgcttcatagtggatgtacccgatgagggcggtgtagagcagcgtttccgccttcacccagaaatcgtcaccggctttgccctcgcccttggtgttggcgatcagcgtcgtgaccagcttcaaaatgtccttttccgagtggatgtaggcgaacgggttgtagtgcatggacttcttgaagttcagggaattgagaatcttgatctgatacccgttcttttgcagcgcatggccgcaggaaaccacgatgtcccctttgggatcggtgacgacgaagctggtgggataggtttttgaggtgcattgcagtagattgggcttcaaccaaaagcgggtcttgcccgaaccgctgccgccgacgatcaggacatttttgttccgcgccgttttcgggtctttggggcggctattcatcgtcagccgctccgtctgcgtgagaatgatgttgttctcaaatgcgggatcgacgtagggcttgatgtcctccgcgtttccccaacgggcgctgccgtactccagatttttgcggaatttctttgcgtttttgcccttgatatagaccgccagccgaatggcgatggcggcggcaacgcccacgcacaggtcaatgggatgaaagctggggacaagggagtgaaacgccgtgttcaggccggtcataatgttcaggagcttcgtggaagcgtctgaaccgggagccagccgcaccgcctcgctgaccttggtggccagcagtgcgatgaacacatacggaatattgggaagaatgagctttttgacgttgacttgcttcatcgttccagctccttccgctttgtcctgtccaccacagccgcctgaatgagcgacttgaagtgttgcagcttttccagcaccgaggggcgctccgcctttctgacctgcttggcggtatattccttgaacgcggcggtcatggcgtcggcgtccggcgctttgaagaacaccatgtatcgcttttcgcccttgaccttgaatggagcgaagtcaatgccatacttccgggcaatccggttgaatgagccgatattctgatcggtgacttcaatgctctgcaatcccttatccttggcggcaagctgcttgacggtcattttcccgtggggattggccttgctgtactgatgcttctggcggtcgtttttcaactgctccagcagcttggcaacggccttacgaaattcctgttcacctagcttcccacaggagatcatcagggatacgattctctgttcaacttcttcctgcatgacttatcacgctcctttccttcgatttgcagggagaatgccgggacactaaggcggaaccaccagccggtgcagaagatgcttattcatttctgcgcccctgtcccttgacggtcaggatgccgtccagcgtggtggcggtgatccgcaggcgctcggccacggcgatgtcgtttttcacgctttcatccacgatgctgccgcaaaccaccagcacacgagcgcggcgcagatgctcccgcgccatgtcgatgccgtctttatgctcctgcggaatctcatcgcgcaggaacagcggcaaaaacagcgtggggcagatgggcgaaaagcccgcgtcatagactgccctgcaatacttggcggcattttcggtgttctcaaactcgttctcgctccacggagcggtgatgtaggcaagggggcgtttcatcggtatcaaatcctttctcccaaaatcgggcatgaaaaatgacggcctttaggggccaccgtgaaaatcgtgattgaccagcatggcatagtggttgtcgatggtggaaacggaattgaacagcgccgccatgagataggctttcgtattccaaacgcgggtggtgttctcgcggataccgtccatgaccttttcgatatgcatggaggtgatcttttcaaagcgctgttggacgaagccggtgggatactccgcatcccgcccgatcttgaccgtggggctgcggtttatggcgacctccagcatgatctctaccagctcatcaagctgcatccggtcatactgctgacagagaatgtcgtattcgatttgctctctgatctccgcttttttctcaaacccgtccgtcattccgtccgccgcaggcagaaagaatgaatgagtgcttgatagatcagtatttgatttttgagtattagatttcttagtatttaattgcgcgggattatccgtatccggtgcctccgtatccgggttatccagatacgggttttccgtatctggtaaagtcgtatccggtggagagggctttcggggcttctcgaagatggtgtactccgtgtcggaaatgcgcccgtccttgccgcgaagctgacggcggatgatgtagcccgccagctccagctccttgagcgttttcccgatggcgtccacgccctccttgcagattgcagccagcccccgcgtggtgtaattccactcgtcggggagggagagcatcatggagagcagccccttggcttttagggaaagattgctgtctttcaggtgatggttgcacatcaccgtgtaatcccgcgtccgttcaacgcgaaatacagccatattgcttcaatcctttccgcagaatggtcaggctgtttgaccgtcctccttggcaaatcgctcgtccagccgctccacgctccagttctgcttgaactgtcccagcgggccggtgccgaactgcgccagcgcacggcgatccagctccatcagcttttcccacagctccgggtggtgttttcgcagcttccgcagctcgtcgatgcgctggaacgggcagcaccagcaggacgcacggtggtatatctcatacagcccgccgaagtcaaagccacggtcatagcaggcttggagcgcctgcacctccgtaatgccccactccacaaggggataccgctcgtccttgcagcgccacgcttcatcggcggcgataccgacatagtggatcgcgcccagctcgcctttgagccggttgacctccttggtgatgaggtgcgttttgagctgcccggtacaccagcggacgcggatacccggccagccgttgccgtagggcgggatgcccagctttgcgcggttttccagactgcggggcttctgcttgggttcgtcgaacatcaggtattcaaagcccttgggatgccgcagcgtggtaatatggatgccgcgctcccggaaaagatgctcgtccagtttggcaaggtgttcgtacatttccgggaactccatgccggtgtccgctgacagcaccatgtcgatgggcatatcccgttcgatcatcaaaagcagcatggcggtactgtccttgccaccggacaggctgacggcgtgaaactgcttgccgtttgcgttctgaatggtttcccgcataggaaagccgctccgtttccactcctttcccacatcacagctcatagatgggctgctcgtgttcgtagtagggatcgcacagggcggcaagctcggccaccaagtcctccaaatccagagaaatctcgctgtctgcccaatcgctgcccttgtagacgcgatactcggtgacgtattcgccttctccggcgttcacgctgaatttggcaacgacggcaaagcccatatcctccagcagccacaactccatcgaccgggcggcaaacaccgcgccgatatagctgtcgcctacgtcctcatagagaagcgtcgcacgctgcttgaacagctccgcgctgcgatagtccaagctcagcgcattcttgccgtctgcgcgataggcatagaccgtttcggccttgttccaaacggcttgcagcagggcgtgatagtcaatgttttccagaaactcgtcgatctccgtttctgtgtagccgacctccgtacccttgcggaacagcgtggtcagcgctttttccagctctgttactctgctcatggtaattcctccaatcactttagtgacgccgctttttccggtcagggaggatatgcccctcaatgacggcggcgtgtttgcggattttgatttctccgcgcctctcggatgcctgcgccttggcatatcccacgtcggagaggaacaacctcagccgttcgcccttttcacccacaggagatttccatgacaggacatcaaaaataatcatgtggcgggtttcgtccataaagcgctccagcgcaaggatgctgtgcccgccgacaaaatcatcagcgttcatattcggcacctcgcgctctgatctgaaaggcggcaagcccatagcgggcgatcagagtggcgttgacgatcaggcgcagcgcctccgggtcaatgacctccggttccgccaagtccgccatcgtgacggcctccgtcttgtcgcagaggtcgcgcgctgccatgaacagtgcgtagttgtgcggcgaggtgtttttcaacaccgcatagccgaactcaatcccgtccttgcagaagcagtttgccgtgcggcggtaaatgtcgtcgttggaggtcagcaggtacatggccgcataataggcgttggtatccctgcggcggcggtagccctgcacggcacattgatactgcattcggcgctcatgctgctcgttgctccagaggcttccgggataatgcttgatcagcaggttcaggcgctggaacaggcggcgttcatggggaaatgtctctaagactgcctcgcggtagccgaccacaccggcctcaatgcgctcggccagccacgggcagcgcagggcggtacagcccagctttttcacatactcggtacagagctggcagctcacatctttgggcgtgtatttgaacgtgttgatatacatggcgtcctccttttggcatgaaaatagcggacaaacaaactgcttgtccgctcaacggctctggtcacgctggcgctttttctgccatgcgtccagtaatttgaagatggtgttctcgatctggaacggggtataggaacgcgggaagtatttgcggagcttttcaccggaaagggtgatgtcgtttttctccggtttcttctgctccatcataatggagagcatggtgtcctcgttcagctcgccgctctgactgagctttttcatccgctgcgcctgcgagagcgagggggtggtctgttcgctgtcgatggtttccagaagcagcccttgttccttgggtgtcagcgccgcaagctgataggcgggactgagggcgattttcttctcgtccaccatctgctgaagctccgggactaactgcgtcaaggcgatgtagttgcggatggtatctccgctcacaccggcatcctgaccaacttcatcatcgctgcggaacttcgccgaaattttcggcgaagtcagatccgttcgtgcgccctgccgcttgatggcctccatcttcatcttgtaggctttggcgcgttcggaggggagaatgttctcacgctgaaggttgctgtccaccatgatgatggtggcagcgtcccggtcaatgtcgcggacaatgacgggcatggtggccagcccagccagctcgcaggcgtgtttgcggcggtggcctgcaatcagctcataaccgccgtcctcccgtggccgcgccagcgcggggacgaggacgccgtattccttaacgctttcggcggtttcctgcatggacgcatcctcccgcacctgaaaggggtgatccgggaacggatgcagctcggagagcgaaatctgaacaactacttcctgctgcggtttcggctttttggatggcgcgggctttttgcccggttccttctgcacggctttttcaggcattgtgttcctcctgtcggcatctgattttgggtacaaaaaaaggacatttcttcttttcagaggaaatgtcctgatttcttggacgggctgacagcccgcccaaacagtatttagtttttgtcgttactataacaccccctacgatataactacttcgcggctcgatttttcggtttggaaaaggatgaaaaaccttgccagataaccgaaaacccttgatatacggggcttttccggtttgtcgtaattataccgtaagggcacaccttcgcgaagcagtggatccgccacggcggcgacatcaaggcgctgcagtcgatcttcgggcacaaggacgccatggtcacgctcaacgtctacgccgacatcgagccgatgtccaagatccagaacatgctgcgcgtgttgccgagcctgtggcgaggctacctcggcctgagggtggaccccggccccatgttccagcagaagatccgcgaggcgatcgagacgctcgaggcgttcggctacggcatctccgagcctgacgaccgcaacgtcctcatccgcgacgttcagacgataagccgcctctaccccaccgagtacgcggcagtgctgggggccatcccgaccgaggcgaccgtggtcgagtagaggctgagacatgcgctttcccaaatccgtagcgcaagtacgggaatgtggaatagcgttcagatatattctacccggtcatctcggtgacgcaaatgcggcacgggtttccgcgaacgcggatgcccgtgcctatctttttatgattgtgaatacgcctgcgcgaatgtagatgaagccccgcggttcaggccggggattttcagccgcgccgcccgatttcgaataaaggcctgcaaatgcagacggctttcggggggcccgacggcacctctctcaaaaatgggagtatggcccgaggccgcacctgtgccccagctccgccacgagggcatcgttgtcggtcaccgagacgatggcgtcgccgtcgtagggcgcctcgatgtagacgcggtcgagcgagttggccgtccccgcccagagcgtcctggtgcgccggacgctccgcacgtgggcgtagggtatcaccgaacgcgtcccagcgtacacgacgacgaggcggtcgccgtagagctcgaggcggttgctgcggacgggaagggcggccagggccacgagggccgggacgggcagcagcgcgagccagccccataggagcgcgggactcgagctcaggaaacacgcgatacacgccgcggataaaccgcccgccacaatcaccatggccgctatgaaccacgggtctgtcctgccggggaacacccgctccggccgctcgtccttctcacccattacggcctccctcccgacgccctccctggcggagcgtggggccggagagtgccttgaacccgtcgccgaccatctcgccccccgttccgtgggccttctgtagtggtgtgtacccccgactgttcgacggatgtcgtacgattaaaagtttgtctaaccttttaagacgggtgcagcaagatcgagcagattgtccgtgcgagaggcttcccgccgcagcgcccggtctcgggttcgatgcatcgacatccgtctcaggtggtatctccgctgcgcggcattgcagggtgcaaagccgcgcagcggagataccacggagtacgccgaggctttgctcgcgtgggctgaaacatattcccaatccgggaatgcatatatataagtgcgatcgttttgccgtagatgggaaacccgtcggccgggcgggaccggagagccgggcgggaccggagggccgggcggcgaatgcgaaaggccggatgcagccgatgccctgaatgaggtcccaacacatgggaggggcaggtgaatccatctctttggccgctcccgagggcatggatttcccagccctcgcccccgaggacatcttgcagacgattcgcaggtctccgagcggtaggtacctgatggagcagagggccgcgctggcgtagttgccgcacttcgacgatatggacgatgacgagctccgccaattcgccgcccaagtcaggccgtgattttatagaattcagggaggaccgctgtcacgttcgccgtttaagaaggtgccgctttgaaatatctcgtcgaggatttcgatgatccggcagatcccgtccaagactacgccgaggccaagcaaatcgtccgaaaagtactcggctcccacccatcggtgagacaagctgccacatggccatggaagcctcatttatttgcgaagaacatcggctagccgcaggattgaaatcatcgaccgataagtgagttccaccttttcgcccgcaagcagtcgtttcgagccaatctcatctagccccacaagccgagaaaacagcgggccgctcatcgtgccctcgtcaattgactcccttatggtcttcaaaacgtccgtatcatgaagcgatgccgagctgtagggggcaacacgagcggaactctcaattaacgacgagacaaaaggatggagatgctttggacatagtccatcaaacaccacatccccattgtcatccgagccgaccaggcgccaagtataatgatcgacccagtcatctccgtcatatatggcgtccatgagcaacttcccgtctagagagagaaacctatttggacatcggggcgcaagaccgcaatccatatcgggcctgcagcagctccaacccaacgcaccacatagtttccctttcgtacatgtgtatcaatctccccgaaatgccggagaatgcaattccagacccgtttgtcggatagcaatcgacgtatttttgttttccgctcacaaccttgtatagatatatcgttccagcaaaagagaaggtatcgtgactattttagatctatatggccaattcgagccctcaccatggcaattgtggcagctgggtttcttttcattaaaatttcactttgttaaatccctgcccctaagcattaaacccgaagtccaccgagtgggcgaaagtaaaagagggtcgaatccgaagcagttcccagacaattggcgtccggccagacacttcggtttggccctttctttccaggactctataacagcaaagcacctgctagatgggctttttgtgggtgggtaattgtaacagctgattgaactgcaacgcgctggggccaatagggcgaggcaaactggcgaggtgtgtcgtcgcgagtgcaatcgccacggtcgacgacgcggtcgtccagctgccgcggcacggcgccaccgctgtgtgtctggccctcggcgcgacagaaggagacactgttgtggccgatgggctaagaccgttgccgaccaagtgccgttagcggccattggcacatgtcagccagactgattctgtgggtatagggtggcatttcactaaggtcggaaactcccgcaaccattgattgatttcgacatgtccgaaattcatattacgtatatgggtaacaatcatttataggagccctcaagtaaccttagtaaccgaaccggggcagaagggcctacaaacaagccgcgactaacagcttcttccgcatttctttaggcaagcgaaaagagggatggcatgacggccaagagctacgtaaagatcgttattgttggctctgcactttgtcttgcaatggtgctatgtgcatcatttgcgaggtataggtccgagcagtcgttcatcgatggcgctgaaaacggttttggcatagacgggatgtatgtcaacgatggcgcgaccaggccgtctatggcgattcttgcaggcgaagacatggaatggcaaatctgtaatgacgatggctcttgtctgagtggtcgtttggccgcaacgagcgacccgaattcgttcgatcttctcgacaatgatggatcggattgcggttcagttcacctgtcgtatgcatcacgagacgggatggacggcattctctacgtctcccacgagactggcgatttcaagatgcgcaggactaaccgagtgccggcttttatcgaggagtgagaactcccggcggtctgccgatcaggccgccggggtatcgaaccccgcattcatccgtacacacacggatgaatgcgggaagtgtccggatgaagttgataatcaaggaaacaatgccgttctgcctgggacggctttggcctggactttaactacaacatcgcgatcgacacttatcagctcgcgcgacgcgcatggccagatctcggacgctggtgcatggaggaccttcgagatttactgtacatccaaaacgacgacgcacaccgcgtgctcgccgactgcgaagacgagttggctgtctacaatgcgatcagaaacggcgtgaagtccggagagctttctgtcgaaccgccgcgccgtcgcgcgagccgaccgggcaacccgggcgatctggtcctggctctcccgatcgtattcctacgatatcgcccctagatcaccaatgtgtcagataaagaatgaggcaatggctgtgatcacgcctacggcggacgcaacgactgcgccttttttcctctcctttagtccgatgaatagggttgccgtaaagtaaagggcggaaatgcagtctatggcaagcaaaacgagttccttgggcggtttcagcaaaaggtcgctagcaaagagtgatgcgagcagggtaaagccgattgggaccaagtatctcgagtgattttgcgacagcatggcaaccgccttttagaacatgtaagtgaaaagtcggtacgatgtcattgcggttgcaaacaagccgccgccaggaccggttgtcacgagaccggcgataacgcattttctcggtttccagctcatgacaggcccctctctcatggtgcaacgcatacattatgagatatgcacattatctcgctaattaatttcaatatccatcatccaactaaagaatactgactcactggttcagcgacgatgcatttttacccttgcgttcccactcgccgcgtcggcggtcggaagggtctccgtctcgcatttagcgaccttgcacccgtatctgtcgagccaggcggcaagcgcatcccaatcgacgcgcttccagtcgccgctcggcgcgtgctgcatcacgaggcctccggcgaccatgagcgcgtggacatgctctccttgcaggccagcaatgatcccgccggtgcatacgatgctaggtcgctgtgccggcactgcgcaaacgtattggcctttgtaccccttttggcaactttagcatgactgtaggttaaaccaacccacagccatgagcacgttaacgtagtactatgctaattacacggataaggcaggggtatttttctttggcgaataaatttgtattttatggcaaggggagtggcgttaaggttttcatcgctatatcagttgccgtgttcgcattctctgcgctatttctaaaagtggagcgttgccaaaaagatagcggaggtgactattcacatttgtggttcgtgagcggattggtgttgaacgttgacagctctggcgattttaccatgtcggtcgaaagcgaagatccatataacgacgggtctgatcgtctgaccattctggttgattcagaacatacgcgctatgtaagcgatagccccgtgagcgttgggtctaaagtcaaggtaggctattttctcgattcccgaaagaaaaatacgattcgctgctcttctgtggatgtgttggaataatttttgagtaactatcagtaaaaagctgcgagcaaaggccgctccacgtggggcggcctttttggtggatagacgttgcggaggatgattgattgacgtttttactccgcatggaaatcgagtgaggattctgttccgcgaggggcgtgttttgaggctcttggcggtacgtaattctcgttcggcgtcttgacgggacaaaaccctcggttgactttttgaagcgtccctagaatcagctgttacgataaaaacggggggggtaactccgcggacacggcctagcgcgctgccatccagtgccgattctgccatactcgcaattcggcgaggatgaggagtatgaattgatcggggcttataggacaaaatgtgtgtcctataagccccaaggatgacgattccaatacggatgacgacaccaaaaccggcatcgacggttccatggacgattcggattccaaataggccctgttagtttatctacttctttgccggtgtcgtatacgaaaccgctatacccgcggcaattgccatgagacagctcgcgatgaatccgaactcatacttcaaaacgtttgttgcggtcagggcgataatcaacacggtcgcaatttgcagaattatcattattgcgaagagattgattccttgtttggccgaagtcgctgagtgagtttggctttgttgattcaggttgtagctgacaacaaaagcgaccagttcgcttgatacggggccgactacatagaaaaagattgcgtcaatgaagcctatagtgttgtaagttgtttcgccggaaaaaacagtgtataaagcatatccaaatcttggctgattcatgtatgagtacgaaaagacgaagagcgtcaatattgctactaccagaagtgcattcaggacaaatcgtttgcttttcatcgatcgctccttctgggtgactcttatttgtaattctacagcatccatttgtttttcaaagaatttgactgtcctaaataacatgcactttcgctggagggtcgctgtttggcggccctcttttttgcacaggcgcggtgggatggtaataatcgggcgggagtcagccgctctgatagaatcgtccttgctgtcggcagccctcgtgccgggcagagccctccatccgatgggaggtgatgcccatgaccgatttcactgagctcgtgaagctcctgactgctatggtctcgctcctcacggcccttgtcgtcctttccaaggcactcaagcagggttcgaagcccaaaaagaaaggccaccgtcgctaagacgatgacccaacttcattaagcaacggctctgcccagctctctacaacttgggctgccgtcggcaccattttaccctcctgacgaggaattcgtccatatttcaaaaaccaaattgcgtttgctatcgaagccttgattatcaacttcatccgaacacctcccacattcatccgcacatgtgcggatgaatgcgggaacccgataccctgagggccggaccggccggcaccgggagatcggaggacggccggtccggaaagaggaagaagggttccgcggaggcggccccgagggcctacggcaggctcaccaggcacgagcgggacacggtccagaggatgctggagcgcagggcctcgtgcagggagatcgccagggagctgtgcaggtcgccctcggcggtgagcgccgaggtggcgtcgcacaggttcgtgacggcgccgaagtccaggcgcggcgagcgcgtcgacggctcggccgacctgtcggcggcctgcccgcgcctggcggcgtggccgcgctgctgcaacgggtgcggccggtaccgtgcgatcggctgcaagcgccgcccgcacgtattctgtgtttcgtcaagaggatttgagcaaaaagagcatcggaaattgagcagtcgcagcatcggaagcgcgcacgctttttgagcggctagccctcctgcatgagggcatggcggacgcggtaggactcgccgcggaactggacgagcctcccgtggtggacgatgcggtcgatcagggcggcggccatctggtcgtccccgaacaccgcccacacctgctgaactccaggttcgtggtgaataccaccgactgcctctcgtatgcgtcggcgaggacctggaagagcagcctcgccccgtccgcgtcgagcgggagaaacccgagctcgtcgatgacgagcaggcgggccttgccgatgattgcggcctcccggtcgagcctcccgtcgtcgcgggcgcgcctcaggcgcatcacgagcgaggacgccgtgaagaagcgcgcctcgagcctcctctcgcacgccagcgcgcagagggccgacgccatgtgcgtcttgccggtgccgacgtcgcccatgagcacgaggtcctccctgcgctcgacgaagtcgagcgcgagcagcgactcgcgccccatgccctccggccacgacacggccgaccagtcgtagccgtcgaaggtcttgggcgccggcagcgcgcagcgcctgagcagcgtcgcgcgcttcgaggcctcgcggctggacctctccgcctcgaggtagcccgccaggtactccacctgcttcggggtgccgagcctcgaccactcctccaggacggcggtggtgagcgagcacgaccgcccggcctccacgaccctgcgggccagctcctcgctagctgccatcggcgaccgcccccttcaggaacccgtcgtagaccgacaggtcggccccgccggccccgccgagagggcgcgcgcagagaggggcgatgccccgctggcctagcctaagggcgaaaatggaatagacggaccgaccgtccggctgagtctgggaagaggtgccgggcggcgggcggagcatggccaccggacccatcgaaacacatctccaccgttccttcaactgggaaaacgacgccccgtggcctgaatggggcctcgggggcgttcggctaactgcgggaacggcctatccgctcaatgtgttcggctgagatcggaaatcaaccatattatgggcacagtcggcaattgggttggatagcctcgcaccagaggaatcaacatgagtacaagtagctacaaaccgcaaaaaggccgtggcctcccgtggcctttagacacggacgctccatcggttgccgatcaggccgagacgcctagcgagatggaggcggcgcttgacgttcgacaggatgagattgcaaagagcgagatcctgagtggaatcaacaggccatcctacgactcattatttgcggtcgcgaagaatcgcgtccagcttgcgattctgatcatgatttgctccttccagacgtccaaagggcctaataggaaggatgccaacggaaaagaacttacaaaaggtcttttcatgcgtcaggacaagctcgaaaaaaagtctgttcgactcaaccgactgtatcgaaagctctgggcgagctggctcatcgaggcatcatcatgaagaccgatggggtgtgggtcatcgtttgggctcagctcgatattcaagcgcgtgaggccggatgagatccgcgcgcggacgcgggcggcgaggtcggatgtgaaagccggaccgcagaggtatcgagcgcacgcggctagggcctcgagggcgcctggcgggtagggagatccgagcatgaggcaggacaacgcgcaggcccgcgaaaggttcacgagctcccccgcgacgcggcagaccctcggctgcccctcgtaaaggatgcagaagacacggtcgaggtccgacggttcgaccaggctgtaccggcagtccgcgtacagtgcgcagcccctcccgcgcgggtcgccgtccgagtcctcatccggctcatgatggcgcacctcgacccaaaggccctccaacacatcgtcgaacccgaaatcgagctccgcctggacgctctcgccgaacgcatcgcccagggcgagcttcggcaccttcgtcacacggccgtccagccactcaatctctgtcatcgcgcgcatggtccaagccccttccgacacgggattgtcagctcaacccgacccttacccatacggacgaacataactcgccaggggaagcccctgaaggccgtgcgccacaacatgaggccgaatccgcccccggctggacaggccaacaacgaaggagcacacggaaccggcgcggcgttacaaccgtcccggcaagcgtgtcacttggccaagtcatgatgccgacaaacccggaaatgctccaacggagcgccgaacgagcgtaacaatacaaagccgtgcaacacgtgttggacgaccggaacatcccaaacaaaggcctgtaggtcccaccttcaagcccaatagcaaaatgtgcatcagcggatttgcagcgatacaagtctcaaccgtcaccatcacgccgcagcgcgcctagtcccactcatcctactgcaaatgtcccagaacgagaaaacgaccagcttaacatgccaacctttatatccgcacgcgcgtaattcaactcataaggaccggctatcccttacctgtgacacaatctcaaacgcacagaacagaatcatcagtccaatcatcgtataagaggcagccgaaccttcaagcactattccacaaagaacaatctccgcgcagccaataagaaccgttatcaggcgctctgcctttttgctctcgccgctcgcataaaaaggcggcaaagcgcacaagatcacatatagcccgggaaggaaatacaggatcgatagtccaagtcccccatcaaccgcagtgctttgcgtaagaatcaactgaacccaaacggcaattatcactgagcaggttgtcgataaaagaagactagaaatatagcacgcaacaaagtcccgtcgcattcgagcagagaaatccgcgaactctcttcgccgcgtggaaacaataaggtacacagaaattgcaatagaaccaatcagagaaaacagcggaacaaccagcaattcaagcttattaccccatcgatcaaccacacccccactccaatgagcgggaattgtatcagggaggactgaccaagccgcccatagaatcagaaatggaagaatagagaggatgaaagatgataacactgcagtagttttttttgaggctctcatcgattccgcatctccttgcgcgcccacattccactccgccttaaatcaagtatacgttttggaacgggatgtcactccgaacgccttaccctcttagtgtgaatgccgctgcggcattgttgactcatccttagtaatcgcgtctatcctctgcagcatcagccaaagcaatccgagaggagccgcacatgcatgcagcggaaattcctttcgggggggggtatctcccagatttacccgccgcccgaaggggcagtcgacagtcgagtacgtactgatcatcgcgatcatcgtcctggtggtgctgatcgcgggaccgtgggtctcgtcggcgatcacaaaccagttcaacacggtggcggggacgctcggcaacggaatctcaaaggggagctgggagtcgggcggcacgggcggcggcaacgggtcgttgaccgacgccgacatcgtggaccccgttcacgggatagcgttcgccgtgtactcggaggacgaccacagcctcatgttctacaagcgccgcggggtccccagagtcggtgacatgctcaacagccgccgcgtgacggcggtgtatacggggttcgaaaatggatacgccaccgcgaccgtgggaaacgacggcaagacgactgccccctggtggcctaacagaaataatatcgtggccgtaaaggccattgacgatggcatagaaatccactcgttggcattttgctttcagtacatggagaactgcaagagctttgatctggcaaagttcgacatgtcgaactgcacaaatctgcagcacgcattcgcgtattgcggcaatgcgacttccttcagtatttcaagctgggatacgtcctcggtcgtcgaattcgactcggcgctcaaaaacctttacaaggtcgaggagattgacatctccggatggtcgacgcggaaagccggcgatttacgtctccttttttccaccgacagttcgctgaaaagcgtgaaatttggaccagggtggaagacctcagatgttatggatatgctcggcatgtttagctattgcaaaaatctaaacctcgactgttccgattggaatgtcccaacctatgccaatcatagtgacttcaatcactgcgcccccggcgttatcctcccgaaggcgtggcagtaggtctgaagaaacaaaacggcaagcagtttatgtggcgcgggcacccgtgccgccgttgcctcagcgacacgttacgggctagtcggttcgatttaacgtacgctctgcatgcaatatcaatccccatgcgaagggagtgtcgcatatgcatgcagcggcaattaaccttcggggggcgggtatctcctaggaatacccgcctccgaggccaaggagccatcgagtacgttctggtcatcgcgattatcgtcctggttgtgatgatagccggcccttgggtctcgtcggcaatcaggaaccagttcaacacggtggcgggagtattggtaaacgggacagcaggtgggacttgggaaccgagcggttccggcagcggtaacggcgcgggttccgcgaccgtccaggcggcgctcgccaaggacgcgaaggacacgcgaaggactggaccctcggtgagcagaaggcagttgccgaggacatcgccgccaagggcgaggcgtcgcccgcctacgccaaggcgaaggccgcgatggatgccgacaccgagttctcgatgaagctcaccgatggcaagacgctgacttaccgcattatcggcatcaatcatgatgaccctgcaggcggatccggcaaggcgggcctcacgttcctcaccaccacgacgggcatttggtcccccatgaacgcgattgacaccaacgccggcggttgggagaagtctgaactccgtcagaaaatgaactccggctagatctggaatctgatgccctccgatttccagtccaaggtgaaggccgtcaaaaagctatcgaacaatgtcgggggcggtgatgagaacaagaacgccgccgtgacggctacctcggacaagctgttcctgctcagctactctgagatcgccccccacctcctattgggcattctatccctggacttcctccgagggcacccagtacgaggccttcaaaggcaaggtgacggagaactataatcccaactctgccattgccattggcagcggttggtgggagcgttcggtgtttccgaacgcctcgaagggcttcctccatgtcgacagcagcggcaatccgtcggacagcaactccgcgccgggctggttttgcgtctcccccgcctggtgcttctagcttgtctagcgcaaagcccgcgttaccccgcgcgtgctttcttttggcgaccgaacgaacggcttcaggttcatggcacgggtagtcggattgaagagaaatggggtcatacagcggctctcagagcgcctgccgcactcccccgccattacctctgctgcgtcctcgtatagagtccatcctgcttggtgtttcgagttcggggcgtatacggtgggtggataatggattcacttcgatgacggcgtttacgggagcgaccatggcgatgcgcgagatcgcggtcaagttcgatgagggcgaaatggccttgattcagggccatgcggacgccacgggcatgaccttttccgagttcgtgagaagggccgcgttcgagaaggctgaggacatggcggacatcgaggcctacaacgaggctttggacggggacggcggcactcgctacccgatggaagaggtcgtgcgcatggcggtggaggctgagtgattgtccacacgcgttgtctgtctcggctctaaaggcttctcttgggcggggttcggcttatagccgggtcccgcttttttgcggctttcagttgtctttctgaaggtatgaaatggctgcctcgatatgaatacggtcggcattcgaagcggacgttatagccgcgctaatagcgcatgactttctcccctgccgtcatcgttgccgcagcggcaagaccgttgcaaatacttggaatagccctacgctcggctcgtattgcaaaccccgagtgaagggagccgtatatgcatgcagcggcaattaaccttcgggggggggtcgctcctgaaacgacccgcttccgagggcaatcaattatcgagtacgtcctgatcattgccgtcatcggcctggtcatcgtgttcgcgggacccggcgtggccggagccatccgaaaccagtccaacctggtcggcaacacggtgaacaatggaacggtcggcggcgtcgagggaggcgcgtccggtggcggctccgcaggcgccgattccgcggccgtccaggtggccatcgccaaggacgcgaaggactggaccctcgacgagcaggaggcggttgccaaagacattgccaagaacggtacatcgtctatcgcctacgccaaggccaaggccgccatggatgccggcaccaagttctcgatgaagctgaccaatggcaagacgctcgagtaccgtatcatcggcatcaaccacgacgacttggccgatggtagcggcatggcaggcttgacgttcgaggcgaccaactctgccttgggtagccagagaatgaacgctacggacaccaatgccggtggttgggataagtccgagctccgtacccgcctcagcagcggtgacctctggttgctcctgcccagcgagctccagtcaaaggtgaaacccgtcacaaagacaaccgataacgttggcggtaacgggggcggtgccccctcggcgacgaccgacaaggtttttctgctctcggcaaccgaagtatacggggatatgcaatctgacggcatccagtacgagtgctacaaatccaagggcgtgacgaggtcgaactattccggtgcatcaggctatagccactggactcgttccgtgagaccgcgcagctccacatcctttcgctatgttcaaagcggcggtatttgctacagctacagcgcgacggactcgttttatgtcctccccgctttctgcttctgatctctttcatcgcaaagccctcgcaatcctgcgagggcttttcttttggcgattactcaaacaattcgaggttcattgtacaggtaatcgggttgaggagaaatgggggcatacagcggctctcagagcgcctgccgcacttccccgccattacctttgcggcatcctcgtatggagtccatcctggttggcgttttgttgtaaccgctcacttgtccacagatcaagtgaactgctggaataaatacagcgacacactagttcgttacagtcgccatatctgcgtaaatcgccgcgataaatacagcctgtactcgtctgtataccagctacgcgtatgtagattcatgtcgcgttaataaatcggctcaagcgcgtgcaaaacgcgcaagtaaccgcaaaaagcgattatcgcgcaggtagttttttggcaccctgttgcttaatcaaaattaagcaattgcttaaaacaaaaaaggtcaggcactaggtgcctgacctgcaaacttctggtcgggacgactggattcgaaccagcgaccccttgacccccagtcaagtgcgctaccaagctgcgccacgtcccgaagcttatgtttgttgctctgctctcgcttgcaacagggagtatattaacccgaaactttagacttgtgcaagaacttttttataaattttgaagcaagtccaaaattgtatctgcgagctggggttttgttagcacgggaagttcttgcgtacccgttgtgctcacaatccaggccttgttagtgtcggttccaaagcccgaatcggcgcgcgagacatcgttggcgataatggcatcgcagcccttgcgggccaatttgcgctcggcgtactcgacaacgttatcggtctcggccgcaaatccgattacgcaccgcttgcccttctggcgcgagagctcggccaaaatatcgaccgtttcgacaagctcgatgcgatccaggcgttcgttggcctttttgagcttatggtccgcaggggtggcgggggtatagtcggcgacggcggccgcacaaattgccgcatcggccgtctggaaggcgctgagcgctacctgcagcatttcagcggcggtctgcacgcgcacgcactccacgccgcgggggacatcgagcgatgtcggtcccagcacaagcttgaccgcagcaccgcggcgagcggcctcccctgccagggcgatgcccatcttgcctgatgagcggttgccaatgaatcgcaccgggtcgattggttcgtgcgtggggccggcagtgatgacgacgcgcttgcctgccaggtactgaggcacgggtttgagcacctcacagacagcctcgacgatgtcctcgggctcgctcatgcgtcccgtgtccacgtcgccgcaggcaaggtagccgctgccgggtcccacaacatggacaccgcgctcgcgcagcgtggccatgttggcctgcgtcgccggcgccttccacatgccgttgttcatagcgggtgcgatcacgatgggtcgcggcgtcgcaagcagcgtggtggaaataaggtcatcggcgatgccgttggccatcttggcgatgatattggccgtcgcgggcgccacgaccaccagatcgggctcctgcgcaagcgagatatggtggatggggtcagacgggtcgtcgaatagcccaaccgcgaccggctcattggtgagcgcgcggaacgtgagcgggcccacgaactccgtggcatgctcgctcataacgactttgacacgtgcgccgcgcttttgcagcaggcgcacgatattgcacgacttataggcggcgatcccgccggtaatgcccagcaggatcgtttttccctcaagttgcattgaattgttggatgccgccgtcatcgctaggcttccttgctcgggagcaccaggaggcggtggcagtacgggcagtgcgtaattgacctaccgtcgtggttgaggtcgcttatggacgatgcctgcagcgcggtgtggcagaccgtggggatgttgccctggatggtctcgacggccaagccgcggaactgcttgagcagacgctcgtagtcggtgagcacgtcggccggcagcgtggcggcaagagcggtgcgctccttagtggcggcttcgatctgagcctgcaggtcggcagccttggcgcgggcggcgttggtatcggccttcacgccctcctcgaacttggcgatgatggcctgcgcgcgggtctcgcggtcgagcgcctccttatgggcgacaacgacatccttgcgggtgtgctcaatcttgtccaggcgcttggccagggtggcgagctcgttttccaggtcctgtacctcgcggtagtcggagccgtcaacgtggcgcttcttagctgcctcgatggcgttattggtctggatctcggtggtgttgagatcgtcgagctcaatgtccagatccttgcgctgggcgtagagcttggtcatctcggacttgagcttcacataggtcttgcgcttggaagcgagctccttgagctccggcatattggcaagttcgctcttgttgcgggcgagctccaaatcgatctgttgcagcttgagtagcgtagcgccggcgctcataagttctctccttttgtcacagtccaccattggcaagggttctgtattttaatcgcatgacgggggttgaccccggcgtcaactgcagagttcatcaatatatcaacgaacggctcctcggagcggtcgtggccgagcaagatgacgcccagaccgcgcagagcgaggtcctgcgccacgtgatagcccgcctcgcccgtcacgacaacgtccgcgcccgcggcgatggcgagctctccaaagtcgcccagggagccgcccaaaatggcgacggtgcggcacgggcgatcggcttcgccccacacacgcgggtcgctgccgaaggccgtggcagcacgggtggcaagatcgcgcagcgtgcacgggtcgttgagcgttgcaagcgcgcccaggccggttgcctcggggtcgtccacgtgctccagtgagctcacgagtgcggcacccagcagcttgctcaggcagacacgggcttcgttcgagcggtccaggttggtgtggagcgatatgatgctcacgccgcaacgggccgcctcatagagtgccgcgctgcactgggggcgagtggcatccgctggacaaaacgcctcgggcgccttgatatagacaggatgatgcgtcagcagcacgttgacaccggcctcgaaagcacggtgcacattggcttcggtcgcatcgagtgcgcaggccacgccggcaatctcggtggcagggtcgcccacggataagcctacgtggtcccagggctcggcgtccgtctttggatagcgtgccagcagagcgcgctcgagctcggcgacgatcatgcggcacccacgatcgtcagcagcgcttgggcaaagtcgtccagatcggctgggttcacgcggtcatcgaacgagatgcgaagagcgccgagagcttgctcgcgaccgatgcccatcgcgctcaaaacgtggctggggtccatactgccgctcgagcacgccgagcctgccgatacctcaaagccggcggcgtcgagcttgatgatgagctcctcggagtccatgccgtcaatgtagatcgacaccatgccgggcagacgatcggcatgcgcatagtcgcccatggtggcgtgaatgcgcggatgagccgtaagcgtggcgtagagcttgtcggaaagagcttgcagcgtcgtacgctcctgggccacgcggggcgccaacgtgcgggcggcagcggcaaaggccagctgcgtgcgcaggtcctgcgtgccggcacgacgtccggcttcctgtccaccgccaaagatgcgcggacgcagcggcgtgcggttcttaaggtagagtgcgccggatgccacggggccgccgatcttgtgcgcggcaacggtcatagcatcgacgcccagctcggcggcatcgagcggaatgtgcagatagccctggatggcatcggtgtggaacagagcgcccacggtatgcgcggccgcggtcagctcgcggatgggctgcaccacgccggtctcgttgttggcaaccatgatgctcacgagcgccacgtcgtcgccgagcaagtcgctcagcgcggcaggctcaatataacctgcacggcagggctgcaccaggtcgacggtaaagccggcagcacgcagcagcggcaggttgtccagaatcgaatcgtgctcgatggcagatacgatcacgcggttacgcttgcgatcgcgctgacgagcgccctcggcaagaccgagcagcgccagctggttggcttcggtgccgccgttggtcaaaacaatctcggacgggcgaacgcgcgcgccaaagctgcgggcaatctcgcgacgcgccacttccaggcgtgcagcggccttgcggccgagcgaatgcagcgagttggggttgacgccggcaagctcgctgtcgtcgtactcgcgctgcgcaaggcgcgcctcgacgcgcatgggcgtcgaggcggcatagtcaagattcacgggtatgcggttttgacctgcggtcataaggttttatgcctcctgtgcggcctcgttgcccagcttctgcagcagcgcaacctcggcagcgggatcttcggacttaaatacggcggaacctgcgacgagcacgttggcgccagccttgacgacctcggcgatgttcttggaagagataccgccatcgacctcgatgagaggcgaaacgccgtgacgctcgcacatggccttgagctcgtgcagtttggcaatggtgcccgggataaagctctggccgccaaagccggggttcacgctcatgagcagcaccatatcgacgacgtcgatgatgctctcgagtacgcacacgggggtggcggggttgagcaccacgccggccttgatgccgcgctgctgcagatgcgtgagcgtgcggtgcaggtgcgtggaggcctcgtagtgcacggtgatcatgtcggcaccggcatcggcgtaccaatcgacggtctcgtcggggttcgacaccatcaggtgcgcgtcgaccggcacgttggtggagcgcttgacggccttaaggatgtcaacgccaaaggtgaggttgccggtaaagtggccgtccatgacgtcgaagtgcacgtagtcggcaccggcgatcttgtcgagttcgcccttgaggttggccatgtcggccgaaaggacggacggagcgattttgatggaacccatggtagtagcctttctgcgctagtcggtgagtccgtagaactcttgagaggggacgcggtcggtgagaatctcgagcgccctatccaaagtaacaccgttgtagagcgtttgctccacggcaaaggtgagcggaatgtctacgcccagtgagcgggcaagctcgctgacgctgcgggccgcgacggcgccctcgaccaccatatgcgtgcgctcctgatactcgtcgagcgacacgccgtgggcaaactcgtagccaaaggtgcggttgcgcgaatgctccgaagtgcaggtggcaatgaggtcgcccatgccggcaaggcccatgcaggtgatggcctggccgccgcgggcatgcaccagacggctgatctcggccagacctcgcgtcatgataagggcgagcgtgttgtcgcccgcgccggagccggcggaaatgccacacacgatggcgatgacgtttttcatggcgccgcagacctcgacgccggtcatgtcctgcgtcaggtagatgcggaaggccgtggataggagcaggtccttaaaggtctcccctatctgcgggtctttgctggcgatgacggcggcagaaagcccgccgcggcagatctcttcggcatggttggggcccgagagtgccgccacacgcgcctcgttgccgatctcgctggcgatgacctcgctcatgagcaggccggactcgggctcaatgcctttggtgaggcagagcactggggtatcggcggcgataaagggcgcggcctggtggcacacgctgcgaaggtgcgtcgaaggaacggcaaagatgatggcctcggcgccgtcgagcgcctgcacgagctcggtcgtggcgacggagttgccgggcagcacgtagtccacaaggtagcgggggttgcggtgttcgccattgatgccggcggccgtctgctcgctatgggcccacatggtcacgcgctcggctcgcgcggcggcaaggccggcgacggcggttccccaggagccagagccaatcagcgcaacattcatgactctctcctacttatcatcgggttcggtgacgcgcttggtaaacgagagcttggactccttaccggtcatgagctttttgatgttcgcgcgatgggcccacaccacggtgatgccgatcatcgccatgcaaaacttaagtcctaggctgctgtacggaaagaccgcgcaggcagcgatgggaaggctgatagccgcggcaagcgagcccaccgacacgaacttggtgatggcgacggccacgataaacatgcccagcagcgacagaccaatgggccagtaccaggcgagaatgacgcccagaccaactgcgatacccttgccgccatggaagttaaggtagggcgagaagatatggccccacacggctgccaggcagacgacgccaagcatccagtcgccggcggcgccgggggccatgatgctcacggggaagccatagcccacgctcgcgatgagcggacgcgcgataaggacgcagatggcgcccttaaggcagtcgagcagcagggtgagcgcggccaccttgggaccggccacacgcagtgcgttggtggtgccgatgttgccggagcccgccttgcgaatgtccgtgtggttgaacacacggcccaggatcagaccaaacggaaccgccccgataaagaacgagaccacggcgcagatggcggtcagaagaatcggattatgcatccttttgctccttcttcctaaagaagagtcgaatgggcgtgccggcaaagtcgaaggtcgagcgcatgcggttctccacgtagcgctggtaggtgtcgttgaccaggtcactgtggttgacgaagaacgtgaacgtcggcgggttgacgcccgtctgggtcacgtagtgcatacgcaggcggcgcttgccgtccaccacggtatgaccgaactcgcgcaggtcggtgaggaacgtgttgaggcgcgaggtgctgatcttttgcgagcgcgtcttctcggcggcgtctaccattgcccagatcttctcgacgctgcggccggtcagggctgagatgcgcaggtactgggcccagggagccatgacgcccagacggcggtcgacggtctccatgcaggcctcgcgcttgcggtcatcgtcgagcaggtcccacttgttgagcagcaccacgatggcgcagccgcgctcgatggcaagacccatgaccttctggtcctgctccgtaacgcccacggaggcgtcgacgacgagcagtgccacgtcggcgcggtcgatggcgcgcaggccgcggaccatggagtagtactcgatgttctcgtacacagtgctcttcttgcggatgcccgcggtatcgaccatgcggtagtgcttaccgttgcgctccacgacggtgtcgatggcgtcgcgcgtcgtgccggcaatgttggacacgatagagcggtcggcgcctaggatacgattgaacagcgatgacttaccggcattggggcggccgatgatggctacgttcagcgcgtcggggaactcatcggcgacctcgtcctcttcctccggaagcagggccacgatgtcatcgagcaggtcgcccgtaccgtggccatgcagggccgagagcggcgtgggctcgccgatgccgagcgaatagaactcccagatgctgtcgttttcgcgatcggggttgtcgagcttgttcaccagcagaaagaccggcttgtcgcagcgtttgagcatgcgggcgaccgactcgtcctcctcggtgacgccggtgcggccgtcgaccacaaacaggatgacggcggcttcctcggcggcggcgagggcctggtcgcggatggacgtggcaaagacgtcatcgctcttgagcggctcgatgccgcccgtgtcgacgatggtgaactcgcggccgttccaatcggccgtgtgatacgagcggtcgcgcgtgacgccgcgagactcgtggacgatggcgtccgaggtctgggccaggcggttaacgagcgtggacttgcccacgttggggcgtccgacgacggcgacgataggtttcatctgctctcctttaatgggtagggtcagcggaattagtagagtcggcaggcacaatgccaaggatgtgctccagggtatcgagcagctcatgcggcatggtcgacaccacatgaacctcggcgccgcgactggtaaggcttgcgagtaaatcgtcacgatgatactcgtcaagcgtcatgccgtcagcgttgaacatgagcttaggcacaaagagcataaccccagagaggtcctgcggcagctgctccagaatgtcacacgcgacgatgaggccggtcacgtccacgttgccgccaaagtagcggttcttgatggctgtgacggtgccgccgagaccatgcggcgactccacaaagcgcgccaccgtgtcgcgtgcgctggcgcccgagaggcacagcaggtgctggctgcgagcggcgatggcctcgcggacgcgggctaggcgctcggcatcggcggcaagcacatcgtccgtctcgtctaggtatgagcggatcatgccgataccgtcgtagtactgcggatagccgtcgtaaaagtccgcctcgggcggatcgatgccggcgtccaggtagaactcgtcgctcatctggaaggtgtggcggccaaaacgctcgaaggcgcggtcctggtagggacggatcatggcgatggtctcgcgcgccagctcgggcttgtcgctgtaggaccagctaaaacggttctgatgcttggtaaaaccgagcggtacaatgcccaggcttgtgatttgctcgtgctcctcgcaaaagcgcagggtcttttccagctcctcgccgtcgttcatgccggggcacaacacgatctgcgcgtgaatctcgatgccggcggccatgatggcctcgagtacgtccatgccccgctgggcgttgcggcccatcatacgacggcggacgtcggggcttacggcatggaccgacacgttcatggggctcatgttgcgctggatgacgttttgcacgtcctcgtcggtgaggttcgtgagcgtgacaaagttgccctgcaaaaagctcagacgatagtcgtcgtcgcggatgtagagcgtggagcggccgcccttgggcagcatggtcataaagcagaacacgcaggcgtttacgcaggtacgcatgccgtcgaagatggggccatcgaactccaaaccccagtcctcgcccgggaagcggtcgagctcgacgggggtgacggtgccgtcgcgcgggtcgaatacctccaaatcaacggtgtcgtcgtcggcctcccaaagccatacgatcatgtcggtgagcgcctcaccgttgaccgtgagcacgcgcatgcccggctcgatacccacatcccatgcgggcgattcgggacgcacattcttaacgagcgcgccctcacccggctcggggtcgcggctgcgcccgtaatcggccacctcggcggcgtatgcgggtacggtctggtccatggttagcggcaaagctccttgatgcgcgcgacggcgcgttcgatgtgttcttgtggggtggaggctccagcggtgatgccgatgtggcgcgcctcggcaaaccaagcggcctggagctcggaagcttcctcgatgtgatacgtgcgctcgcaggcgtctgcgcaaatttgcgccaggcggcgggtgttgcccgagttcttgccacccacgacgaccatgcagtcgcagcggttggcaagtgtggctgctgcctgttgacgctcactcgtggcggcgcagatggtgttgatcacacgcaactcctgcacgcgcggggtgatagcggccacgacttcggcgaggttctgcgcggtctgagtggtctgcacaacgaggcccaccttgcccttgagcgacagggcatcggcgtcggcggcacagctcacgacctgcgcatcattgccggcgtggcccagaatgccctcgacctcggggtggcctggctcgcccacgacgatcacgcggtagccctcgcgcaccaggcgctcggctgccacatggaccttcttcacgtaggggcaggtggcgtcgaccacggtaaggtcgcgcttgcgggcagcaccgattacctgcggcaccacgccgtgggcgcggatgatcacggtgccggttgcggcgtcgtccaaggtgtcggccagaccgacgcctgcctcagcaagctcgcgcaccacgatggggttatggatgagcggccccaaggtgtgaacttgagtgcactcctctgcctgcggcgcagcggccagcgccatatcgagcgcacgctgtacgccgtagcaagtgccggcgtgggcggcgatctcgatggtaggcgcggttgcctggccggacacagtcgcggtggtgttcgtcacgttctcgctcatggctagaacctgcccggatgctcggcgcacagctcgtctcgcatggcgtagacgcggttcatggcctcggactcaaaccattccaggcgctccgtgcgcttaagcccagccggtgcgtcggaaagcgagacggccttgccggcgcggatccagcacttcttgggacgcatgagctttttgcctgcgggcgtgatgtcggaccagccgcagatggcgagcgggttgacgggcgccttgcccatctgggcgatgagcgcaaagccgccgtggacctcgggcttgatctcgcgcgagcggatgcgtgtgccctctgggaagatcaggacgtcctcgccgcgctgcagcgcatgctgggcggcgcgcaggcacttcatatcggcagtaccacgctcgacggggatgccgccaacgcggctaaaggcccagcgcacaatcttgctcttggcgaactcggacttaaagatgggacgaatgcggcggcccccaaagaacagcgccgtctccacggccaagagctcggccatcgaggtgtggttgcagatgaccacgctgccgcggccttcctggcgctcaaacagaagatcggcgtcctcgaccttccagcgccacatgagcttggagaaggcccaaaggatggccatgactacgacgacggtgccgcggatgagcgctggaaactcggcgtagggggcgttgtaatagtcctcgggcgtctgctgaaacaggcgcatgggctacctcctttggttaataaggtcctcgattatcgagacgacctcgtcgatggtgtgggcggtggagtcgacgtgcacggcgtcctcggcgggcacgagcggggcgacctcgcggctgctgtcaagcttgtcgcgcttcttaagggcgtcgagggtctcgtcgacctcggcttcgagctgctcggacgtgagcggctgagcatcgttttggtgacgctgcagcacgcggcggcgggcgcgctcgcgcgggtcggcggtcaggaagaccttgacctgcgcgttagggaacacgacggttccgatgtcgcgaccctcggcgacgatatcgcggtcctcggcggcgcggcgctggtggatgagcatggcggcgcgcacgcccggataggccgagaccttggacacgttggcgtcgacctgcggggtgcggatggcggccgaagcgtcctggccgtcaatggtcaggcgcgtgtcctcgccggtgccgtttgtaaagcggatctcgatttgctcggcgagggcgtcgatggccgcctcgtcatccaggtcgatgccgcggtcgagcgcggcgaaggtgacggcgcgatacatggcgcccgtgtcgagcttgttaaagcccagctggcgggcgatctccttggcgatggtggacttgccggaaccggcggggccgtcgatggcgacgatcatgcaatacttcctttcggtggttgacgtgctggtatggttcgcgggcgttggggcgcggcgggttgcctagcccgtgtagcgctcgcggtaggtgttgcgcttgggtgcggagccgtggctgccgtggtgacgcgtgcgggtcgcggtgttggtcgccggcgcggcgccgcgcttggagctggcctgcttgggcggaataccgccggccttgaggatctgcacctcgcgatcggtgagctcgcgccacgagcccttggccacgtccttgagctccaggccagcaaagttgcagcggtgcagacgaatcaccgggtggtgaatcttgctcagcatgcgcttgacctggttcttgcggccttcgcggatgatgacctccacggcggtggtgccgggcttgacgccctggggagctacggcctcggcctcgcgcgcgttaatgattcggcagatcgccggctggcataggccgtcgtcgagctcgatgccacggcggagcggttccaagtcgcgatcggtcaagtggccgtccacgagcgcctgataggtcttgtagacgtgcttactcgggtgcagcaggtcctgtgacaggtcgccgtcggtggtaaagagcaaaaggcccgtggtgtcgcggtccaggcggcccaccgggaacagtcccggaaagcggtcgcgggggaccaggtcggccacgcaagggcgctcctgcgggtcgctcatggtggtgaggtagccggtcggcttgtaaagcatcaggtacacggcgccctggttgagcttgacgggcatgccgtcgacctcgatgtggtcgcggtcgacatcgaccttggtgcccagctcggtcgcgacctggccgttgacggtcacgcggccggcggtcatcaggtcctccgagccgcggcggctcgccacgcccgcacgcgccaaaaagcgctgcaggcgcatggtgtgcggatagacgggctgggcgtcggttacgggtactgcgttgcccacggcgcgcgtctcccctacttcgttagtcctcgtcatgcaaatcctccgaggtctcgtcgacgtccagggtttccaagtcctcgactgcatcaacatcttcaacatcggtatcgagcagttcgcgctcttcgtccagatcttcggcctgctcctcgagcgtggactgaatgctgcggccgcttagacgctcgcggataaactggcgcgactgctcgtcgggggcaaactgctccaggtcgggcaggtcgcgggtggagcgcagaccgaacttttccaagaaggcgttggtcgtgccgtagatgatggcctgaccgcgctgggggtcgcggccgagctcacgcaccaggcccttgtccacgagcgacgcgatgacgccgtcggagttgacgccgcggatgcccttgaccacctcgcgcgtcacgggctggtggtaggcgatgacggccagggtctcgagtgccgcctgcgacagcttttgcgtgtcccagctcaacacgtgggcctcgaccacgtcgtggtaggcggggtgcgtaaacaggcgccagccgccggcgacctcgcgcagctgaaagccgcggttggcctcctcgtactcaaccttgagctcggcgagcagcgatgcgcactcgccgggggcgatatccagcgcaccagccagcgcgggcgcactcaccgggtcgctcgacaccagcagcagcgcctcgagggcacctttgaggctgtttgcctctagcgtggaaagggttgacatggttgcggctcctattcggtgagctcggggccctcgccgggcacataggcctcggcgccctcgacgcggttgatgcggatggttccaaagatctcgtcctggctcagcgtgagcgagccgcgcttggcgagctccagcatggccaggaaggtgacgacgagctgctcggtggtggcatcgccgtccaacagctcgcggaaggtgcaggtttggtgcgccatggtaaagcggtcgactgaggccacggtcaggtcgagcggtacgcgatgcggcgccacatgctcggcctccagcaagaaggtctggcgcttgccgtccaggtcggcacagatgacggcgagaccgcgcagggtaatgccggcaaggtagtcgggcataaggcctaggaactccgggtcgggaccggccacacgcggatgcatacggctttcggcctgcatgcgggcaccgagggccgcagccgcgcccttaaactgcttgtaggcaatcaggcgctggatcaggacctcgcgcagggcgtcgccgtcgagcgcgctgagctcctcgagatcttcgtcgaactcgtcatcgtattcatcggctttgcgtggggcctcctgcggcaccagagaggcagccttgatgtccaaaagggttgccgcgaccagcaaaaaatcgctcgccacgtccaggtccagtgcttcgatgcgctcggcctcggcaaggtattgctcggccacctcgctgatggagatggcgccaatatctactttttggcgggttaccagctgcagcagcaggtcgaacggtccgctgtagacctgcgtcgacacgcgatacgacatcttcgacctcctttgacggcgccttcgcggcgcggtttgggtgcatattgcgacagttttgcacggtcgacctgtaagtttaccttagatgccggcgattgcgaagttgagcagctgctcagcaagcggatacacggtaacgtcgaaatagcggccgattacatcgatgccggtccacatgggcagcagatacagcacgatgatgagtatgggcatggcgtattgctgcaggtggtagtagttggcgagcgccttacctttgaggaacggcacgatgatcgacgagccgtcaagcggcggaatcggaatgaggttaaagaacgcaagcgataggttgaccacgataaacgtagcgccaaagttcatgatttgcgacgctacggcaaaggacatactggtgtagaggttgccgtaggtcaggtgcatgagggctgcggccaggcacgcgagcgcgatgttcgatgtggggccggctacgctcaccaggacctcgtcgcgcttggggtgcttgaggttgttgagatagacgggcacgggcttggcgaaggcgaacacgggaccgcctgcggcgagcatgagcagcggcaggatgatggtgccaaacggttcgatatggttgagcgggttgagcgagacgcggccgcgcgagcgagccgttttgtcgccgagcgcccaggctgcggcggcgtgcgcgctctcgtggatcacgatgccaacgatgacggcaacggcactggcgagcaggttcatgatgtagctgctggacataacactcccctagcggacgcggcgcgaggcgcgcgtgagcaggtagtcaattacaaacaggatcacagcgacgatagcataatccaggcggaacacaccgccaaaaggcgacgtgatgacgccgtagccggcgatggcgctcggcagtgcacgcgaaagctcaacgacaaagccaacgatctgcagcttggcggtgaggccgctaaagcacagcagaacggtcattgcgctcataaagatgccgcagatgcgacaggcgatggcgatgatgatcatcgcaacggcggcggccttacgagagttcacgcgcggtctcctcttcgatctgggtggaaagctccagccattcgtcctcgagcttgggcagctcctgcttaaggccgttatattcccccagcgcggcgttgaacttgtcctgatcggcataaagctcttcacttgccatcaattccataagctcgtcatagcgggcacgctttttgtcgagctctgcctcgatcttcttgagctggttgcgcacgcccttgagttttttgttgagcgcagcgcgggcctgggcctcggcacgcttttgctccttggtctttttgccctcggcaggtttggaagcggcggcgggcgcatcgggctgggccgcggtgaccttggcggacttggccgcgacaggcacgctctcccctgctgtctcggcggcggcgcgggccgcgaggtcctcgcgcttgtagaggtagtagtcgtagtcgccgtcgtagaccgtgaccttgccgtcgcggatgtcgatcacacgattggccacggcgcgtaccaggtgctcgtcgtggctgatcagcacgatggtgccggggaagttttgcagggcgttctcgagcatgtccaccgagtcgatgtccaggtggttggtgggctcgtccaggcacaggagcgcctcgggggccacgagcatcttggccagtgccagacgcgccttttcgccgccggagaggacgcggacctgcttctcgatggaatcgttgtcgctaaacaggaaggcgcccagcaggctgcgctgctgcggcacggtccatttgggcgtgacggtgtcgatctcttgcaggacggtattggactcggtcatgccctcgagtgcgtgctgggcgtagtaggccacgcccacgttggtgcccagatcacgcgtgccggtagttggcggctccagaccggcgaggatcttcatgagggtagacttgccggcgccgttggggccgacgagcgccacatgctcgccgcggtagagcttgaggtcgatatcgctgtagatgtgctttttgccgtaggacttggagacgccctcgagccccacgaccatgtcgccggagcgcggcgggtcggggaacttaaagtcgatgtgcttgtggccctcgggcaggatgacaagctcctttttgatctgctcgatcttgcggatgcgctcctgagcctgggcagccttggtgggcttgtagcggaacttgtcgacgaagacctgcatgtgggcgatgtcgcgctcctgagcggcacgcttggcgcgcatctgctccaggttgtcctcgcgctgcttgaggtaactgctgtagttgccggtgtaggtggtcacgcgacggttttcgagagcggcgacgtggtcgacgcaggcgtccataaaggcgcggtcgtggctgacgatgaggacggcgccgtcgtagttggcgataaagccgcgcagccattggacgctctcgaggtccaggtggttagtaggctcgtccagaagcagcaggtcggggtggcgcaggaatagcttggcgagtgcgatgcgcatctgccagccacccgagaactcggagcacgggcgctcaaagtcggtgaccttaaagcccaggccggaaaggatcttgcgggcgttgctctcgagctcgtagccgcccaggtgctcaaagcggtcctggacctggccatactcgttgaggagtgcgtcgacgtccttgccctgatcggagagctcggtgatctgggcctgcagctcgttggcgcgctcgcccatgcggcggatttccttggcggcggccatgacctcggcaaggatggtggtgtccttttgctccagattagtttcctgctctaggtagcctacctggcagtccttggcgtactggacctggccggcatcgggactgtcgatgcccatgatgatcttgagcatggtggttttgccagcgccgttggggcccacgagcgcgaagcgctcgccggggttgatctggaaggatgcgccgctaaagaggacgcgcgcgccgaagcttttttcgatcttgtcgaccaggaggatcatggtgccgcctttgaccttgttttcctatatgaaaaaaggccccaacttgcgttggagcctcattcaatgctcgggtggagacgagggggatcgaacccctgacctcttgactgccagtcaagcgctctcccagctgagctacgcccccgtgcgaaaaagtactatacgggaactcccccggcgatgcaaggacaattttggaaaaactttcctggggcggcggcgcggatgcgggacggactcgagagcgatgggcccgcgatgcccgactaagcccacggggcgcgccccgcgggagggcggcgctgccgccgccctcccatcaggctccactccgcccgcccccggggcctcccgccacgaaaccggcccatctactacgtttggccggcatcccccgaccatggcgcctcgggcaaaaataaaatcgcaggtagacggcctgcggttttcgcgaaatacggggtatggtcgaggggtcgggcttaaacgtagtagatgggccggtttcgtggcggcggcatcgcgggcagtcgacagggggcgtccggaagtgagcaagcaggctatttgcaagtggaaactactgccatgaaaaagaaaacaggccagacatattgcctgacctgttgaaaaacctggtgggccctccgggattcgaacccagaacccagggattatgagtcccctgcgctaaccgttgcgccaagagcccttataaagtggcacttacagttggggtggcagaacagcctccaacgcattgaaccacgtcgtgaaatactaccatgcacgcgacgcccattcaacgcacgatcttgtcgaccaggaggatcatggtgccgcctttgaccttgttttcctatatgaaaaaaggccccaacttgcgttggagcctcattcaatgctcgggtggagacgagggggatcgaacccctgacctcttgactgccagtcaagcgctctcccagctgagctacgcccccgtgcgaagaagtactatacgggaactcccccggcgatgcaaggacaattttggaaaaactttccggaggcgcgggcgccgctgggacgagagcgcggcgcggactcgagggcaagggacccgcgatgccggatccggcccgcggggcgcgccccgcgggcggcggcgctgccgccgccctcctccccggcgcccccagggcatctcgggttccgccgctcgccggttttcgcttccaccccacgggccgccatccgcccaacgaccatcccgccggcgccgggcccattatcggggccaatcgcgctcccgccgacccggcgatttcaaaaccatgccggtttacggggccaggccgggaacccccgagcatgccgtaatcggtaaaatcaaaaccgcaggtagacgacttgcgcattcagcgaaatgcagggtatggacggccggtccgggtccagccccgtaatccggcatggttttgaaatgatactaattcactagcagtaaaactaggtcgttctagcgccttgtcgccggctaatttccgagttccaaccagttgcacagaacatttgctcgcagttgcgtctcggcgcgcttcattgcctcggatttggctttatatcgaatccccaaacgactgcagacgcttttgactatggcgtctagctgttttttgtcgttaagcatatcgtgggttaccaggaacacatcgaaacccatgctctggagcgcagtcatgcgctccgcatcttggtcaagtaccgcgcctgacccatggatgacctcaccttggatttcgataattgctgccttcattaggattgggtttacaatcacgatgtcaccgtagcaaaccttttgacctgcgatgctttgggcttcctcggatagaggggttaaatcgttgaggtatacgtatctgaatcctgaaccacctagacgtcgagaacgacttagaagcaggacccccgcgacctcgagtggagatgcagcaatgccgataacctgctgagcggcatcataaaactgctttccccacatttgacttttgaccttttcggcgaatcgatgcaagtcgctcagttcgatgagtggctttctcatccaaagcgaagtacctttgagtttcgtaacctctcttccatcctcgcgattgttcgtttggccttcatttgctgggacctttacggttgtgcgggcataaactcgtttccaaggaatctcgtcttcgccttctccaagttcgaacagatcctgcgtgctggaattgcgattctcctttaacgcgatttttactgcatttcgacagcgggggtcggctcgaaaacagaaaaccagccgcaaagttcgtacatagccagtacgagatctatttgggacacaaagcgtgtcatagtaaataacgtgttaagcggattggtgacgctgttagcgccggaataatttagccaaatatagtcggccgagattgaccaatcccgaacaaatccaagttagaccatttcaaatggttcgatgtctgcccggatgcgacacaactggtgtgtccatcctcgcagtatccggttctcaaggtgcacgcctgcgctggttcccggttccaccgggccgcgcggcaaggagatatattgccagaccggaggggccccgggggcgggaatcgcgcactccatattttgttcacaaatgaataggtccctcagtcgcatcactgaggttaaaactgaagcattggcttctgatattggcgatgaccagctgttttatgtgtattgagacatcggtcatctctggagcgctactttactccaaaggcatcagttatttgtttcccatcggtaaaaggcgggttttgttcgccaagcgttcttatatatagctagatacgggttcgaacccgtgcaccggcaacaaaaaagacggccaaccgaagttgaccgtctcaacaatctttgggtgggccgtcaggggttcagcctgcttcgcaggcggccgctgcggcgctttcgcgccttgcgcgctgcgctggcaaacgctcacgcgtttactcagctccgcgccccgacgggttcgaacccatgaaagggcgacaaaaaagacggccaaccgaagttgaccgtctcaacaatctttgggtgggccgtcaggggttcgaaccctggaccttgggattaaaagtcccctgctctgccagctgagctaacggcccgcgggtggcattgtaccacggtctgggactattcccaactccattggccgttctggaaaatcacaacttcacgtccatcaggcgtaatgcccacaatatcgatgtcgtccgtgccgatcataaaatcgacgtgcgtgctcgagacgttaacgccatgctccagaagctcctccttggacatgtcatacccaccctcgatgcattcggggaaaccgacacctagcgcgagatggcagctagcgttctcgtcatagagcgtattgtagaacagaacaccactttcgcggatcggcgtgttcttggaaatgagcgcgacctctcccaggtgagcagcgccctcgtcagtatcgatgatacttgcgagcgttgccttgcccacgcgggcgtcgtagtccaccacgcggccgccctcgaacttaatccaaaaatcttcgaccttattgccgtgatggatgagcggcatggccgagtacacgataccgtcggcgcgcatgcgatcgggcgaagtgaagacttcctcggtgggaatgttggggaagaaggggtgcccatcgggcgtcttgcccttgccgccggcccactcgtgacctttcgtcatgccaatcgtcagatcggttccatttgccgcggtgtaatgcaggtagtcgaaacgattgtcgttcaggaaacgcaggttcttttcgaatgcggcgtcatggagttcccagtcgctctctgggtcctggccatcggcgcgcgcggtgtgcagaatcgcattccacagcttatagattgcaacctcatcggcgtctcccgggaacacctcgtgcgcccaagccacgaccggagcgccggcgatgcaccacggattgatgttgtaatccagtccacggcggaaaactttgcactgcgtattcctcgcctttgatgccgcggccggcttggctggatcgatgcccttgagggccgcaggatccgcaccctcgataaagacaaagcaggcaccatcctgggccaaggaatccagctgcatgcgcttccactcggacgtctgctcaaaatagcttttctcgacatgctcgtacgtgagcctcgtcacggcatcatcggcccaaatgaccgtcacgtggccggcgccggcagcataggcctccgcgaccaccacgcgcgcaaacggcgcgcactcgaccggagactgaacgacgacctcctggccgggcttgacgtttacgcccttgcggacgaccaggcgcgcgtagtttttaatcttgggctccagggccttcatgccctccagagcctcttcgaccgtcagggcagctcgaatcatgtgccactccatctatctatagaacagtaaaaaggcgcgccgcaaaaacgacgcgccttatatcttagcgataagtatgtatgcaaacgctacttcttcttggagtccttcttgtcctcctcggcagccgcgcgctcaataagagcgttgagcttgttctcggacatgccctcggcctgcgcgcggtacatgttgcgcaagggacgaatacgagcgaagtcatagataaagtcgcccaaaatgatgacgtaggacaaaacaatgccgaccatctggacagggctggacaccatgccagcgggagcgaagtacagcgaggcccaaattgccacgacgagcaccatgccaatggcgagcacaatccaccagatgcgacggcgcttggtgtagtcctcgtcctgcttgaggaggatattcgacaccgtatagatgcggtcctccttggcgcgctgcttagccttgcgggcgcgcttctcctctttagagaggccctcgaggttctcgcccttctcgagctctttgcggcgtgccttagacgaagccggcacgacgcgaacggagctcgctgcttggcgggcgggcttagcagatgcggcagacttgcgcgcaaccccggtaacttcgtgggattgcgtgcgcttgttcgtggcgctacgggtactcacttatgcgttctccttcatgcttgtgaactgggagcccgtgatgatctggaaggcctcgcgatagcgctcggacgtgccatcgatgacctcggcgggcaggtgcggggtctcccccgtcatatcccagttggccttgagccaattgcggacgaattgcttgtcgtagctaggctggatcttgccctcctcgtagctggcagcaggccagaaacggctggagtcgggcgtgagacactcgtcgatcagcgtgaccttgccatcgatgacaccaaactcgaacttggtgtcggcaatgatgatgccacgggtcgcggcgtactcggcggcagccttgtagatcttgagggaaaggtcacgaatctgcgtggcgatgtcctcgcccacgatctcgcagcaacgctcgaacgagatattctcgtcgtggtcaccgatctcggccttcgtggacggcgtgaacagcggctcaggaagcttggaagcctcggtcaggccctcaggcagctggatgccgcagacggtgccgttctcgtcgtaggtcttcttgcccgaaccggtcagatagccgcggacgatgcactcgataggaatcgtctgggccttcttaaccagcatggcgcggccagcgaggtagtcacgatactcagcaaactcctcggggaaatccgccgggtcgatggaaacgagatggttggggacgatgtcggcaaacttatcgaaccagaatgccgagatgcgattgagtacctctcccttaaacggaatctcgtcgggaagaatgaagtcgaacgcagaaatgcggtcggtggcgaccatcagcaggttttcaccggcatcgtaaatatcacgaaccttgccacgggaatccggacgacgctccatcgttgtcacgtgagtcactccttacctaaatacgacagaaatgcgggttttttcccgcatgttttcgcaaactcggagcggcagggacgcggcccctccttcaccgaatagcgaaaagctagtgctccattgtagtagatgccgcgtccgccgtgtgctcgcggggcagatgaattgtaaaagtcgtaccctttccaagctccgactccacggatatgtagccatggtgacgctcgacgatctgcttggtcacggcgaggccaacgcccaggccgccagcttcgcgggcgcggctggcatcggcgcgccaaaaccgcccgaagatgcgcgacagatcgtccttggcaataccgatgccggtatcagaaacggcaatgctgacgtgcttgcggtcactgagcaccgacaccacgacccaaccgccctcgggggtgtagcgcatggcgttgctcatgaggttgataacacattgcgtgatcatgtcgggatcggcctcgacgacatcgtcgtgaccctgggtctcgtccgcaaaacgcaggcgcagatcgcggtcgacaaacaggcgctcctgggcattgacgatggaacgcacgaaaggaaccatgtccaccggctcaaggttgagcggagccgtgctgttttccatgcgcgacaggtcgagcatctgctgcaccagacgagccaggcgacgcgtctcggaagcaacggtctccaaatgctcatcgtcggtgggatacacgccatcctgcatggcctcgaccgttgcgagcatggccataagcggcgtgcgaagctcgtgtgcaacgtctgaggtcaggcgcttctcgtgtttcatatccttctcgagcgaagtggccatctcatcgaaggtctcacccagctgatcgatctcgtcatcaccgcgcagtcccgtgcgagccgacaggtcgccgtcacggatttgctttgcggtactggtgatgcgatgaatcggcttggtgagcatgcgcgacacgagcgatccgataacgaccgaaatgcagattgcaacaaccgcggcgagggccatggcgttaaaggtcttctccctaaacgcagagtccgccttggtgagcagagcgtcggagccgatggcccacagctttacctgtccgacatgctcgccggaagacgttacaatctcgacgttagcaacgctatcggagtcggttggagcagacgagaccgggctatgcgatgccctcttgccgctcgtgtcgtcagtcgtagcctggttttcgcgtacatcggcggtggcgcttgccgagggccaggaatcgtcataaacgatcacgccctttttattgacgacctgcatgcccagatcgtcggaaaccaaactcgacgttgcgaccgtgcgcagttctcccgcggtccaagagccgttttcctcatatgaggttgccaacttctcggcagcggaatttgcgatttcgacgatattggagcgtgtgtaatccgaaaagaccgtgccccacacaacagagacaacgcccaccagcaccaataccgtcatgagcgatgtcagagcaaaagcaagtgccatgcgcgagggatagctcatcgttggccgtgaatcggaacgaggcgtgttccaactagccttggaacccgcctcgctctcctgcttgtgcttttgtccgatttcaaagcgcgcaggtgtcatatgtgatttccctatttctcgtccgacttatcggtcttggccggagcctcgaagcgatagccgacaccatggacggtgtagagccacttgggcttcttgggatcatcgcccagcttggcgcgaagattcttcacgtggctatcgatggtgcgctcatagccctcaaagtcatacccgagcactttctcgaccagctccatgcggttatacacacggccgggatggcgggcaagcgtggtgagcagcttgaactcggaagccgtcagatcgacttccttgccctcgaccaagatcttgtggcccgagatatcgatgaccagatcgccgaagtcgagcacctcgacggcgggctcgtcggcctgatgggcacggcggaacagagcacgaacgcgggcgacgagctcgcgcggcgagaacggcttaatcagatagtcatcggcgccgagctcaagaccgataatacggtcctcgatctcgcccttagccgtcagcatgatgatggggacatccgaggtatcgcgaatggtgcggcaaacgcgctcgccgggaatcttggggagcataaggtcgagcacgaccaggtcgaactgatgcttctcgaactcctcgatcgcggactgaccgtcgccgacgcccacaacccagtagccttcgcgctcgagataggcagcgacggcgtcacggattgccttctcatcctcgaccagcagaatcttttttgcatctgaagccataacacggcccccctgtctcaattagctaagaacaagcccattttaacgcacctgagcccgccagatgccgctatgacgcggcagctcggcgggcggtactcacaattacaacgcgtttattcccctgttggcgcctttttaacccctctaagcttaaagagagaataggcgtgcagtgaccgtctctggtataccctggctgttgcgcaccgtggcgtacgtaaggaatgagtccgattttcccgccgtagctggataatcgccatactccaaagcgcggtcgggcgacagcagcgagccataggtcttggcagaggtgtcgatcaggaaatgcgacgcctgtaccttaacaaggtatttattcttcttgccagccgcacatgcgagcggctcgcgtgacaggaagaggtacggccctccctcattaccgatatacgtgcccatattgcccaggctgcccacgccactataggccgcctcgatagaaaacacgaaggtatcgcccatatatacggcctcgaaaggcgaaactgacgaaggaaggaccaactgggcacgcttggtgttgttgccgtcggtcagatcgattgccgttatgccgtagtagacgccctcgtcgttgcggacacgcggcgagatggtcaaaatgccgtcgctcgcgcgcggggccgatgcaaagcgacccgtcgatttccaaattgtctcggccttggattcatcaagcgagcgacgatagcaaaacgaatcgctactcgttttattgccacctgccgagggcattttataccagatgactgatgacccgaacgccgtaaacagcggcggatcatagtccttgccacctcgatcgagctcaaccacgtcgccagagagcgaagcgcccgacagattttgaccgtagagcttccacgatgaattggcaaagttcatctcaacccacgcgaatacgctgtcgccggcacggacatcgtagaatgcatatcccgtgccctcgataggatcctcgattaatgtggtaagcgagccatcgcccaggttgagcacaccgagcgtgttggcgtgcagtgccgatgcgggcgccatcattgccgcggcgtaatcgccgtcgcagtagtacagcagcgtacccagaggcagcgtccacgacgccgccggctcaagatcgatgtcgactgcctcgtactcatccgtaatcgagatgattttggaatcatccttgataacctgcggctcgccggcggcatcatcgctggtgcccgtttttttcgagcatccggcaagcaccgtggcagcgcccgcggcagccccaccgagtacaaagccgcgacgcgatattccgttcttgatgtgatcggcgatacccattaggcgatctcggtgcgagcggcctcgatagcgcgtgtaagctggtcggcgcaggaggtctttttcataccgcaggtattaccggcgagaacctcgattacgcgatcggcaggagcgccctcgaccagcttggagatagccttgagattgccgtcgcagccgccggtaaactcaacgcccatcaccttgttgccgtcatcggaaagatcaaggtgaatattgcgagcacacacgccctgaggcttgtaatcaaacgaaatcatgcgatcccctctcagaatgttattcgagacgactattatccccgtctttccctaaatgcaacgaggcgctttgccggcaacacacattaccagcaaagcgccctaaaaagctaacgttatgcccgaacctactcgaagctcagctgctccagacgatcaaagaccgtgtcgatacgggtgaggaagtcccacggatcaaagatctcgtcgagcttctcctgactgacggtgcagcgcgggtcggcctcgagacgctccttaaaggtggggccggagacacaatcctgtacctcgtgccaggttgccatagcgttctcctgcacaatggcgtacgcgtcctcgcgggtgatgcccgtgtcgacgagggcgagcagtaccttggaagagaagatgaggccgcgggtcttattgaggttggccatcatgcgggcgggatacagttgcaggccgtcgataacgcgaatgaggcactggaacatgtggtcgagggcgatgaagctgtcggcctgggcgacgcgctcggcagaggagtgcgaaatgtcacgctcgtgccacagggcgacgttgtcgaaggcaacctgcgcgttggccttcacgacgcgcgacaggccacagaccttctccatggtgatggggttgcgcttgtgcggcatggcggagctgcccttttgacccttacggaacggttcctcggcctcgagtgtatcggtcttctgcagattgcgaacctcggtagcgatgcgctcacaggtggccgcggtggtggcgagaacgccggcgagataggcatggtgatcgcggctgatgacctgcgtggacagaggatcgtggaccaggcccaggtgctcgcagacgtactcctcgacgaacggctcgatggagctgtacgtgccgacagcgcccgagatagcaccgaaggcaacgttcttgcgggcatcctcaagacggtccagatcgcgcttgagctcccaggcccaagagccaaacttcatgccgaaggtcatcggctcggcatggatgccatgagtacggccggcgcagagcgtgttgcgctcctcaaaggcgcgacgcttgcaaatctcgccgagcttcttgacatcctcgatgatcaggtcgcaggcctgggtgagctggtagcacagggccgtgtcgcccagatcggagctggtcatgccatagtgaacccagcggctgggtttggggtcgccctcgggaacatcggcatcgatgtattccttcatgttggtcaggaaggcaatgacgtcgtggcgcgtgacttcctcgatctcatcgaccttcgccttctcaaagttggcatggtcgcggatccactgggcctcgtctttggaaataccgatcttgccgagctccgcctgggcctcgcaggccaagacctcgatctcctgccaaatggcgtacttgttctcgagggagaaaatgtgtcccatctccgggcgggtatagcgatcgatcatagcggctcctttttggttattggcacgttggtcgtaacccatccattgtaccgtgcgcaggtgcaagtatgggcagcaggcattaacctaacattttggaattggagcgagcaacgggacgtctgcgttatttgcttcgcaaatacgcaccggctgcggtcgatcccctcggattcacggtgacgatggggaagactttgttgaattggccgtcccgaggtcttctgtgctccatggagcggacaacgggacgtctgcgtatttgcttcgcaaatccgcaccggcttaaggcgcctgtcggcgccttcgcctgctcgctacaaacgcttcgcgtttgcttaacgctcgcaccctggcgggttcgagtcccggcgcttggtagtaaaaagcacggcaacgtaacgctgccgtgcttgtgctttttactggagcgggcaacgggactcgaacccgcgagtgtcagcttgggaagctgatgccttaccacttggcgatgcccgcatatgtgggggatagtataacgcggttgtcttgttcgatacaagagtggcgatgcttgttttagctgtggagattcgtttgaaaatcgcgtcaattgtggagatgaggacctttgacttcctgttctccctatcttctacctgcgcttttgcttgattgttgtatttgagctcaatttatcaggaattgggcaagcttttggtcaggctccggtacttacccgcatgaacctcgggggtagcctcatcctacgcgtcgcagcctccccatgcggcgcacgagggataaggagcagccatgtccaacgcacccacgcactctgtccacagcgcaatcgcaacaggtccgctgctcctgctcctcttcctgcttttcggctacctggcaccgggagccgcatttgccgtcgatggctacgaccagctcggcttccgcactattagcgatgattgtgggcccttctttatcggcaagtatgaagctcaagacgcctcgattgcctactgcatgaaccaggagcgccccggccccaccaagccgggcggcccatggctcaactttgatcaaggctgggtttggctcgacgacgagttcgcggcaatcgtttgtcacggatatcctaccgccacgtcgtttggcggctaccatctttcacccgatcgcgcccgcgccgcaacccagcttgccgtatggatgctcaacggcactacccatgtcgacggtacctactcctacacgaccgctcagggcaaaaccaagagtgggcactttaccgctgacaatgaagtcgtggcggcggcgcggtggctccacgacagcgcaaaatcaggaagcatcaaagccgcaccgcaccgcgcgcggcgctatctaggaaccgtatcgggcggcagcagacgtcaagacatgctctatgtactgccggcggtctctgtttccttccaaaagcagtctgcaaacgctgccattaccagcggaaacaatacttatcagtttgacggggcaacattcgatatttttgagagcggcagcggcgcgcgtgttggcaccatccagatggacagcaacggtcgagcgcaagcaacactcctacccaacacggcatactacctgattgaaacgaaggcgccggccggctatgtcccccgtcgtgatcgcatcgcctttaccacggggaatgacggcgggcgggtcgccattgatgaacagcccggcaccatcaacctgcgtatcgtaaaactcgatgccgcgacgaatgccggcccccaggtgggatcttcactcgcaggagcagagttcacgtgtgtgtcgcaatcaacccctggatgggcacaaatcctcacgaccgacgaaagcggtcgggccaccctcaccgatgtccccttaggaacctttaccatctacgaatcaaaagcccccgagggctacctgccatccaacgacagctggacctataccgttggagccgaccagctcggcgattcaggcgtggtcgagatcgaatctcgcgtttccgatatccccattgcgtttaaccttgagatttccaaattcaaggattacggcaatagcgaccaatccggcctggagcagccggcggaaggtgttgtctttgaggttgtcagcaacagctctcagcaggttgttggcacactgaccacaaacgtctatggctttgcctccaccaaagatcagcccgaagcatggttcggcgcaggcaagcgacccgccggtgtccatggagccatcccatacgaccgcgccggctacacggttcgcgaggttccggaaaccgtccccgagggttttaaacgtgcaggggaatggaccgtcgaggccaatcagatttccaacggcgccgagcttcaatatatcgtggacaaccacgcgctgtcgacgcatctccagattgtaaaacgtgatgcccaaacaggcgcttctgttccactagccggattcaccttccaactactcgacagcaatcacgaatctgtctcacaaacttgctggtatccaacacataacgtaatggacacctttacgactgacgcgaccgggaccgtcacactgcccgaatcgctcgtgccgggcacctattatgtacgcgaaacctcggccaaagagccctatcttgtcggcaaggagatcgaggtaaacatacccgccgacatgaacctaacgcccgttgcaatcgcctcgtattatgaccacgccgcgaccggaaacatcaggatcgttaaaaccgatgccgtagacggcagcagcctcgcgggcgccgtctttgagatccgtgcctcgggtgatatcgtgcgccccgacggtagcattgcagcgctcgacggtgagactgtcgctaccgtcacgacagatgaaactggagaagcacgcgcggacgacctcccgctgggatctggcaccgcacgctacgaggttgtcgagactcaagcgccggcaggcttcttactcgatcggacatcccatattgtcgaccttacttatgccgaccagaaaacacccgttgtagaagcacggcttaacgtatccgacgattacaccaaggttgatatctccaaggtcgatgcaagcggtgagcaggaagtggaaggcgcacaactcaccttatatggtcccgataaaaccgaaatagactcctggacctcatccgacaagccacaccgcgtcgaacatcttgcacccggcacctactcgttgcgcgaaatgatgtctccgcggacctatgaccttgccgaggaaataacgtttgaaataaaggatacgggagaagtccaatccgtcgcgatgaaggatgcgcccatcgagatcaagggacaggtcgacaaacgtcaggaacttgtccaacctatcgaaaagggcctgttggctaacggcgatggtaaaaaccgcgccacgacgcaaaccaatagtgatgggcttttctcctataccatcgatgctcgaaacgattccgctacttgggttgatgagtttacgattaccgatgatcttgagtgcgccaaagacggcacggcgagattcatctcaatcgaaacccccgtcgccatcggcgacctcaatggtctgtgcaacgtgtggtatcgcacgacgccgttggactcgacagacgtcgatgagccggcaaacgcgacacttgacgatgggcacgaaaatccttggcttgagtccgacgaagtaagggagagtctgggtgaggattgccgcctcgtcgattacgacggctggcacctctggaaggcggatgtctcgaccacggaatccaccacactcgaggcgaaagaactcgaccttgcgtccaataccgtcgtaacgggcattcgaattgaatacggtgcggtagccgccgactttacgactcgaagcgatgcggattcttggacccgcgatgatctcaaagatgagcacgacgaccttgacgattccaaagcaatccttggcacagacgctcggggcgcagtcgtacacatgcaggcaacgtcggcttatacgccccaaaccgcactcatcaacagcgcgcgcgtcgatctttgccgcaacggtggcggcgataaacttgagtcacatgacgaggacagcgtcattcaacgctgtaccctaccgcaggacctaccggcaacaggatcagctcccatcgctgcttgcatcaccgcgctcctgacctcgggtgccgcagccctatggttcgctcgccttaggtcgatcccaaagaagcgctagcgcgatgaaaaagcgggcgagacagtcccctggctcgcccgctttcaatcatgtaaatcgccgtatctactctgcagacgaagatccaccatcaacgattgcctgctcggactcaggaatcccatcggcacccgtgctctgttcttgctccacctcttcgctgattgcggaggcgggggtcgagcccttcgcacccacgatgtaggcagccccaaatcccaacgcaatggcaatcaaggtcaaaatcacgtagacaggccaatggcgcttaatatacgaaaacacgttgactccttagagctccgtctacgaacggcggataacctcggtcacgacctcggataccgtggcaacgttcgtcgggttgacattgtggggcaggtcgtcctcggtacgagcgcaagccagacgcgtgccgtccacgccggcgatggtgagggctcggcggctcgcctcgagcgcggcataggcatcggtcttggcatagggcatctcgagcgcgccacaatcgacatggaacgacttgcagaccttgctgaccaggttcatgatgcggcgatcgcccttgagcagttgttgttcgccctcgaccgtcacaaccgaaagcctaccggcgccgacggattcaagattgatgaaaaatacgccgcggagcttatcgcgatgcgaagccaagaaggccttcatgccggcgccatcacaatccgaggcgcccgttgccacaaaccagatatcgtgaccaagcagctcatcatcgcccatagaggcgacagccgagagcatatcttcggaagaagcgccatcggaagacgtagcgccacccttccagccatcgttatcgtcctcaaagttatcccacgaaccgataccgcgaccggacttcttggcatcgtaatcgtcttcgacgcccagccagtcactcatgctgtcctgctcgtttttctttttacgaccgaacaggccacccaggccgcgcttacgagacttgggtgccgatgtgggttcgggaccttgggcggtagcaaaggggtcgttgacctgggcagagggatcgggaaggtcgaacagcgacgtgcgagacgcaacgtttgcctgcttcatagacggcagcgacggatcggggaccgaagccagcggagacgaggagggtgtaggcgacggtgccgacgccggatcgggaacattcatctgcggacgcggcgatgcctgggaggaaatctgggccataagggaatcgaccgtttcgtcctgggtgggagcgacattggcaaccgtggcaccggaaccactcggggtcggcatggtgaaaatctgcgtggaataaggcctcgactcatccgtctcgggagtctcggaaaccgcagccacttcctcctgctcgacctcggtcgaatcaccttgatcggctgccacgtattgctcttcgtcagagttggcctcaacggactcgtcctcggcggcatcttggatttcggcagcatcaataggctcgtcatcgtctgccgcgtcgccctgtccatcggaaacaggaaggggctcggcaatcgcggtgccctgcttttcaaacgttatcgtggaatcgaactgcgcggcatcaaacgacatggtgctatcgacgtgctgctgagcctcgaaagatgttgttgcctcaacaacatccgctgacgtcggttgctgagcctcgaaagacattgtagcttcggcggcgtcgacgggcgcggactgcatagcctcgttttgctcgaactcttgcgccgcgtgctcacgtgccgccgcggctgcctgctgctgagcgatagcctcctgctcggcagcctcgcgtgcggcagcgcgcttctcctcgaaatcgtcgacaaatttcttgccctttgcaagcgcacccttaaagaagttggaagcgctggcgccaatcgaagagaacgcggatgcaatatcggcatggggcgttgccgcgggaatctcggccgagaaatcagtatcgctctcgtaagacacgcgcctcggctgttcaacgtaatcgtcgtcagactcgtccgcaacgtcttgcgccggcgcggcgggagccaaaatgtccagtcctgccgcaagatcgatcgcggacaccgcctcggactcggcaacggcagcggtaaccgcggcagactcatcatccgcagtgacaacgggcgcaggctcgggctcaaacgtcggctcctcgccctccttgtaatcgagcgtgcaggactcgggaagcattccgagcgcacggatggcatccgaaccaaagcggatgttgccggcggcgttgcgatagagcttgggctcgggctcggccgcgacaggctcctccaccggctcggcagcggaaacctcgtcattgaactcttcagcctggacagcctgattctgatcctcgggcacgatggcgccaatcagcgtctcgtcggcagacgcaccctcaaagccctcgatctgctcgtcgaaagcctcaccctgttcgggctcggtctgagtgtcgggagcaatcggctgaccgaactcgtcctcggcgtaggtaggctcttcgtactcgatggtgttaccgtagtcgttttgctgctgggccgcggcatactccgccgctgcacgcgccatttcctcggcacgacgcttttgctccccaaaataggtatcgaacggaacatcgtcgggaaactcgttctcgccctggaagggagcaacgttgtccataacaccgagcatagcggcgacagaagacttgttgcacaccgcgccggacgtatagggaagaatgtggcggttagagatgatgtttgccgcgttggcaagtgcaacgagggaagcgaggatcgcgacaatccacagcagaaccttgagcgcgccggggagcggcaggatacgcaggatggcaacggcagcgggggcaaccgtggcaacgggcaacagcttggcgatgagcgcacgatacgaagcataaggctcgcgggcgagcagctcggcacggggagagtcgtagtgtgcgacaacgaccaccgggcggttacgcggggacgcgagcgggcccgaggccttgtggtaggcgatgacattttggctcacgcccgtcttgcccaggcgcgaaaccacgggatgccccgtgcgctcgagcacgtagagcacggcaccgacaatggccagcaaggtgccgaccaagccgataccgccgccgatgcccatcagcagggcgccggcaaacgcaagaataccggtaacggcaaatgccaacctactgggcgccggggcattgaactcctgaacctcggggtcaaagccgtggttgcggaagatctgagcgatatcctcggcagccaagcgctcttcttcgctgcatgccggcgtaatgccggtgttctgcagcaggtggttaatatagttctgggtgttcgccatgtgcgctccacatccataatccgacaaataggcccaatgcatgcacattagaaccgtatatagtcgaaagtataccccgagcgagcgcaaacgaccgaattcggctcatcttaacgccccgagcggacaaggatatagcctaatctccatatcggactaaaatcatggcagcaaaccaccttctcatgcgaggactctatgacggcaagcgacacgaccgcgacaattaaaaaggggaattcggagcccagtttcgataaaacggctcagcgcatcctcaatcttttctttgtgctcaacagctcccccgaaccgctgacgaccgagcagatcgtcttggattccgacctgggatatggctcgggcaacatcgactcggataagcgcaagtttcggcgcgatcgtgacaaactgctcgagcgtggcatcttaatcaaggaggttcgccccgccggcgcgcaggagaccgaggaaagctcgtggacaatcgaccgcgagcacacgtttgctgcaggcggcctcattaccgcagacgacgccgatatcctgctcaacgccatcgaccagacgctagcggccggctcatccacctttaccgcaccgcttgccgatattcgctccaagattgcctatctcaccggtaggacgacggtggacgaaacaccgattcgccgctctcccaccgtcgatgcggtatggagcgcctttgccgagcgatgcgcgctgcgatttttatatcagaacggacgcggcgagcagaaagaacgtaccgtctgcgtctacggcatgttcgagcgcgagggcgtggcgtacttctgcggcctcgacaatgtcaccgacaacatcaggacattccgctgcgaccgtatcgttcgcgcttggcgtccttcgaaggcctacgtcatccccgcggacttcaatctcaacgactatctgttctttgaattcgatttcgccgaccgaccgcccgttgcagccacgttctcgttcgcccctcagacgcagatcgatatgatcaacggcctcacgcgcgggcgaggtgagctcacacacaccgatgcgggatggatctggaccgttgacgtgcgcgaccttgaagccgccgcctcattttgcatggcccacgccatggacggcatgaggcccatggcccccaaatcgctcaagcaggcgtggaaccacctcatagaaaggacggtgcacgagcatgcccgtgcgtaaactcaccagcgagcagagactctcgcgcgccatcgacatcatggaggccctctacgccgccggcgatggcggcatgacacgaaccgagatttgcagtcgctttgacatcacgggggcgtcgctcgacgagattctcgagatcgtctcgacgctcgcggaccgagaatcgggcgcgcgcatcatctgcgaatgccgcggcgagcgcgtggccctcactggtgacgccgggcgcgtgctaccgttgcgcctgagtgccgccgagggcgccgtgctcaaccatgaacttgaatcgttggggatcgagccgcagacggcagctcggattcgacatgcccttctgcccgaagagctcggctataaccagcgcgtctttgacaccgtcaaccacgggtcgcactggcagcagctgagctgcgccattcaggacggtgttcgttgccgcatctcgtatcgctcgatggacgatgcgcggccacgcgagcgtctggtcgaccccttgcgcattacggcaaacggcgaccaaacatacctgattgcctgggacatcgcgatcgatgagcagcgcacctatcgcatggataaaatcgagggactcaccttgacggaagactccgtcgtgcctcacacaccgggcgtcgcatccctccacgattcccttgcccggacgcagcgtagcgcaaagctcttgatgccattcgatatggcggagcatctggactgggccggcatcaccctaatcgagcgcagcggggcagacatggcaacggtaaccgtgcattacggctccgagcgttggctactgagccaggtaatcgcagcgggcggagccatccgcatcttggatgaccccgccctgtcaaagcgtctgtgcgatatggcaaaaaccctcgtctgtccgctttagcgccgccgctcgtgacgtgcgcgccacagttgcagatagtgaccgatctgcgccgattcgatgcgctggtaggagctcgtgggcagcgacgttaagaacttctttccgtagcccttcgtcaccaggcgcgggtcggccagaatcagcacgccgcaatcggtcgacgagcggataaggcggccggccgcctgcttaacctcgagcaccgcctcgggcagcgaatagcgcgcccaagcgcggtcttcgcgcaggttgcgctcgcacgagagcgggtccgtggggctcgagaacggcagcttgggaatgatgacgcaacgcagcgtctcgccgctggcgtcaaacccctcccagaaggccttaagcgcaaaaagcgacgaggtcggctcgttgataaaccggtcgcgcaggcgacgaggagatgagttgcgctgctggcagtcgagctccagacccgcacgggccatcttgggctcaacgcgggcgtacaggtcttccatgtcgtgccgattggtgaacagtgtgagcaccgatccgcccatggcaagatgggcgtcgaccagcacgcgctcgagcgccgtaagatagctctcgcgatcgcgcggatcggggatatcgcccgcaacgactacagccatgttcgaatcgaagtcgtagctcgagtccaagtgcagcgatgaggatgttgaagcaccgatgcgatcgaggccgaccgcatggttaaagtgttcaaagcttttggacaccgtcatagtcgccgaggcaaagatagccgtgtgaacctcgggcagccactcggttgccaaggcctcgccaatgtcgatgcgctctgcggtcatcgactctccgccggcacgcagcctgcgattgacctgcagcgaatacacgtagtgttcatcggtgccatcaatgatgagtttgaggttctcgaccagctcgtgcaggcgacgcgagatatcacccaggtcaacaacaacctcgggcttgtcggcggcgacggcttgcaccagcgcgtcgacgctcttgtcagcctgttccaatgcgtcgatgccagtgtaggccgactgtaagaaatcatgccagtcgtcagattcgcgcagttcggggccaatccatagattggcattgtcataacccccacgggcacggcggccgagctcgcgaacgccatcgaacacgtcggcgattgccatgctcgcgcgcgcaaccgtcgacgtcgccttggcagtaaggcccagatagagcgtagagccctcggaggttgccaaatcacgggaaacctggcttagcgcgccggtgctcgagccacccaggcgctcaaacagaacgcgtgactcgtccgccgacaccacgcgcgcccactggcggcgcgcctcgcgctcgatggaatgggcctcgtcgattacccaatgacgaatcggaggcaaaatcctgccctcggccgcaacgttgcggaacagcagggaatggttggtgaccaccacatcggcatgcgccgcacgacggcgagcgccgtggaccaaacatttatcagggaaaaacgggcagaggcgacgagcacactcgcgcgaggccgtcgtaaagtcggggcggttgacgctgcgccaccgaatgccaagtgagtcgaggtcgccatcggctgattggcagacgtacgccataatgaccgcgaccgccgtgagcgtgtccgccggatcgcgcttggtggtaatctcggcctggccgcggctcatgcgctcaagcttgcgcaggcacggatagtggtcataccccttgagagcgcaaaatgacagaccaccgtccagttgctcggcaagttttggcagctcatggtacatgagctggtcggcgagattgttcgatttggtcgcaataccaaccgtgatgttgttacggcgtgctgcctcggcaaaaggcaccagataggccatcgatttgccgacgcccgtgcccgcctcaattacacgatgagtgcccgtgaccagcgcatcgcggacctcgagcgccatcgcaatctgctcatcacgcggctcgtaggtggggtacatgcgattgaccaggccacctggcgcatagtctgcctcaatctcctcacgactcggcatcttgaggaccggcagttcgtcggcgtccacccgatcgtcggcgcgatcggccttgagaacgtcagcacgagcggcgctgagagagaagatagaaccagggttctgccctgccaagaatgagaagataggacgataggaccaaggcacatccggatgcatgtcggctaggcgcgccatgaggccctggggcaagtcggtgagcgccacgagcaacacgcgccatacgccacacagggcgtcgacgtcggcattggcacggtgtgataccgagtcacagccaaacagatcagccataaaagacagcttgtgcgaggccaggcgcggaagcgcgattcgcgacagcgccagcgaatcgatccaaatatcgctcacgttgacgccgcctttgaccgactcgataaacgagcggtcgaacgtggcgttatgtgcgatcaccgggcaaccaccgacaaaatcggcgagagcggcgacggcctcaacggccgacggggcatctgccacatcggcatttgtaatgctcgtgagctcggtaatctcggcgggaatcagctgcttgggatgcacgaaggtatcgaaacggtcgacgatctcgcggcccgaaagacgggccgccgagatctcgatcagttcattgtcctgcaccgaaagacctgtggtctcggtatcgaggacaatcacatcttcctcgataagaccaaaggactgcgttttggcgcgttcggcaagcgtggcataggagtcgatgacaaactgcggcgttcctgacgaaaccgcgtcctcgattagcatgcaatgcccgctcgacgaaggcccatacggatcaggctgtcacagacctgcgggaacgtcatgtcgtctgtgtggcgaatctcatccggatacagcgacgtatcggtcatgccgggaatggtgttggtctcgaggatgacggggccgtcctcgctcacgataaaatcgctgcgcgagatgcccaggcaaccgagggccttgtgagcagcacaggcaagctcctgagcgcgagcgtaattctcgggtgaaatctgcgccggaatacgatggatgtccgtagggtcgacatacttcacgtccagatcgtagaactcacagtcctcgggcttgcgaatctcgacaatcggcagggcgcgcacgtcgtcctcgccgtacacgccgacggtgatctcggtaccctcgatgcacttctcgaccagcactttgtcgccgtactcaaacgccttggcaattgccgcgggcagctcggagggctcatggaccagggaaatgccatagctggaaccgttgacggccggcttcacaaagctgcgctcgccacaaacctcgacgatatgatcgatatcgacttcatcgcccacctcgagcgcaaggccgggggcaatgggaatgcccgccttggcgtacaggagcttagagacctctttgtcggcaccgcaggcgctagcaagcacgcccgaggccgtgtaggggatacccagggtctccatggcgccctgcatggcaccatcctcgccgccggcaccgtgcatggcgataaacgccacgtcaaagccgccggttgccatggttaccataaagtcatcagcggccgtatcgagcagctccaccgaggtgtagccggcttccttcagtgccaccacaacgttctttcccgaattgagcgagatctcgcgctcagcggaatgaccgcccgccaagaccgctacgtgcatgttctctaggcttttacccggcatgggcagactcctcctctataatttctgcagctgataccatattgtagcgataccctctacgtttccccaaaatcgaaaggcttccatgaatcccaggactaaatctcaggacattcgcgacttgagccaaaacgatattcgcgagctcgtggccgaacttggccagcccgcgttccgcgcgaagcagctcattgaatgggtcttcgagaagaacgtttgttcgtttgacgatatgaccaacattcccaaggctttccgcgagcagcttaaagaggcttttgcctttgacacgcccactgaactcaccaagcaggtttccaaagatggctcgcgcaagtatctgctcgaataccacgacggcgtttccgtcgagactgtcggcatgccccgtcgtaacaagctttccgtctgcgtttccacccaggcaggctgcggcatgggctgtgccttttgcgctaccggtctcaacggcctcaagcgctctctgaccgctcaagagatcgtcgaccaggtacttcatgtatccaacgactttggcgagcgcgccacgagcgttgtcttcatgggccagggcgagccgtttgccaactacgacgaggttctcaaggcgctgcgaatcctcaacgaccccgatggcatcggtatcggcgctcgtcacctcaccgtctctaccagtggcgttattcccggtattcgcaaatttgccgacatccccgagcagttcacgcttgctgtttcactgcattccgccatccagtcgacgcgcaataagctcatgcccggtgttaagaagtacacgctgcttcgccttcacgaagcgcttcagctctacaccgtgaagaccggccgccgtccaacctatgagtatgccatgatcgaaggcgtcaacgatacgaatccggaaatgcaggcgctctgcgacttctgcgagggaacgctgtgccacgttaacctcattcagcttaacgacatcgagggtagcccgctcaagccgtcgccgattcataaggttgaggatcttcagcgtcgccttgagtcccgtggcatcgagacaacgattcgcaactcccgtggtaacgatattgacgccgcttgcggacagctgaagcagcgcttcaaagttcagaagaacgcataggggagtcgcacccaaaacgtttcatgtgaaacatcgaacgaccccggttgcaggatatccaaccggggtcgtttcatttattgaccttaattttgaatcagctgctactggtcccatttttacggccaaaataaggggtccttgtctcgtgaatcagacaaggacccatcacaatatgctaagtaattattaggtacctaatagcctacattttcccattggttgctgacccaaccctgattaatcttgggattcttcgttacctgagcagtacgcattgcaacatcttctgtcataacatccattttcttcttggatgtatcgataatatcttgcgcactacgaagcaaacgacctcgaagttcatcgtctgtcgcgatcttatagccagcaaaggcaccagccgcgacagtcgtcgccaatgcaatcgcagttaaaattctattcctcatcttggcctccttgatcaaactgaatcatttcgccaagaatacgagagagctcttcatcgtctttaaactcaatctcaatcttattctttccacgcgagctcttcacacgcacgttggtattaaaaacctgacgaagcacgcgggctgcctttttaaaagactgaggggttgcaggcctcggcgtcttaggtgtctctccggcagaaaacaacggagcaagattttctgtcgctcttacggaaaggccctctgcaacaaccttctctgcaagtcgaattcgagcatcctcatagggaactgcaagaatcgcacgtgcatgaccagcagtaagtttaccctcaaaaatcatctgctgaactacttcggggagatcgagaagacgcagtgagtttgtaattgcagagcgtgacttgcttactgccttcgacaatgcctcctgggtcataccgctggcatcgatgagctgtcgatagcccttagcctcttcgacgggattcagatctgaacgttgaaggttttcgataagagcaagagccagcatctcttcatcatttacctctttaatgatgactggcaattcttcaaggccagcaagctttgacgcctggtaacgacgctcaccagcgatgatctcatagccgtttccatgcttgcgaaccaaaagcggctgcaaaacgccatgttcttggattgactcgctcaactcgcgaagttcagtttcgttaaagtgaattcgcggctgattagggttgggaacgatatcctcaataggtagttttgtttcagatgcagcattagaagccgatgcagccgaaccgccggtctcatactcggcctctgaaaccaaagcattcagtccacgtcccaatccgccacgtttctttacactaggcacgcttgatcacctcttttgcaaggttcatatatgcttttgcacccttattttgaggtgcataggtaattactggttctccaaaagacggagcttcggagattttaaccgtacgggggattagcgtcttaaacgccttatcaccaaagtacgattgaacctcctcaacaacctgattcgatagtgaagtacgcgagtcatacatggtcataagcacaccataggtgtctaagcccttgttcagtcttgatttgaccatcttcattgactcaagcagcttcgtaacgccctcgagtgcgtaatattcgcactggatcggaatcaaaacgctgtctgctgcggtcaaagcgttgatagtaagcaggccgagcgaaggaggacagtcaatgaaaataaaatcgaactcgtcctgaatcggctcaagcaaatctttgaggcgggtttcacgtgcaattgcgcttacgagctcaatttcggcgcctgcaagctgaattgtagctggaattacgaatacctttttgcaatttgtatcaagaacaagcgattctgccggcacatcattcagcaatgcatcatagatgcagtgatcaaggtcttctttttcaattccgaatccactggtgctgtttccctgcggatcaaaatcaacaatcagtgtcttacgaccctgctcacccagtgctgctgcaaggtttacagccgtcgttgacttaccgacgccgcctttttgattgatgattgcaatgatacgcgtgtcttttgcgctcttagaacgcttaacgtcgcgaaatcccacggtccctcctggtgtgtattaaagctgtcaaacggaggatgtttcacgtgaaacattccgaatcgatagcaactgctatgtttcacgtgaaacactgcaagctgttagtaaccattatgtttcacgtgaaacatctaggcaagcggattcttctttgccatgccatttgcacgaggcaatgaaacggatgctgaatgactcttcttaagaacaatgaactccctgtgacccaagccttcaggcaaatcaattgcgtcattcagaagcaaagtgaagccgcaaatcttagctgctgacatgccggaagcaagctcctcatccgaaggattgcccttggtgataacaaatagccctccatccttcaggtacggagccgcatactcaacaagaatcggtagaggggccagtgcgcgggcggttacaacggagaactgcttcttatggcttcgagcatattcttcaagacgatcatgaaccgcatgagcatgtttcaatccaagagcatggacaaaggaattaaccgcatcaaccttcttgccaacagagtcaatataagtagctttacgatgcgtggttatggttaatggaataccagggaagcccgcacctgttcccatatcgagcaaagctccctcaggagccttattgatataggggagcaaaacaagtgagtcgaggatatgaagtacggcagcatcttctacgttaagaatacgggtgagattggttgtcttatttgtttctagaaccaaatccaaatgctggatacatttcctcagctcaatatcagttacgctcaaggaatattctttgcaataggaagttaggcgactcaacatctcgtcatcctgctgatcggtaagtacaaacaacagaagctcctttctgacaaaaatcagcgtatcgagaacttttgacaaaaaaaggggacgtggaaaccacgtccccctagcataagctcgagtagattatcgagcaacaatcaccacatggcgatcagggtcagaaccctcagaatgagtatcgactgcatcgttgccacgaagtgcaatgtgaaccagtcggcgctcgtaggcattcatgggcggaagcgaaacactcttatgagtgcggatggcacgctcggcagcagactgagccatggaggcgaccttatcctgacggcgactcttgtatccctcgacgtccactacaaccggatacctaaagccaagcttgcggctcaccagcaaagagaacataacctgaagagcatcaagagtgcgaccatgacggccaatgagaacagcaaggtcgggagccgttacatccaaaatcagctcaccctcgtcgccctcatactcatcgataggagagttggcggcatcgaagtgcgaaaggatggaacgcaggatggaaatcgcaacatcggcaatggtgtcgagctcctcatcggtcagctcttcaccagccttgtagcgctgtgcaatctcgggataatcgcccgcgacctgcggggcaacctcctcaagcatatcctcgatgatctcttcagacataacgtactccaaaagttaggtacctaaataagattgatatcccactacttcttcttgtgcgggcgcggcttcttctcgcgacgagtgacctcaacctgcagcggagcgttcttaagacgctcctcctcatcggccttcgccttgtcgatgaccttctgcgtcacaaaaatctgctggataacctgccaagcagacgagacgtcgtagtacagcagaacaccaacgggaaggctccagcccatccaaagcatcatgaccgtcatgacaacggccatcatacgcatgctctgagcctgctggccggtctggttgcgcgacatatagagctgcggaatcagggtcaggacggcaaacaggatcaggcaaaccagcgcaggcagtgcaaccataaagccatcggcaaaggaagcgctcggcgtggtggtcaggtcgggcaggatgttgaagaacgagaacgtgccgttgttaaagtactgcggcaggttgcgcagcaatgtaaacagggcgaacaggataggcatctgaatcagcagcggcagacagccagccatggggttgaacttgttctcgctgtagaacttctgcatctcctcggcctgacgctggggatcgtcggcatagcgctcctggatctcgagcatcttgggctgcagcacctgcatgcgagccgtcgacttggtcgacttgagcataagcggcgtcagcagcagacggatgatgaccaccaggatgatgatggacaggccccagtcgaccgcaaaggtctggatgagcttgagcagctcgaaaaggatgttaacgatccaatcccacatgtaagttttcctccgatagcgagtgcccgctagggcacagggtcataaccgccgacgtgcaggggattgcagcgagcgatgcgcctcacggcaagccagcagcctctcaaaacaccgtgcttctcaatcgcctggatggcgtattgcgagcacgttgggtaataaatgcaggcgtcaggcaataagggcgaaataacctgtttatatatgcgaataggagcgatggcaacacgtcgcaaaacgtgattgctcatcgctcctccccggcaacgccggcgcgcttcataagcgaacgcaacgccttgtccatctcctgcggcgaggaaaccctcgtcttgggagttgcaaacaagatgatgtcataacccgcaacgggaaatccgcagctacgggcggcctcgcgcatcacacgcttagatcggttgcgcacgacggcacaaccgagtcgcttagcaccaacgaaggcgacccttccggagtcgccttcgccaaccgattcacatatggtcattcgaatcagagggtgattgaaacgacgcccctgactgaacacatgctcgaaatcttgccgagacttaatagtcttcatgcgagatgtgtgtatcgctgctagacagtgagacgcttgcggcccttggcgcgacgacgggcgagcacggcacgaccacccttagtggccatacgggcacggaagccatgggtcttggcacgcttacgcttattaggctgatacgtacgcttcatcttaagttcctcctgctgcatttcgagtgtccgcggggacgcggacgcagatatagacacgtgagcttgaagattgtagggaaatcaatgttcaaatgtcaagaaatcaaaggtaaaaggttgcgcagttcacacggttcccccataagccaagctcgatttagcggtgcatggcaacttttcacgatatttcatcgagttttcaacaggtcatgttggcaatgttgagaacttttcgtccgttttccaaagttttcaacaggttttgaaagtttgtcgaaagatgagaaacattgcacggtgagctactatttgttcgaaaccttttggaagattgcgagcggcatgtctgacgacttttacaccatggtcgattccggagacccggcacccgacaacgagcacatcaccggcgtgcgcgaagagcgtgacgaaggtgaacagacgacaacgcaggcgccaaaagccatgtacgccgcgcgcatcgccgtctatgacgacatgctgtcgacaccgcgtgtgatcgtcatcgatccgcaagatgtccgcacgtatttggaagagacgaccaacaccgtctaccagtgcatgaaagaacaaggtggccatatctcgctcatggtcatccgcgagattgtcgaaaactttatccacgcacactttgcagagcccatcatctcgattctggacggcggagacaccatccgctttgctgaccaaggacccggcatcgacgacaaggaacgcgctttcgactttggcgttaccagcgcaaacagcaagatgaagcgctatatccgtggaaccggagcagggtttcccatggtgcaggagtatttggaaaacgccggcggtgccgtatccatcgaggacaacatgggcaacggcaccgtggttacggtaagcctgaaccctaaacgcgtgcaggaaatcgagcgtgccggcggacgcggtgctgccgtgcggcccgagacggagcagcccacatatcccctgccgggagcttttgcgcagcagcccatggcaacgcagcagatgcagccccccgtggggcagatgcagcagcccggaatgcttcccacacaagagccccaggcggcatctatgtcgatgacgccaaacatgccagaggccatgccgctggcagatcaggatgcagcagcaatgcagcaggcgacgggggcaccgggtggccagcaaatgggctatcagccgtaccaacggggatatccatatcagcagatgccgccactggggtatggccagcagttcccgcagcagtaccagcagggatatcagcagccgtaccagcagatgccgcagcagcagtacaacccctgggcccaacagatgcctctgcagccttaccaacagtggcctcaaagttttcaacagcaaatgccgccgatgcagagttctcaacaaccagcagctcaaatgatgtatcctaatgcagcaaatcagtatgcgcagccacaaccggacgtgttcgtaagcgatcgcggcaacgccgcgctgggctatctggcgcaaaatcaagcgtgcggtgcaaccgatctggcgagggcgtttggaaactcggcccccacttggtcacgcacgctcaatgacttggcgcaggccggcttggtcatcaagcatggccagaaataccatctgaccgaactcggcgccgctcgcgtgcgagctcagagctaaagaacgggagagacagtggacgaggaagcaagcatcatcctgggggatgccatcgccttttgccagcgcgacggccaagatgcacgcctcatcaacatgctggggcaatcgcgggccataagcctgaccgaagatacgctcacgatcgaggccccctcgcgctttgccatcgcgcagctcaaaaagcatcagccgactattgaggcctatctggaagaaatcgcctttgcaccgatcgcgctcgacatcgtggcaccgcaaggcgccgcgacggaatccgctgccgccacggcgcccgccacggctcccgctgcttccccggcggtgccggcctccgcaggcgacgcgtcgacggtcgagcaccagcacagcgatgtttcccgtgaaaccatggcaccgttgccgaccgcggcggcgacgccaacgaacgcgcccgtcacgcacatgcccatcgctcacgacgcagcggcgggcgcggattcgggcattgcaatcaaaaacacgctctcggccgacgattttcgtcgcatgatgaaccagatgaagggcggggcgccgactaaatccacgcaagccgcgacccccacctcacccatgccagcaccgaccgtgccggccgagcagaatacggatggagccccgctcgccgcgaactcaaaatttacctttgagaactttgtctacggccccgaaaacagccatgcctatcgctcggcactcaagtttgccgccctcgcggacgagcgcggcacatgcacatcactattcatctacggcaaatcgggcctgggcaagacgcacctgctgcttgccatcaaaaacgagctcgccgagaagtcgcccgagatcaaggtcaagtatgccaactcccaggcatatctggacgacctgatgaccgagttcgaccgtcaaaagaagagcaacgctcccatcatgcaggcgtaccacggcgtggacgtgctcatcatcgatgacatccaaaacatcatcggcaagcgcgcgagcgtggactactttttccagctcatggacgagttcatccgcaacaacaagaaggtcgtcatcgcggcagaccgcgcccccaaggacctaagcatggacgagcgtctgaccagccgcttcaacgccggcatgctctgcctggttgcagagcccagctacgagatgaaatacaagatcttgcagcgctattacgagaacaccatcgtcgccgcccccgaggcaggcgacgactcgctgctggcggcctatgggggcgacggcgggcacctgaccgacgaacactttaaacacatggccgaggtctcgggcaccaacatccgcgaactcgagagcttttgcgagcgctgcgccggcgaggcgggtgaccgcgagcgcgagggcggggagctcacctttgacgatatcgacgccatcgccagccagtacttcgacacatcggccaaaaagatcaacgtccagacggttcagtccgtcatcgaagagcagtacggcgtgacacacgaggagctcatcggcccgcgtcgcaacgccaatatcgccaaagcgcgccatatcgctatctacctggccatcgagatgtgcgaaatgacgaccacggcggtgggcgccgaatttggcaaccgcaaccactcgaccgtcagcacgagctacaaaaaggtccagaagatgatccaggaagaccgcaccgtcaccgaagacctcaagtcactgcgcgataaaattacactgcgctcgtagggaaatagagacacctgttgaaaacttgtcgaaaccacgggcataaggtgtttaaaacccaacccgcggtgatgaaaagttttgcgcaggttttgaacgtggaaaaccacccccgttgcacacaggttgctgtcgattctctttctgggtctgacctgcgtctttgggagtaatcaacagtttcgtcagtgctattactattattaagatatttatatctatagaaaggtattaaaagatgaagttcaccgtcagccagagctcgcttacacaagccatcggcgtcgttatgaagggcgtcgcttcggcatccacccttcccatcctgtcgggcgtgctcgtcaaggcgcaagacggcatcttggaattccagacctctaactacaccatctcgatccgtcatcgcatcgcggcacatgtcgaagaagagggcgagatggttatcccttgtaagatgctctccaatatcaccaagaccctccccgatgccccggtcacctttgagctgtccgagcgccaggtgctgattggttgtgagaagagctctttccgcctgaacacgctcgatgccaatgacttccccgagtttccggcctatgccatcgagagcgccgtggaactgccgaccgatatcttgtccgaaatggtcggccgcgtgtggcgcgtcacctcgactgacaaggcccgccccatcctgggtggcgtgcacatgaaggtcgagaacaacaccgtgcgcctggtggcgaccgattccttccgcttggccgtgtgcgatacgcaggtcgagacctcaaccctcgagggctcctttgaactcaacgttccggccgatgcctttaacgacgcgctgaacatcatggccagccaggcgaccatcatgatcggggctaccgacacccaggtcgtctttgaggccggcaacaccacctacgtgtcgcgccgcatcgagggcgtgtaccccaactacaagcagctcatccccgattcgtgcgtgacgagcgtcaagatcgacgtcgccgcctttaacgccgccctcaagcgcgtggccgttatcgcgagcgccaaccccgccgtcaagttcgagatcgatgtcgagaacgggcagatgggcctgtcctccatttccaatgaccaggaccttgcgcaggagacgatcgatgtcgaggccgagggcgagtcgggcaccatcgccttcaactaccactacatcttcgggtgcctcaatgccctgtccaaggagaaggagatcacgctggagctcaagagctactcgcaggcgggcatcttcaagtcctacgacaagatcaactacctgtacctggtcatgccggtccgcatctagcaactgccctatgaccatgttcgcccgcgatctttccgtcgcgcactaccgcagcttcgatagctatcgccttgccctggacgagggcgtgacgatacttgcgggacccaacgcggcgggaaagaccaatctcatagaggcgctgcaactgctgacgagcggcgcctcgtttaggcatccgaccgccgccgagctcgtccatgacggcgcggactcgtgcaaggttgagctgaggctcgagggcgacggccgcgtgcttgatatgggattgagcgcggaggacggtaagcgctcgtttagccgcaacggcaagagatgctctgccgccggtgtgcgcggggtcctgccgagcgtgctgttttgccccgaccatctggacatggttaagcgaggcgccagtgtgcgccgtgccgccctcgatgactttggcatgcaactgagcgcacgctatgccgatcttgcgagcacctatgggcgctgcgtgacccagcgtaacgccttgctcaaggaggcctggtgctgccgcgagatgctcggcgcgtggaacgattcgattgcccgcgcgggctcggccctgctcgtgcaccggttggccctgctcgaccggctggcgggccatgtgcacactgcctacgggcaagtggcgtccggcgaggccgccaacgtgacctatacgtccacgctgggggatttgccccaggtcgaggatcgcgaagagctgaaggactgggcgtacgagcgcatgctggctgcccttgatgagcacgccgacgaggaaattcgccgcggcgtgacgttggtgggaccgcatcgcgatgagattgagtttgccgtggcgggtcgatccgcccgttcatttgccagccaaggtcagcagcggacgttggttttggcctggaaggtggcggaggtggccgtggctcgcgatgtcctgggcaccgccccactgctgcttttggacgacgtgatgagcgagctcgacggcgagcgtcgcggcgcttttctgcggctgatcggcgatgatatccagacggtcataaccacgaccaacctggggtattttaccgatgacctgcttgatcgagccaaggtggtgagcatgggtgagacgtgctaattacgagcgcgagagcgaaacggtcgccttcagtggatttttaaacgcagagcgccagcgcatcctggcggccgcgacgcctgagcgccgcgtgcagatggaggctgcagaggaatctcgtgcggtctatcgcgcctggaatgcggtgtgctcgggcacgcgcgaggggcgccatgtgacgggcctgcgctacctgcccgagtccaatgagctgctggtatatctcgactcgccctcgtggacgcaggaaatgacgctgttgcgcgagatcatccgcgcgcgcatggagcgcgccggtgcgcatgtggacggcctggtgttcaaaaccaccgcgcccggtcacacgccgcccgccgccaaggagcgcctgcgtccggcgacgaccgagcgcccgccggctccgcacgccgacctaagtgaggccgagcgcaccgagattgagcgccaagtggcgcccatcgaagaccaaaaactgcgcgaggccctcgagaatgccatgagagccagtgccgagtgggccaagggcgtgcaaagcaaaaaagagccttaaatcgcatctggtggccttgtagagccaaataccctcgttcccgagggtatttttttacgataaactagtaaggctgtacacattttcttgactgaaggaggacgtgtggcaaacgaaaacgattacgatggcggcgagattaagattctcgaaggtctcgaggccgttcgtaagcgcccgggcatgtatatcggctcgacgagcgccagcggtctgcatcacctggtgtgggagatcgttgacaactccgtcgacgaggccatggccggtttctgcaccgagatccaggtgacggtccacgccgacaactccatcacggtcgtcgacaacgggcgcggcatccccgtcgacgagcaccctgttaaaaagatcccgacgctcgaggtcgtcatgacgatcttgcacgccggcggtaagttcgataactcggcctataaggtctcgggcggcctgcacggcgttggcatctccgtcgtcaacgcactgtccaagcgcgtggtcgttcaggttcgtcgcgacggcaacacctacgagatggagttctcgcgcggcaagaccgtcaagaagatggaggtcgtgggcacctcggattcgacgggcaccaccgtcaccttctggcccgacgacgagatcttcgagacctgcatctacgatttcgatacgctgcacaaccgtctgcaggagacggcgttcctcaataagaacctcaaaatcgtgctgaccgacgagcgcgaggcgactccccacgtggaggagttttgctacgagggcggcatcatcgacttcgtcaagttcctcaacgagggcaaggacgtccccgaggcctttaaggagcccatctacatcgagggcaaatcggacccggacgcgcctgtgaccaagatgggcgaggtcgaggtttctctgcagtggaatagcggttacggcgagaacgtcatgtcgtttgccaacgacatctacacccccgagggtggcatgcaccttgagggcttccgcaccgcgctcacccgcgtgatcaacgattacgcgcgcaagcagaacctgctcaaggaaaaagacgccaacctgaccggcgacgatgtgcgcgagggcctttcggccgttatctcggtcaagctgcccgatccgcagtttgagggccagaccaaggccaagctcggcagctcctatatgcgcgcgctcacactcaagattgtgaccgacggccttgccgattacctcgaggagcatcccaagcccgctcgcgagatcgtcaagaaggcgcaacaggcctgcaaggcgcgcaatgccgcccgcaaggcgcgcgaggcgacccgccgcaagagcctgctcgagacggcgtccctgcccggtaagctcgccgactgctcggtgcgcgatgccgagctgaccgagctcttcatcgtagagggcgactcggcaggcggttcggccaaggacggccgtcgccgagacatccaggcgattttgcccctgcgcggcaagattttgaacgtcgaacgcgttggtgaccatcgcgcgttctcgagtgacaccatccagtcgctgattaccgcgatcggttgcggcgtcacgacgagtgccggcgacggcggcgacttcgatatcaccaaggcgcgctaccacaagatcatcatcatgaccgatgcagacgtcgacggtgcgcatatccgcatcctgctactgacgttcttctacaagtacatgcgtccgctgatcgatgccggctacgtctatgttgcctgcccgcccatctttggcattaaggtgcgcaacaagattcactacgtgtatcccaacggccgccagcccgaagacgagatcctgcgcgacaccatccagagtctgggcctgaaccccgacgataacgacgaggacggcaaggccaaggacggcaagatcaccaaaaagcgcaagggctataccgtccagcgctacaagggcctgggcgagatggaccccaaacagcttgcctcgacgacgatggacccaaagacccgcattctgcagcgtgtgtcgatcgaggacgccgtggtggcggaccgcgccgtgcgcgagctgatgggttccgaggtcggctatcgccgcgagtacatcgagaagcatgcacatgatgcacgattccttgacgcttaagaggaggtaacgtggcagacgatatcaacaataacgagggtatggacgaggccggcgatgccggtatgcccgatgatctgaagcgcctgcttgcccgtgctgagcagggcgaggacggcgatccggacgcctataaccccgatgccgatgatgatgaggaagaggacgacgacggtgagctcgaggagagctttggcgaagtcgatcgtggcgcctcggccggcgaggacatcaacggcggccagctccagatttcggagttcggtcgcgagatgaagcagtcgttcatcgagtattcgatgtcggttatcacagcgcgtgccctgccggacgtgcgcgacggcttaaagccggtacaccgccgcatcctgtacgcgatgaacgagagcggcatctaccccaaccgcccacacaaaaagtcggcctggacggtcggcgaagttatcggtaagtaccacccgcacggtgactctgcggtctacgaggccatggtccgcctggcgcagtggttctccatgcgcacgccgctcatcgacggtcacggcaacttcggcaacatcgatggcgacggcgccgccgccatgcgttacaccgagagccgcctggcaaagcccgccatggagctactgcgtgacctgcagaaggataccgtcgactggcagcccaactacgacgagtcgctcgccgagcccgtggcgctgcccgcgcgcttccccaacctgctggtcaacggcagccagggcatcgccgtcggcatggccaccaacatcgctccgcacaacctcaccgaggcgatcgaggccacctgctacctgatcgataatcccgatgccaccgtcgacgagctcatgcagatcatgcccggcccggacttccccaccggcgccatcatcatgggcagtgccggcatcaagcagagctacgagaccggacgcggctccatcaccgtgcgtgccaaggctcatgtggagtccaccaagaccggccgcagccgcctggtctttaccgagatcccctacatggtcaacaagggcaccctgcaggagaagatcgcccagctcgtcaacgacaagcgcatcgagggcatctcggacatgcgcgatgagtccaaccagaagggcatccgcctggtcatcgagctcaagaagggtgttatcccgcaggtcgtgctcaacaacctgtacaagtacacctcgctgcagacgacctttggcgccaacaacctggcgctcgtcaacggcgtgcccaaatgcctgagcctgcgcgagatgctgcagcactatatcgaccaccaggtcgacgtcgtcacccgccgcactcgttttgacctcaagaaggcccaggcgcgtgcgcatatcctcgagggctacctgatggccctcgaccatatcgacgaggtcattagcatcatccgctcctcgcagaccgactccgaggccagcagccgcctgatcgagcgctttggctttacgcccgagcagaccacggccatcctcgaaatgaagctgcgccgcctgaccggcctggagcgcgacaagatccaggaagagttggacggcctgcgtcgcgccatcgcctactatgaggatctgctggcgcatgaggagaagatcctgggcgtcatcaaggaggagatgcgcgagatctccaagaagttcggcgacaagcgccgcaccgagatcagtcaggttgagaaggacctggatgtcgaggacctcatcgccgacgaggacatggtcgtgaccatcacccacaccggctacgttaagcgcatcccggtggccgcctaccgtgcccagaagcgcggcggcaagggcgtgtcgggcgtcaacctcaaagaggatgacgttatcgacgagatgtttatcgcgtccacgcacgagtacgtgctgttcttctcgagcaagggcaaggtctatcgcctgaaggtgcacgagctgccggttggcacgcgccaggcgcgcggcaccgcgatcgtcaacctgcttcctttcgaggaaggcgagaagatcgcgagcgtcatcagctgccgcgagttccccgccgacgagtacctgatgtttgccaccaagagcggcatggtcaagaagaccgtgatgagcgcctacgaccgtagtcgccgcgacggcctgatcgccatcaacctgagggacgacgacgcgctgctcgctgtacgtcgcgtgcgcgagggtgacaagattatcatggcaaccaccgcgggcaaggcgattatgttccccgaggaccaggtgcgcgccaccggtcgcgataccagcggcgtccgcggcattggcatgaaggaaggcgtgagcgttctgggcatggaagtcactaacggcaacggcgatctgttcgtcatcaccgagcgcggctacggcaagcgcacgccggtcgcggactacccggagcagaatcgcggcggtcagggcgtctacaccattcaaatgaccgagcgtaagggtaacctcgcggccatgaagacggtgggcccgcagcacgagctgtttatcgtgacggagggcgcgacggtcattcgcgtcaagaccgacgagatcagccagaccggccgcgccacccagggcgtcaagatgatgaccgtcgacgacaacgaccgcatctgcgccgtggcccgcatgacggccgccaaagagaagcccgaaggcgaagccacggaaaacggctccgcccccgaagaaacccctgtcgatctaggcgacggcaacgacatgccagaagatctcctagacgagtaagagactctagctggttaaaattatcagaccccatatatcggcggtcggcgcactgcgcgccgaccgcttttttgaaaaccttgggactcgtgttcgccccggtcgcacggcgacatgtgaagtcgatcgcgagttccgcacgagccagagagcacttaatgtgctctctgtgcgagtcaggactgtccgagtaggcgacttcacatgccgccgtgcgaccggggcgaacacccttcaaagattttcaaaaaaagttgttgacgcgcgcgtaacgactcgtctaatatatcccttgcgcgatggacctgtagctcagttggttagagcgtccggctgataaccgggaggtcacaagttcgaatcttgtcaggtccaccactttctttcgcaataaacaccccagcgagagccgagtcgccgctggggtgtttattactgtctccgtgggggtttagctcagctgggagagcgcgggctttgcaagcctgaggtcaggggttcgatccccctaacctccaccatgatggacctgtagctcagttggttagagcgtccggctgataaccgggaggtcacaagttcgaatcttgtcaggtccaccatcaaaactgtgaagagccctggggcattgcctcggggcttttttcttgtctgcgataaatctcattttggttttgtgtgctgtgcgaaagtttgggtagtatagctattcaatgcggcggactgccgcgtgttaaccgctacgtaccggaggtgttccatggttcgtgtcgacatagagaccatcgtcatggccgccggtcccgtgccatcgcttatcgtgcttcgcgagcgctgcagcaaatcggactcgcccgcgccactgcgttccctttccattcagactggttcgtttgaagccgctgccatcagccgcggcatcgatagcggccgcgccgagcgcccgattacccatgacctgttgctcgatactgttggcgccctgggtgccaagctcgaacgcatcgaaatcgttcgcgccgagccgcccgtgttttacgcgacggttgtcgtgttggccgatggcaacgagcataagatcgatgcgcgtcccagtgatgccattgcccttgccgtgcgcagcaatgcccccatgtttgtggaggacgacatcatgaatcgcctgggcaccgtttctgcccatgccgaggaagttgacgacgagcgggagttcgagaagttcgacgagttcgtccatacgctctcccccgatgacttctaaatgtggggcggccaggctgcggagcgttcgctgatggccggcggtatgtcggctgaggcggcggccattgcgcgcgaggcccagatgcgctcggaggcttctgaggcggcgcgcattgcctatgtgacgcaggcccgcacgcttcgcgaacgccgcggctcgtttatcaagatggttgtcgtctccgcccttgtcgcggcaatctgctcgcgccttcgtggtacagttggtgcgcttgggttttcgatctctacgggcctcgtgatctggggtgtggtcgatgcggtcatgctgaccagtcagatcaaggtgctcgacaagcgcgcgatggatatgatgcgcacccgcgacgctgccgctaagatcgccgccgaggcacaagaactgtaatgacgccagactcgatgggaaggtctaaagatggcacaggatatgcaggacgccggtaacgtctccgccgagctcgacgccatggtgtgcgatctgatcggcgcgttcttggacgaccttgccgccggtgaaaaccctggcgtggtcgtggcaattgaggacgccgcttccaaccgttatctggcggcgctcgacgaggacggcgaagaggcgtgcctcgaggcggccaccaactttatctccgagcacaagatgggtcttaaggacgagggcctgggccgtatcgctcgctatgccatcggctacaccggctgcgtcgagattgacggcggctatcacgatgctctgctcgtgagcttcttcgaaaccacgctcgagagcggtttttcggcatatgtgctgtatgagggcatgggcgccggcgatggttttatgtggagcgaccctgaacctgcaggtgaggaaacccctctcatctaaaatcgctaaaataaacgagttttcggtaaaaggctcaatattcccgccgagcgttgcattgctgggtgggtcgcatacgcgtgccggttgtatatagatagaagataggggaactacatgcgcgtagacaatctgaggaacatcgccatcatcgctcacgtcgaccacggcaagacgacgatggtcgacaagctcctgcgtgccacggacgccttccgtgccaaccagcaggtcgaggaccgcgtcctggattccaacgaccaggagcgcgagcgcggcattacgattctcgccaagaacatctctatcgagtacaaggacgtcaagatcaacgtcatcgacaccccgggccacgccgactttggcggcgaggtcgagcgcgtgctgcgtatggccgacggcgccctgctgctggtcgacgcctttgagggccccatgccccagacccgcttcgtgctgcgtcacgctatcgacaccggccttaagatcatgatcgtcatcaacaagatcgaccgtccgggcgccaaccccgagaaggcctacaacgactgcctggacctcatggccgacctgggcgccaccgacgaccagcttgagttcgccatggagcacgtggtctacgccagcgccatgaacggctttgcccgccttgaccccaacgacggcaacatggacatgtacccgctgctcgacatgatcatcgacgacatgcctgcgcccgaggttgacgagaacgccccgctggccatgcagtgcgtgaccatcgaccactccaacttcgtcggtcgcatcggtatcggccgcgtgtactctggcaccatccaccagggcgaccagattctggtcgtcaagaacgacggctccagcgccaccgctaccgtcaagcagctctttaccttcgactacctgggccgcaccgagtgccaggaagtcggcgccggcgatatcgctgctgtcgtgggtattgaccgcaccgatatcggcgatgtctacaccgatcccgagaaccccgtcgagctcgagcccatcgagatcgacccgccgaccctgtccatcgtctttgaggcttcgacctccccgctcgtcggccgtgacggagacatcgtgggcgcccgtcagcttaaggagcgcctgttcaacgaggccgagaacaacgtgaccatgaagatcgaggagctcgaggacaagagcggcgtcgaggtctcgggccgcggcattctgcacctgtctgttctgatggagtccatgcgccgcgagggctttgagttccaggtcggccgtccccgcgttctgtttaagaaggacgagaacggcaacaagatggagcctgtcgagcaggccgtcgttgagtgcccggacgagtactcgggcaaggtcgttgaggtcttcggtacctccggtggcatcatgacgagcatggatacctcgggtatcgtgacgcacctcgagtttaagatcccgacccgcggcatcatgggccttaagaaccgcatcatgaacgtcacccacggcgagggcgtgttctaccacaccttcctggagtacggtccctacgccggcgagatcggcaaccgtcagaacggcgcaatgatctccatgaccaccgagaaggccgttgcctatgctctgggtacgctgcaggagcgcggccagctttttgttgagccgggcaccgagtgctacgagggcatgatcgtgggcgagcgcagcaaggctggcgacatggtcgtcaacatcgcccgtaccaagaacctgggcaaccagcgttcctcgacctccgatatctccgttcagctggtgccgccccgcaccttctcgctggaggaggcgctggagtacatcgccgacgacgagctggttgagattacccccaagaacatccgcctgcgcaagcgcctgctcaacgccaccgaccgcaagaaggccgccgtccgcgccggccaggtcaacaaataagcgctggactttatagcgtctaacaagaaagggcgtcgaccgtaatggtcggcgccctttttgtgcatagggactgagctggtctgcaccaccacaaaggtgcctggtccctttgtggtggttggtggctaagcggtggggagtcctggcatgttagccggctgctgcggcttgaggtgggcgttgcgccagatgatctggataacgtagccgagcataaagacaaaggctacgccgctgatgaagtcacctacgaggggaagccccgtgagggcgcctgcgattacgccgcccacggctgccatggcgtagcggttttggctgtgtccgaccatgcgggcgatcgcacaccccgcaaaggcactcgacaccaacgcgatgccgataacgccgcacaagagggctccggcaagcgacagaccagcgatagagataatcagcagtaggacggcggggacgatagcaatcgtgctcagaagaccgctcacccacaggggcatggggcgctggtggagcatgccggcggcgctggcggtcgcgcgcggaaagacgagctcgagcagcagggcgacaaagcaggtcgagagtgccgcggcgacgataccgccgatgacatcgttaacggtggaagtatcctcgttctcggtgcgctcgatcttgagcgcgcctacctcggcgcctgcggcacgctcggggtcctcggagacgtgcgcgttcacggtgccggtgatgtgggcgttcttgcccaggatgagcttgtcggcccaaacctcgacatcgccattgaccgtgccgtcgatagtcaccgtgtcgcccgcgagcgctgccgacttgacggaaccgcgcagggcgaccgtctcgcccactgcgtagaagcaactggcagtgctatcggtgttgaggatgatgtgctggccggcaaccgtaacgctgccgtcaaccgtggtcttggcgatatcgatagtgcgtgccgccaagcggacggcgccacccaccgtgcagtcgcggatagagagggtatcgcccgcggcgatgatatcgcggtcgatggacacatcatccaagttgagggcctgaccggcccagtacaggtcaccctcaacgccggacggattggcgtcattgtcggtcgcaagtacgttgcctgcggtgtccgtgccggcgaacgacgccgtgggaagcacggtgatcgccagcgcgatgagcgcgaataggatggtgatgcggccccatgctttacggcgctgggtcaacgggaattgattgcagggcatagtgaatccttcgttagatactcggcatatatctaacagggtacccaacgcgtgggcgctctaaaagaacctctcggttgcatttcgaagggtcgtgccgtgctgtctactttttacggtgcaagaagcgcgcgatatcttcttcggtggggcttttgatgtcaaagcgcagcgagagccagcgcagacccatggtcacgacaacgcatacgaccagcgcggcgacattgctcatgatgccgctcataacgagacacacatagcttgtcgatccggcgatggcggcgatggcataaaagttagtacgttggaaaatacccggaaccacgcccataaagccgtcgcgcagcatgccgccgcccaccgcggtgaaaaagcccatcatgatgcacaccgccggcgcaaagccgtagacaagcgccttgtccgctccggtggcggcgtagatgccgaccgagatgatatcgagcaggggaatgagtttttcgggcttgtcgacgattgccgggaaaatatagatgatggctgccgtggcaatggaaagcggcagcgccatcggctggttgaggatgtagacgttgccgacctggagcgtcatatcgcgcaaaagaccgccgcccagaccgcagaccaccgcgagcgcgaccgcgcccaccaggtcgagcttgtgctcgcgcgcaaccagcacacccgagatcgatgcagcgacaacagcgaacatctcgagccaaaacgggatggcaaccatggcatccgaggcgtgtgcggtaacgatcatagcggcggcaacgggcaagatggggtcctttgagttacgggtttagacaatgcccgtacatagtacatggttggcgggcctggcgaccctattgctcggtaaacggtcgggactggatgcgggcgtaggcaccaaacgtgtacatcagcctccaaagatgtcaaataatgtcggttttggagggtggtgtacatgttttggttggggtgtgctgggaagacgctactcggaaggtgtgtcttcgccctgcgcgctcttccagttgcggataagtgccttgcgcagttcgttttgctttcgctggtactcggcgtccgtgcagcggggcataccgagtgcttcgcgaatgctgttcatggcgcgatgaaaggcaagttgacttgcgaactgtgccgaggtgagcgtaacgattcgatatcccatttggacgagtacggcctctcgttccgcatctgcgcccttgcgctcggtctcgtcgtgaaaaccgcccttatattcgatgccgagttctctgcgctgataagtaacaagagcgtcgattttgagcgatcgggcttttgtgcaatgccagagacgttgagggatttcgagcggtttgttgagttcgatacctcggatgccaacgccgccttcgcttgttgggagcgagagggcgatggacgatgcggtctccatgggcgaggctgagtggtcgtagatgtgtctgagcgcgagtctggcgcgtgtggcgccgggtttgccagggtgccgatcgagtagctcgacaatttcgtccttggaggtggtggctggttgctcggtgtaagggtcagagggattgagccccatgcgatagtcgccgcaaacttcgtaaccatactcgaggtattcgatcctatccatccactcggcagcgagcacgaaggtgaaggcttcgtcggtgataaagatgccgggcgtaagctcgtcaatatggtcgtagggtaggttttggccgagaacgtggcaagtgacaccgttggtgcgaattcgctcgaaagcaaatactacggagatgtcgatagtcttgagcatggtggacggaatgccgcagtcggtaagtgcctgccgaatgcgcgcgatgcgttgctgggtagagaggccccgcacgcctatctggtagtcgcgttgtgcgacggcttgaaccaggttccgcggtgcatgatggacgagccatgccgttttatgcgaaatgagaacaggagtatccattagggacctctcgctttatgccgatatgcagtccttatgtccgttgaagtgaggaaatataccgaatgctggcaaaatggccaatcgtgcgccgagcgcgatatgcaaaggtgtacatcagcctccaaagatgtcgaaaaatgtcgtttttggagggtgatgtacatggttggttgggacgtgcggccaagagaggattcgataacaaaaaagcccccaataccgggagctttctcaatctaaatggcggaggaggagggattcgaaccctcgtgaccttatacaggccaaacggttttcgagaccgccgcattcaaccactctgccacccctccgcgtggggtaaaaacaaagcaggctcgaaggcctgctttggaattaactggcggagagtcagggatttgaaccctggagacgcttttgacgcctacacgatttccaatcgtgctccttcggccactcggacaactctccgttaaatgcgaaagtcagtatacacgaggaatcgcaaagtgcaaacagaaaagttggcattttttaaaacgctcggccgcgcttggcgttgcagtggggtttgaggtgccaaaaaaacggcttccgaccagcgtggttgatcaactcaattgttcaaaaggggtattcataagcgacttggcaatgaatttaaaaatctttgggtggtgctgtggaccgctggtatgcattttgcgaccacagccttgtgcccgttgacctgcggcttggctcagctcgtccccacggcaccgtatcgtgtccacagattcgtcaagcttttggtaagcatttggttggaatgcgcatgaaacgtcgtgcgagtatgggcatatgtggaggtcatgaggttgtagctgcaaattcttgcagcctaggaggttgaaagatattattaccaagtcttttcctgcttcaggcgcaccttcacgacctgaagccacatttgcccagaggaggtgacaatatgaaggcttatgaactgctgttctttgttgacccgtcgctcgaccccgagactcgtctcgctgttatgaagcgtatcgataccacgatcgctgagggcgctggcaaggtcgactccgttgacgagtggggcaagcgcaagctcgcctacgagatcaacgacctcaccgatggtgactacaccctcatcaacttccacgcagatcctacccagatcgccgagcttgatcgcgtcctgcgcatcaccgacgctgtggtccgccacatgatcgtccgtcgcgacgaccaggagtaagactgtcgttttggactgggcttgtgccccaagaggaagtagtgagttatgagcatcaatcgagtgaacatcaccggtaacctcacccgcgatcccgagctgcgcgccaccgccggcggaacccaggttctgtcctttggcgtcgccgtgaacgatcgtcgccgcaacgcgcagactggcgagtgggaggactatcccaactttgtcgactgcaccatgttcggcacccgcgccgaggccgtgagccgtttcctggcaaagggaaacaaggtcgcgatcgagggcaagctgcgctacagctcttgggagcgcgacggccagcgccggagcaaacttgaggtcatcgtcgatgagatcgagtttatgagctcccgtggtggccagggtggctacgatcagggcggttacgcccccgcagctcccgcgcccgcagcacgtcctgccgcaccggtggccacgccgcccgcggtcgacgtctacgatgaggacatcccgttctaagggttgttcacctatttttgagtgagaggcggcttcggttcgccgaagttgccaaatgaaaggtattttgacatggctaatgatttttctgcacgtcagccgcgtcgtaagtactgccagttctgcaaggagaacactgagttcattgactataaggacactcagcttctccgtaagtacatgaccgaccgtggcaagatcaagccccgtcgcgtcactggcgcttgcacgcagcatcagcatgacatcgccaacgccatcaagcgcgcccgcgagatggctctcctgccgtacaccgtccccgtggtttcctctcgtggcaaccgcgaccgcggctaagaagggagacgcatcatgaaggttattcttctcgatgagatcaagggcaagggcggcgagggtgacgtcgtagaggtcgctcagggttacgctgagaacttcctgttccccaagaagctcgctgttgccgccaccaagggcaacctcaagcagcttgacgagcgtcgcaacaacatcgccaagcgcgaggccgtccgtctggctaccgccaacgagaccaaggctgccttcgagggcaagacggtcaccgttgacgtcaaggtcggcgacgagggcatcctctttggctccgttaccgccgctatgatcgctgatgccatcaaggctcagctcggtatggacatcgaccgcaagcgcgtcgagctcggtaagcccatcaaggttgccggtgcccacaccgttgccatctcgctgtaccgcgagatcaaggccgaggttgtcgttctcgtcggcgttaccgccgaggagctcgctgccgaggctgaggtcgaggaggccgctgaggtcgccgaggccgagaccgccgaggtcgagactgaggctgctgccgagtagcatttgctgcaacgcaacaatcttgttctaagaagggcgctctgggaaaccagggcgccctttttgctttttagcgcgatgcgagcgccatagagggcgttgcggtgaggtctattcgtgggaccgttcatccgtttggttcggtgatgattggccgcgcgcggcgcgttttgggaccgtggctgatactatggatgctcgcaagcgatatgaatgaggatgctcatggcatatgacgatagggagatcgggctgacggtcgaggaccgcggctcaaagttgggtcttccccaaaaccaagatgcagaggccaatgtactggccgctatgctgctatcgcccgaggtggtcgaagaggcccaggtcgagctgcagcccgatgacttctaccggcccattcataagaccatctatactgcgatggtcgatatgtacaacagccgcattcccatcgactccatctcgctgatcgattacctgcgcagcatcaacaagctcgatgccgtgggcggcgaggcgtacattttggagttgatgggtcagaccctgtcgctcgtcaactggcagcaccatgccgccatcgttcgccgcgactcgatgctgcgcgagctgatcggcgccactaacgagatcaacgcgctggcatataacgcccccaccgacaccaaagaggttgtcgagctggccgagagcaagctgctcaaggttacggcgcgcgaggtcaagtcgagctacaagacgttgaccgagtttatggtcgaggcctataacgaggccgaggaagtgtgccaggccggtggccaggctgcgggcgtgcccacgggctttccgtcactcgaccgcatgctcatgggttttcgcgagggccagctcatcatcatcggcgcccgtcctgctgtaggtaagacgtcgttcgctctgaacctggcgctcaacgctgccgctgctggttataccgtcggcttcttctcgctggagatgtcgggcaaggaaattgcccagcgtctgatttgcgcctacgccatgatctcgatcagtgacttccgcatgggccgcattagccccgagcagtgggccaatatcaacgaggccacgcagaccttgtctaagctcgatattctgattgacgatacgcccggcaccacagtgaccgagattcgcgccaagagccgccgtatgctccataacaaggagaaggcaattatcatcctggactacctgcagctggtgagtcctccgccgggccgtcgttccgagagccgtaccgtcgaggtttcggagatgtcgcgtggtctgaagatcatggccaaggagctcaagatcccgctcatcgcgctgtcgcagctctcgcgtcaggtcgaatcccgtaccggcaagcgcccgcagctttccgaccttcgtgaatcgggctccatcgagcaggacgccgatatcgttatgttcttggaccgctccgccgacgaggccgaagcctcgcgtgacgatcgacccgacgagggcgttacgcgtatcgtcgtggccaagaaccgttcgggcccgatcggcgacgtcgacctgatgttcctgccggcatccaccaagttctatgagcttgatggggcacatgccgaggagtaggacaggcgcccgttgcacgggtatactgggaatgttttgtgcttctgcgtgccggcgtggcgcgtagacagtccatgaatgtaaggagtaaacatgccgtcaaccgttttggtcggtgcccagtggggcgatgagggcaagggtaagatttgcgacctggtcgccggcgacttcgatgccgtcgtgcgctactcgggcggcaacaacgccggtcacaccatcgtcgtcaacggcaagaagtacggcctgcaccaggtgccctccggcatcatgtattccgaccacgtgtcggtgatcggtaacggctgcgtcgtcaaccccaaggttgtccttgaggagatcgatatgttcgaggccgacggcatcaccaccaagaacctcaagattagcggcaacgcgcatgtcatcatgccgtaccacatcgatctggatggcgcctttgagcagaagctcggcaagaagaacatcggtaccaccaagcgcggcatcggtccgtgctatcaggacaagatggctcgcatcggcctgcgcatgcaggacatgctggacgaggcactgttccgcgacaagctggagaccgctctcgcccgcgtgaaccccgagctcgagctcatctacaacctgcccacctacaccgtggaccagatttgcgacgagtacctgccgatggccgagcgcctgcgtccctacatcaccgagacgagcctgctgctcaacaacatgatcgacgagggcaaggacctgctgtttgagggcgcccaggcgacgctgctcgacatcgaccacggcacctatccgtacgtgacgtcctccaactgcaccgccggcggtgccatcaccggatccggcgtcggtatgaagaatgtcgaccgcgtgctgggcgtcatgaaggcctatatcacccgcgtcggttcgggccccatgcccaccgagctttcctatgagtccgaggccggtcacacgctgaccgaggagggctacgagtacggcgtgaccaccggtcgccgtcgtcgctgcggctggttcgacggccccatcgccaactacgcctcgcgcgtcaacggcctcaccgatatcgccatgaccaagctcgacgtgctttcggctttcgacaccatcaaggtgtgcgtggcctacgacgtcgatggcgagcgctataccagcgtgcccgagcatcaggttcgctttgagcacgccaagcccatctacgaggagcttcctggctggaagtgcgatatcaccggctgccgcagctttgaggagctgccgcaggaggctcaggactacgtggcgtttatcgaggatctggcacacacccgcgtgacgttcattggcgttggcgctggtcgcgagcagatcatcaaccgattctggaagtaatcgggactatttggttattgcgatatacccctttgcagcccggacgggcggccgaggggtatatttgcttgcaaagggctcgcgcggagcgggccattcatccatagaggaggcacccttgaaggcggacactcaaaccatcgacatcctgttgttgggcagcggcggccgtgagcatgctttggcagctaagctcgcagcatcaccgcgcgccggcaagctctacatcgcgccgggcaacggcggcaccgcgagctgcggcgagaacgttgttctcgacgactgcgatcctgcggccgtggcggcgtttgcgcagagccacggatgcggactcgtggtaattggccccgaggctccgcttgtggcgggcgtggccgacgccgtgcgcgcggcgggtattccctgctttggcccgggtgccgagggtgcccagatggagggctccaagctgttctccaagcagctcatggagcgcgccggtattccgacggcagcctatggttcgtttaccgacgaggcttcggctctcgcctacgtacgcgagcagggcgccccgctggtcgtgaaggctgacggccttgccgccggcaagggcgttatcgtggcgaccgaacttgagcaggccgaggaagccgtgcgcgagtgctttggcggcacctttggcgatgccggcaacaccgtggtcatcgaggagatgctgaccggccccgagtgctcgctgctggcctttaccgacggcaagaccgtgcgccccatggctacctcgcaggaccacaagcgcgcgcttgagggcgaccttggtcccaacaccggcggcatgggcgtctacagcccggtgcccatcgtgactgacgaggagcacgccaccatggtggcggtcatggagcagaccgtggccgagctcgctgccgagggtatcgactaccgcggctgcctgtacggcggctttatgctcacccccgccggtcccaaggtgctggagttcaatgcccgctttggcgaccccgagacgcaggtcgtgctgccgcgccttaagaacgacctggtcgaggtcatgctggcttgtgccaactgcgagctcgatcagattgagctcgactggcgtgacgagtgggccgtggccgttgtcctgacgagcgcgggctaccccggcagctacgagaaaggaaaggtcatcaccggtattgaggatgccgaggccatggagaacgtgaccgtgtaccatgcgggaactgccgtggtggacggtcagctcgtgaccaatggcggccgcgtgcttgccgtgaccgctctgggcgacacgttcgagaacgctcgcaaccttgcctacgaggcctgcgagaagattgattttgagggcaagaccctgcgtcacgacatcggcctgcgcgcgctgcgcggccgcgacgcctgggatgcctaaaatccgagaggaatgagacggatggacgagaagaacgaagagctcgtggacgcgcagatcgtcgaagaggacagccgcgtgtatgggcacgccgagggcgagcctggtggcgaggtcgctgacgagccggcgctggtgctgggcgatgacgacccgcacgatgccgagctgcacgagaagattctttcggaggagtgcgcctggaagggcaagatcctcgacgtccaccgtcttgaggttgagctgcccaacggtcgccgtagcgcccgcgatatcgttcgccatccgggtgcggcggctgttgtggcactgaccgagagcggcaagatcgtactggtgcgccagtaccgcaccgccatcgaccgcgtgacggtcgagattcccgccggcaagctcgatccaggcgaggacccgctcgattgcgccaagcgcgagctgcatgaggagacgggctttagggccggtcgcattcgctttttgacgtcgattgtcacgtcctgcggcttctgcgacgagatcattcacatctacctggccaccaagctcgagttcgatgcacccaaccccgatgatgacgagtttgtcaacgtggacctcgtgccgctgcacgagctgatcgacgccgtgctcgacggcaagatcgaagacgccaagaccgtcgtgggcgccttggcctgcgatagcatcgcgcaccgcttgggtggggccgagctgtaacgagcgggaatagccctgggacaagaactactgattactttgtcccagggccttatgttgctgatatttctttgaggatcacatgtttaagaggtttctttcgtattacgagccccagatggggctttttgttgctgatactgtttgtgctctggtgcttgccgccattgacctggcgttccccattatcctgcgcaatttgaccggtgggctgtttactcagggtcaggctgctattatgcaggcgctcggcatgatcgcggtgggcttggtgctgatgtatgccgtccgctgcgcctgccgctattttgtgagctattggggtcacgtgatgggcgcgcgtatggagtccaaaatgcgcgaggacctgtttgaccagtatgagcgctttagctttgcatacttcgaccgcaacagctcgggcgacatgatgagccgcgtggtcaacgacctgttcgatatctgcgaggcggcgcaccacgtgcccgagtggatcatcatctgcggcatcgagatcatcggctcgtttgtgatcctctttaccattgccccggtgctggcgctcgccatggccgtggtgacggcggcgtttgcggtcatcatgttttggcagaacatgcgtatgcgcgaggtttttagcgacaaccgcaaaaagatcagcggcatcaatgcgcagctgcaggattcgcttgcgggcatgcgcgtagtcaagagctttgccaacgaggagaccgagcgcgccaagttccgtgcctctaacgatcgctacctttcgtccaaggagaacatgtatcacgccatgggcgtctataccgcgacgtatggcctgctctcgggtgtgctctatgtgatcgtggtgctgctgggcggctggctggtcgcccagggacagctgcaggcggtcgatatggcgacctttgcactctatatttcgctgttctgcacgccgctcgagacgctcgtcaattcggccgaaacgtatcagaaggctatcgccggctttaaacgtatggacgaggtgctctcgaccgcgccggatatccaggacaagccgggcgctacggatctgcaggtgactgccggcgccgtggagtatcacgacgtgtgctttaactacgaggatgtcgagctgggcgagggctatgccgacgagcgtcccgttatcgaccatatgaatctgtccatcaagcccgggcagaccatcgcgctggttggcccttcgggcggtggcaagtccacgacctgttcgctgctgccgcgcttttatgacgtggctgccggatccattagcatcgacggccaggacgtgcgcgatgtgacgcagcagagcctgcgccgcgccatcggcctggtgcagcaggatgtctatctatttgacggtacgattggcgagaacatcgcctacggcaagccgggcgccacggcagaagagatcgccgaggccgcccgtcgcgccaacatcgatgcctttatcgagtcgcttccgcagggctacgacaccgtggtgggcgagcgcggcagccgtctttcgggcggacagaagcagcgcgttgccatcgcgcgcgtgtttctcaagaaccccaagatcctgattttggacgaggcgacgagtgctttggataacgagagcgaggaggcggtgcaggagtcactcgaagagctggcacgcggccgcaccacgattattatcgcccaccgtctttcgaccattaagcatgccgatgagattgcgaccgttgagcatggtcgcgttgtggagcgtggcacgcacgaggagcttctcgcccgtggcggcacctatgcccgttactatcgaatgcagttcgaaggtgcgcgtgcgcacgagctcgactgattgatatgacaggaagtttatggctgacaagaaccctttgactccggaagaagtgacggagttattctccgaaatcgatgcatccggcgtcttggatcccacgctcgccaaaaagcgtaccgagcgcatgcgtgagaaggaggctgcggccaagcgcggtgacaaagcggcgctagcacagctgcgcagcgaggaccgcgcgagccaggcaaaacatatcgacccgctgtccgaggacgatccttcgggctcgcaggtgagccataccattacgaagaccgcgatggccgtggtcatcggtattttggtgctgatcgtgggcatgcagatcggctacggcgtgatgcgccgtctgaataccgccaacctgtccgagagcgtttcggttgataccgtttctacagcactcaagggtggactcgagtggggcaacggctttacgcagttcccgctcgactttaccgtcgatgaagccgatgagcgtacgggcacggtcgaggtgacggtgttggacacatcgtctgccaacgagctcgagctgctgtccaacgggcagatccaggccgcggcgcttgcgaccaacgcgctgctcaacgacaagatcgaccgcgtggtgtataacgttcacgcctatatcgacgaggatagcaacattcagcacgattccttctttggcatgttccccgcgcggggccaccagagcgccattttgacgttcgtgtggaccaagagctcatccaacgccacgagtatcgactggaagatgcgcatcgtgagtatggatgacaccatcgccgagcgcattcagaagcaggtgaactcggtgtcgtcgttgattgaggacccggtggtgagccagaccaagattgacgaggaaaaggccgagcgtgacctggaacatcgtctgcatggccgcgagattttccgcggcggcaagcccgatcgcacaccgtccgaactgctggagcaggacaagagaaagtaagacgtcatcatcccgcgtgagccacaagcctcgcgggatgatttttctgggacggggattaaaaaatcattctgtcatgtatgcagttggcgacaaagctctgctctcagaatgattttttaatccccgtcccagaaaaatcattatgcatagaaagtcataattatcatttcgtaaacatttcgatgaaattaacgccatgaggcatgcttgcggttacaataccgcgaggcctaactacacacctttaagccggtcctgtgagaccgggaaggagaattatggcgaacaaccataccgcgggcgctgccgcccgcaccttcgcgcccagcgagctttgccagcgcatgctggccaaaaccagcaagggcacctgcggtccctgcatcctgtatcttgaggatgggaccattttttatggacgtgcatgcggcgccgagggcaccgcgaccggcgaagtctgcttcaacacctcgctcgagggctactttgaggtcatgaccgacccgagttatgccggccaaatcgtaaccatgacctatccgcagatcggcaactacggtatcgacgagaccgacgtccagtcggccttccccggcgacgccgtgcgccctgcgagcgctccggctatgcgcggcatgatcgttcgcgacatgtgcgccacgccttctaactggcgctcggccgtcagcgtgccggagtacctgcgtgcacacggcatcgtcgctatcgagggcgtcgacacccgcgccctggtgcgccacctgcgcgacaacggctccaagatgggcattatctcgaccgagatcttcgatgtcgacgagcttgccgagcgtctggccgcagcgcccgcgctggtaggcgagaacctggtcaagaccgtaagttgccccgcgcctcacgagtttgccgccgtcgacctgcctgccacgcatgactttgcgctttcgactgccgctcctgcccgtcacaaagtggtcgcctacgactgcggtgtgaagcgcggcattctggaggggctggtccgcgccggctgcgaccttaccgtcgtgccgtgggacacgcccgcgagtgaggtgctcgacatgaatcccgacggcgtctttttgtccaatggccccggcgaccccgacgccgtggtggagacctacgagcaggtgcagcagctgatcggcaaggtgccggtctttggcatttgcctgggccatcagatgatcagcctggcctgcggcgcccagatggaaaagcttaaattcggtcaccgcggtggcaaccagccggtcatgaacctggtaagccgtcgcgtggagattaccgcgcaaaaccatggctttggcctgctgttccccagcctgggcaagcttgtccccgagctttccggcggcgagaccgagcatgcggccgatggagatctgcgcgtctgggtgcgccgcggaatcgcgccggtcgtgatgaacgagcgctttggccgcattcgcctaacacatgtgaacctcaacgacggcaccgccgagggtatccagctgctcgacgccccgtgcttctcggtccagtaccaccccgaggcctcgcctggccccaccgatgcccactatctctttaccgcctttacgcgactcatggacggcgaggagaactacctggacatcgacaccgcgaaggaccgccttgccggctggaactttgctgagtccgagaccgctgagaccgaggagaactaatatgcctaaacgtactgacatcaagcgcatcctcgtcattggttcgggccccatcgttatcggccaggcctgcgagttcgactactccggcgcccaggcctgcaaggtgctcaaggaggatggctttgaggtcatcctggtcaactccaacccggcgaccatcatgaccgacccgggtcttgccgatcgtacctatgtcgagcccatcaccgccgagtttatcgagcgcgtaatcaagaaagagcgcccggacgcgctgctgcccacgctgggcggccagaccggtctgaacgccgccgtcgagctggcgaaagacggtacgctcgacaagtacggcgtcgagatgatcggctgtgaccttgccgccatcgagcgcggcgaggaccgcaagctctttaacgaggccatggccgagatcggcctggaggtcgcgcgctcgggctatgcctacagcgtggccgacgccgaggccatcgccgagcgcgtgggctatccctgcgtgctgcgtccgagctttaccctcggtggcgccggcggcggcatcgcgcatacccacgaggagctcgtctccatcgtgagccagggccttgaactctcgcccgcccacgaggtgctggtcgaggagtccatcgagggctggaaagagtatgagatggaggtcatgcgtgaccacgccggcaacggcatcatcgtgtgctccatcgagaacctcgaccccatgggtgtgcataccggcgactccatcaccgtggcgccggcgcagacgctctccgaccttgagtatcagcgcatgcgcgtggcctcgctcgccatcttggagaagatcggtgtcgagaccggtggttccaacgtacagtttgccgtgaaccccaacaccggccgcctgatcgtcatcgagatgaacccgcgcgtgagccgctcgtccgccctcgcttccaaggccacaggtttccccatcgccaaggctgccgcgcgcctggccgtgggctatacgctcgacgagatcgttaacgacatcaccaaggctacgcccgcctgttttgagcccacaatcgactactgtgtggtcaaggtgccgcgctttgccttcgagaagttcaagggtaccgaccccacgctcaccacgcgcatgaaggccgtgggcgagatcatggcgattggccgcacctttgaggaggccttcggcaaagccatgcgctcgctggaggacggtcaccagggtatctgcgccggtggcaaggagggtgccgataagctgagcgacgatgagctcgctcaagccgtggccacgccgaccgagcaccgcatcttctttgtggtcgaggccctgcgccgtggctgggacatcgctcgcatccatgccatctgcggcatcgacccgtggtacctcaaccgcatcaacgacatggtgcaggttcaggagagcatccgcggcctgcgtgtggaggatatcgacgccgacgcgatgcgcctgctcaagcagtacggcacgagcgatgccgagatcgctgcgctgaccggctcggacgagcgctttgtgcgcgcctatcgcaagggtctgggcgtggttcccagcatgaagacggtcgatacctgcgctgcggagttctcgagcgccacggagtaccactacaagacgtacgagaacatctaccgcacgagcccggatgccaagaagtgcgtggctcccgacgagaccacgccggcggacaagcccaaggcgatgatcctgggcgccggccccaaccgcattggccagggtatcgagttcgattactgctgcgtgcacgcgagctatgcgctggcggcccgcggcttcgagaccatcatggtcaactgcaatcccgagaccgtttcgaccgactacgacacgtccgaccgtctgtactttgagccgctcacctacgaggacgtcatggatgtcatcgatgttgagcgacccgacggcgtcgtggtgacgctcggcggccagactccgcttaagctggcgcgcatgctcgaggagagcggcgtgaacatcatgggcaccaagcccgatgccatcgactttgccgaggaccgcgagcgctttgccgccctgctcgacaagctgggcattatgtatccgccggcgggccaggcaacctcgtttgaggaggccgaggccgtggccgcgcatattggctacccgctgctggtgcgtccgagctacgtgctgggcggccgcggcatgatgatcgcctacgatgccgagcatctgcgcgattacatggccgaggctgcgcgcattagccccgactacccggtgtatctggaccgcttcttggagggcgcgatcgagtccgatgtcgacgccctgtgcgatggcgaagaggtctacatcggcggcattctggagcatatcgaggaggccggtattcactccggcgactctgcgacctgcattccgccgttcagctttagcgagagcctgcaggcaaagcttcgcgagactacgcgccgcatcgcgatggcgctgggcgtacgcggcctggtcaacgtgcagtacgccattaagggcgagaccgtctatgtgatcgaggccaacccgcgtgccagccgtaccgtgccgtttatctccaaggccaccggcgtgccgctggccaagtgcgcggcgcgtatcatggcaggcgattccatcgcgagcctgggcctgccgagcgacgagcgtcagctggactggttctgcatgaaggaagccgttatgccctggggccgtttcccgggcgccgacgttatcctggggcccgagatgaagtctacgggcgaggtcatgggtatcgccaagagctatcccgaggcatatgccaagacgcagctggcgattgactacaagctgcccgacccgagcgccggcaaggtgttcattagcgtgtgcgaccgcgacaagcgtcatatcctttcggtcgcgcgtatcctgcgttacctgggctttgacatctgctccaccgagggcacggcgcgcgtgctgcgcggcggcaacgtgacctgcgaggttgtggagaagatcagcggcccgcacgacggcgagcgtcccaacatcggcgacctcatcgccgatggcaagattgcggtgatcatcaatacgccatacggcccgggctcgcgtggcgacggttatctgctgcgcaccgaggccgtgcgccgcggcgtgacctgcgtgaccgcgatgtctgccgccaacacgtacgtgagtgccatcgaggccgtgcgcgaggaccagcagggtcacggcagcgccaacgacatgggcatggacgtcatcgccctgcaggacctgccgcagcacacggtgtggggtgacctgtccggccggggcgggggccgagtttcccccttcgctccggctgcaagcagagtcgctcagtgggaaactcggctcccccgccccggcctgcggtgacttggttgtgccgtgtgctgcagaaggggctttgtgcgtccggtggcaatcagggttccggcaacggtgggcagacatccggcggttcgaacgatggcgcccaggcgggaaagcccgctggtgacaaggctcagggtggcaagtccgctaactcacttgcgagcaccggtgatcaaacggtggcgaccgtcgccgcgatcggcggcctgggtgccgcgatcgccgcaatcggagtcttccttgctcgtttccgccgcaaggaagactagcgcgagcgattgacaatcgcacacgtttcccaagagggccgcggtaaccgtcgcggccctcactttaccggagcggtctgaggactcgcgtctttcgcttcggactgctgcgcagggtcaatcaggcggagatctcacccgtgtcgggtttgcgatagcttggcgaatataattacgcgaaatctaggatttctcaaaaacgcgaagtagatgatatattgtacttcgcgtttttcagttaatcttaattttgcgaagtggattgccatgagacttattaatcgaccgttctatatggataagctctccaaggtggcgggttcgccagacatcaaggtgattaccggaatcaggcgatgcggaaaatcgaaattgcttgaggcgtttgccagccaacttcgttcaaacgacccctcggccaacgtcatacacgtcaacttcaatctacttgagttcgagccgttggcggaataccatgcgctgcatacatatgtggaaaagcattatatcgagggttgccggaatatcgtcatgatcgacgaggtccagatgtgtgaagggttcgagcgggctatcaacagtcttcatgcgtcagagaaatatgacatttacatcacggggtcgaatgcctttcttctctcaagcgacctctcgacgttgttcacgggaagaacggtggagatcgaggtctttccgttttcacttgcggagttctcggcgtatcacgagatcacttctccagccgaggcccttgctcgctatgtccgcgagggaggaatgccgggttcctatatctaccaggacgaaaggatgcgtttctcatacatctcggatgtgcttgaaactcttatcctgcgcgacatcagacaaaaatatcgtatacgtaatgcggagcagcttaaacgttcctgcgagttcctgatggataacgtcggaaacatctcttctctcaaggggatggcggctgagctgtcacgagcgaaccttaagataagcgacaagacgctggctgtgtatatcgactacctgtgtgatgcgtttgcgttctaccggtttcgtcgctttgacgtctcaggaaagaaatacctgtcgacgggagataaatactacctggccgaccactcgtttcgctacgccgcgcttggtacgaaaaagctcgattttggccatgtttacgagaatatggtggcaatcgagcttatgcgccgcggatgggaagtctacgtgggcgttctctaccaaaaggaagtagactttgtcgccatcaggcgtgaccgccgtgtctatatccaggtgagtgacgacatttcccaagaagcgacgcttgagcgtgagcttgatccgctgcgacggattcgagacgcctatcccaagtgcgtcatcgcccgaacagggcacgaaacgactgattgggatggcatcaaggtcgtcgacctggcacgatggcttatgggtgaatcaggcgagctggccgtctagcacgcgatgacgcgggctggaacgaacgagcgaggattccgtcccgcgaggaggccaatacggccctcttcgagggacggaatcctcgctcgatctcttggcgggacattttgctcggtcgatgatcaacggttggtggaaagcgatgcctcgtccgtgccactattccgtgattgctggtattttctgcatgctaaaatgaatgcataaaagactttatatttggaggtctcgatgcctgctttaaagatgctcgacaatcttgttcccatcagcgatttcagtcacggtaagggtcccgctgcgttttcgagagtgagcaacgacaacccggttgtagttttgaaacacaacaagccggcgttcgttatcgtgacgcccgatgaataccgagaggctaagcaggcggaggaggacctcgccttgttgacgttggcccttaagaggacggctgcgacaagcgatgatgaactcgtttccctatctgatgttatggcagagttgggtgtgggccaggacgaactcgatcagatggatgaggtcgagtttgaatgagcgggtacgaagtcgctttctacccggatactctcaaggatctcaagcgtctcgatggttcccagcgaaaacacgtgtttaaggctatagaaagaatcagaacgaacccattgccgcagaacgaaggcggattcggcaagcctcttggaaacaaggcaggcacggatttgacgggcttcatgaaaatcaagctcaggggaagtggcattcggattgtgtaccgcctcattaaaatcaaaggaaaaatggccatcgtagtggtaggcgctcgtgaagacatggaagcgtaccgaaccgcccaaaggcgtgcgattgatttcgagaagtgggcggaagaggctctctaacttcatgggcgaaaacaggaatgcagcgatgtgcttcaggtgtgcgagttttgaaaggctctggtgattcggaggtccgccagagcctttttctatctgtggacattcctcttggacagttagttcagatacgtatttttcagaggacgtgtggaggccaatttgggcacaattgagctatttttgatagtctggaccgacaaggccgcgcgggcaatagcgagaaagacctattattagatctaaagcgacttaaaaccagtttgttagcgccaattagcaccgccaaaatatacgtatctgaactaactgtccaccaccctccaacaacctcctatttcaaatcaaatcagccaccgtgcgtcatggatattcccggtgggtcgcggggtggcggctacgactttccctcaggataattcgcgaagcccgttttccgaggaaaggtattggttatgtaataccagttaaacagtaaaactatgcttaagtggtatctggctggagaaccaattggtatggttgattagacccacttcgccatctacgttcatttttataccgctgggagaattccaaacttaatttgcgcaactgctcacgtatactggtccaaccttataggtggctatctggttactaccagttgaccccttggtaacgggtgggccaattgtacggaatgtaccgaacacccccccccgtttgatgcgttcgcccatgctgcggggcgcgcgtccgcgacacttccgcatgtcggagggaaggagtccaggtgcgtaggaattccatttttacgaaacggtgggtgaagggaagcgcggtcctcgttgccactgcagcgacgcttgtgtttgccaatccccagcaggcgattgccacgccactcaagggtgtcgactcagcgaccgtgtctcagtctgcctcgaacgtcgtcgacatcgatttcgctgacggcatcaagggccgtattacgttcctcgaggacggtattttccgttataacgtcgaccccaagggtgagttttccgagtacgccacgccgcgcagtaagtcccacacggctaagatccaggctcagcccgatacctcggacacctacagcaagccgagtgcgacggttgccgacaagggcgacactatcgagatcaccggcggaaaggcgaccgtgatcctggacaaggcgactggcaagatgagtatcaagtcaggcgaccgtggcgtggtttctgagtctgcgcccctcgaccttgataagaagggtaccgtccagacgctcgccaaggagaagtccgagaacttctttggcggcggcacccagaacggccgcttcctgcacaccaaccagaccatcgccatctccaacactaacaactggaccgatggcggcgttgcctcgcccaacccgttctattggacgagcgacggctacggcgtgctccgaaacacgtttgcagagggttcctacgacttcggttccacggactcatcgacggtcacgactttgcacagcgagaatgagtttgatgcctattacttcgtggcgaccaacgagggcgcctcgaacgtggcaaccgagatgctgcaggactactacaaggtgaccggcaatccggtgctgctgcccgagtacggtttctacctgggtcatcttaatgcctataaccgtgatggctggtcaacgacctcgggtcaaaagaagtgggagaccaagggcagcaagtcctcgagtgagaagggcgacgttaaatacgagtccggcatgtcgacgggctacaagctcgacggcacgcttgcggccgagacgctcaacggtgagggccctacggttgataccgagaacatgaaggcgaccgatttcgaccgccagttctccgcccggcaggttatcgatgactacgaggacaacgacatgccgctcggctggttcctgccgaacgacggttacggtgctggctacggccagaacggttactacaagaccggcggcgtcaactccgacggaacgagttctgccgagcgcctcaacgccgtgcgcgccaacgtcgacaatcttaagaagttcaccgagtatgccaactccaagggcgtgagcaccggtctctggacccagtcgaacctcgagcccgatagcaactccgagaccccgtggcatctgctgcgcgatttcgattctgaggttaagactggtggcatcaccacgctcaagaccgacgtcgcttgggtgggctctggctactcctttggcctcaacggcatcaagacggcctatgacaccgtgaccaccggcgccaacaagcgccccaacatcatcacgcttgacggctgggccggcacgcagcgctttggcggcatctggaccggcgaccagtacggcggtaactgggagtacattcgcttccatatccccacgtatatcggccagagcctctcgggcaaccccaacatcggctccgatatggacggcatctttggtggcgatcccatcatctccgctcgcgactaccagtggaagacattcacgccctctatgcttgacatggacggttggggcacctaccgcaagtcgcccatgacgcacggcgatccatacacgggcatctcgcgcttctatctcaagctcaaagcacaactcatgccctatatctacacgagcgcggcctcggcggccaacatcgacacgggcaacggcgataccggccttcccatgatccgcgccatgctgctttccgacaactccgagtacgccgcaagcacctcgacgcagtaccagtacatgttcggtgagaacttcctggtggcaccggtgtatcaggatacccaggcagatgagaacggcaacgatgtccgcaacggtatctacctgcccaactacggtaccgacgagaatcccgccatctggattgactacttctcgggcaagcagtaccgcggcggtcaggtcctcaacaactacgaggctccgctttggaagctgccactctttgttaaggccaacgccatcgtgccgatgtacgccgagaacaacaaccccgaggctgtgaccgagaccaacaccaagggcaccaatcgcagccagcgtatcgtcgagttcttcgccaccgagggtgagggcagctttacgcagtacgaggatgacggctcctccatcgagaacaacacgaccgaggacgattcctacggcacaatcgacaatatttcctacggtgagcatgtgagcaccgtctataagtcgagcgtggtgggcggcacggcgacctttaccgccgaggcatcgcagggcggctacagcggctacgactccaaccgcaccacgacctttgtggccaacgtctccgccaagcccacgagcgtctccgccaagaacggcggatccgcgctcaacgtggttgaggtcgactcgcaggaggcctttgacgccgcgacccccgaggccggccaggcggtctacttctacaacgagacccccaacctcaaccactacggtagcgacgcaggcagcaccgaggccgagcagggcgagagcttcaacaacaccaagatcaccacgaatcccaaggtctacgtcaagttcgcgaagaccgatgtcgccacggcagcgcagacgctcgaactgggcgatttcgtgaacgccgatgccacgctcgcggccgaccgcttcaacgagaacctctccgcacccgcgaaccttgctgcccccgaggacgccacgacccccacgagcattaagctcacctgggggaaggtcgatggtgctacctcctacgaccttaaggtagacggcactgtgttcgccgtgggcgatgcggcagaattcacgcataccgatcttgcctacaacagcaagcatacctaccagattcgttcgcgcaacgccgatggctactccgcatggagcgacgtgcttgaggcgaactctgcgctcgacccgtggcggaacgtgcctgaggccgaggaaatcacttgggagggctcgctctacggtagccataaggccgaactcgccttcgaccatgagttccagtcgggcgacggcggtttccactccggtggcaacgatctgggcaaggcgcttaccgttgactacggtcgcgcttacaagctcgacaagctcgagtactatccgcgcgatgatgccggtaacggcactgtgaccaagatgcgcatcgagacgagcctcgacggcgtgcattggacgacgcaggaggtcgactgggagcgctccgccgcttgcaagacggtggcgttcgacggcgccgtggccgcgcgctacgtgcgtatgacgccgctcgcgtccgtgggcaacttcttctccgcctccgagatcgccatctacaagaccgacggcacggacggcttcgctgtgggctccaacctcaacaaggccacggtctccgacggcgactactccaacatgaagaattacctgggtcttgagaaccgcgagcccgacacctcgacgttcgactcccagatccgcgcccacttcgccgacctcaacggcaacggcgtctacgacgtgtacgactactccttcaccatggcggcgctcgacggcggcaccaagcaaaagggcaaggctgctggcaccctcgcggtgatcccgagcaagatggaggtcgaggccggcgacgagatcacggtcgacgtctacgccaccgacgccgagaacatcaacgcgctcggtgcgctcgtcaacttcaacagcgaccagttcgagtatgtctccgagagcatcgcgcaggatgcgtcgacggcgggcatggagaacctctcgcgcgagaaagtgcagttcacggatggccaccagaccatcaacctggccttcgccaaccgcggcgacgccaagctcttcaacagtactggtgtggtcgcgagctttaaactcaaggctaagacggccggcaaggtcgagctgccctcgacgtcttggctcgtcggcccggcgtgcgacgcgctcgagttcgtgagtgatggcaccgtgacgatgcccggtgtcccgcagcccaccaagtccgagtacggccgcgacgcctttgacatcacgatgaccaacgacgagctccccaccgacgacggcaccaacgtcgagaagctcatccagcagaagagctatgacggactgttcgacaacaatgagggcggcaacgacttcgagttcctgtggaactatgggcccaactggatcgacggcaagatgccgacctacgtcaagctgcccgccacgatgacgttcgccttcaagacgccgtcgaaactcgatagcgtcgaggtcgttaaccgcaacggtggcaacggcaccgtgcagaagattaagtccgtcgtgacgttcgaggacggctcgacccaggagttctcgggcggaagctttgattcctatcaggctcgctacgcctttggcctctctgccgagaacaagggcaagaaggcgaccaaggtcgagatcacgccgcttgaggcatcgggtgaccagatgctcacgctgcgcgagatcaacttcaactacacacagggtgtcgaggccatcgagggtgtcgaactgggcaagaaccagaccgagttcttcgagggcgatgtgacgctcgtcgacgccaaggccacgcccgagagcgccggctacccctatgtgacggtcgagagctccgatccttctgtggtgagcgtctccgctgtccaggccggcgatagcgtgagctactacctgcgcgccaacaaggccggcaaggcaacgatcacggtggcgtcggtgctcgatccctccaagaccgcatcctatgaggtcgaggtcaaggctggtgtcgacacctctgcgctcatggcagcgctttccaaggccgcgggctacagcgagtccgtctacaccaaggattcctatgcagccctcaccgctgcggtcgaggcggctcagaagctcctcgatggcggccagggcagctatagcaagaaggatgtcgcagacgccacggccaagatcgagaaggcaatcgacggcctcaagatgcgccccgtcgatgagaagagcctcatcaacacgcccgagaaccgcgagaacgtcaaggtgaccggcttctcgagcgaggccgactatgagggcagcaacgccgtcaacgctcttgacggcgatgagcagacgctctggcacagcgactgggcctataaggccggtatgccccagtacctgaccgtcgacctgggccgcgactacgatctcaccgacgtcacgttcctgccgcgccaggacggcggcacgaacggcgatatctttgaggccgaggtgctggtttccgacaccgccgacggttatgagatgggcaccgccacgtcgatgggtacgtttaccttcgacaacgacggccgcgtgctcaccgaccgtggcgactggaagcagatgagctttggtgccgcgcgcggtcgctacgtgaccgtcaaggtgctccacgccggcggtggcagcgttgacgcctactgcagcatggcggagctcaagttctacggtacggccgttcccaatccggtggcgaaggacgacctcactgccgcgattgaaaaggttgatgccgaggttgcagccggcgaccttaaggccagcgactacaccgaggcttcctggaccgcgttccagaacgccttggcgagcgcccgcgccatcctgaacgacgagaacgccacgcaggacgaggtcgaccaggcactcaaggcactcgagagtgctcgcgacgcgcttgagaagactccggtgaccccggtcgagaacccgaccaagaagcagctcaaggccttggtcaagcaggcgaaggagactgacaccaggggcaagacggacgagtctgtcaaggccctgacggatgccattacctacgccgaggacgtcttgggtgatgagaatgcttccgacatccagctccaggcggcctatgaccagctcaagctggccattgagagcctcaaggatgccgattccggcaaccagggcggctcgggcaaccagggttccggcaatggctcaaacggcggcaaccaggcgggcaagcccgcaggcgacaaggcccagggcagcaagaagagcggttcggcgatccccaataccggcgaccagacggcggcgaccgtcgcggccgtcggtggtcttggcgccatcatcgccgcgatcggcgctttcttccatcgtcgcagcaaggctaagtagtcccagcgacaactaagcaaacgtgcccgccgctccgtcaaggacggcgggcattgctttattatttcagccaacgtacgtcatggcaatatccggtaggtcgcagggcgcttcgcgggcgggcgggccaggctctatctgaacgactttgcgaagcaaccggagtgaagataaagcctggcccgcccgcgaagcgccacagagaccgcagggacgggagcagctatactactctcagtagttaagggtcgcggatccgccgcgtcaccgctctcaacaggaggtctttgtttatggcagatcagaagccggttgtcgggatcatcatgggctccaagtccgatctgggcgttatggaaggttgcaccgccgagctcgaggcactgggcgtgccctatgagctcgtgattgcaagcgcacaccgcacgccggcgaaggtccatgagtgggcctcgaccgctgccgaccgcggcatcaaggtgattatcgctgctgccggcaaggctgctcacctgggcggtgtcgttgctgcgtttacgccgctgccggtcatcggtgtgcctatgaagacgagcgatctgggtggtatggactcgctgctgtcgatggtgcagatgccttcgggcgtgcccgttgcctgtgtggccatcaacggtgccaagaacgctgccatttacgccacgcagattctgggcgcctgcgaccccgagtaccgcaaggttgtcgagaagatgaagcaggagatggctgacgcttaagcgctctgccagtccatttgcagcataaggagagccatgtccgactatcagggaaagcgtttttcggcttctcggattcccgatccagccaagtcgggagcggcccgcgcgccgcagcggggtcggacatcctctcctcagcagtcacgtgcgccgcgccccgtgacgccggcgaagcatcgccgtcaggatacacctgctgcatatcgcccttcgtcatacagtacggccaagaagtcacctcgctcttcggcgcatgccgcgccatcgagctataccgagccgccgcgcaaaaatcgccgctccgtcattcccattctgctcatcatcatcggtattggcctgatcgttgctgcggccgctatctttatcaacgcgcagattggctacaagcaggcgagcgagtcgtatcaaaaaatcgaaaagcaatatgtgagcgacaaggacgccagtggcgtgccaattatcgacttcaatgcgcttgcccagacaaatcccgaggttgtgggttggatttacgcgcccggcaccaacatcaactaccccgtggtgcagaccaacaacaactccaagtacctcaacacgctgttcgacggcaccgccaatgcgtcgggtgccatcttcctggatagcgacgacaccgcgccgggcatggtggatcagcagaccacgatttacggtcatcacatgaacgacggttcgatgttcaacgtgatttcggatacgaccgatcaagcgacgttcgacagcatggactacgtgtactacatcacacgtgacgcgacgtataagctgcgtccgctggcgaccaaggtggtcgaggacacgtatgccaaggcgcgcacgcccaactttgagggcgatgacggactgaagaattatctgtccgagatgctcgacggtgcctctgccgtggcgagcgatgccaccgatcgtgccgcttcggcaaccaaggtcgtaacgcttgtgacctgccgttcgctgtcatttagcaatacgcgcgccgtcatggtgctcacgccggtcgaggaataaagtgtccgggccccgtcccaaaaagactaccctggaaatcaaaaggagaaatgatgcttgagaacggcaaatcgatgccttcggttgatgcttggctgcgcgaagccaaggccgatgtttcggcggctgattgtgggatgtacctgacacacaacggcgtggtgcgcgcgacgcccaaggccgaagtgcgcggagtcgagaccgatggcgtggcgccaggccacaaggtgggcggcatggtgtttggcttcgatgccgaaaaggtgcaggccgctatcgaggcgacgcgcacgatgccgggtatcggctatgtgcgcgtgtggctggcgagcggcgagcttaccgtgggcgacgacatcatgctcgtgctcattggcggagacattcgcccgcatgtggtcgatgcgctgcagtcgctcgtcggcaccatcaagaacgagtgcgtgagcgaggtcgagcgcgaggcgtaaggcctcgtcggcaatccgagtctgtctatagcgaaagcccgccggcagttcatgtagatctgccagcgggctttgatgtgttggagctattttgctctggcgtttgctacacgcgtgtggcgtccttggggctcatggtcatactctgaaaacggttctccatatattcgttatcgaaatgcttgtcatagaactgtgcgacgggaatatttcgaacggttccgttgacgcgctgataccaatagtcgagcgattgcaacgtcatgacgccgtcgatcaacatgacggcggtcaggatgacggtagcagagtagcggcgtttccatggaatcatattgatgagcttaagcaggtgcggcagcaagaccttgatccagatgaggccacccaggccccacatgcaggcaaacggcgtgcatgtgcgtcccccggtcaataccgcgatgggatcgggcatgccgaatagcctaatgtgtgaatagctccacgacaccacgccaaatgaggtctgcataaaccagcctacaaacacctcgaaagcgccgccgatcagggcacttaccaggaaaatgatcagaggattctttttatagaagcggttgagcgccatggtcatgagcaccgcgccaaatccgtagatggggctaaaggggccaaatagcataccggcacggtcctgatagacgccgggatcgacgacgaccatatgccagacttcctcgagaatgagacctaacacgctgcagacgaagaatacccagaacaggttgaagtagttgagcttgatgtagccctcgccggtttcgtcgcggccgagcatcccctcggcggcggcatcgcggtcgagcatctcttgcagacggcgctgcagttcgcgctcctggcgtagcgtggggtcgacggtggccgacagcgcaatgaggatgacaagctggacggcggggcgcagcaggaagggtccgatgccctggagcatcacgtcaactaaaagctcgacgacggtaaacgcgataaggatgtaggaaagacgggcggcgttgcggcgctggttcttgatgaggtccaggccaaagatgatcaagatgacggcactggcagccgagagcatgatgccggcgacgataaggccgactgcgacgagcgtgttgtcgccgaggttggcggcggcgttgccgttgatgagcgcggtgatgacctgccacataaaggcgccgaccgacgggagcgtaccaacaccggacaggatgcacaggacggcatacaccttaatgatgagggggatcttcttgacctccgtggcgctggggacgctggggtcgagttcgtttcgatccatacataacctttctcgttttgctgtaggtacaaggatacgccgccgacctgctaaaagacaagacaaacgacccaattgcagcaatgtaagccctagcggtggacgagacgcgtcgcgacggaagcatgcgggatcgtcggccccgaggcggttgcccaataaaatgtttggctgcaaaacggattataagctcggtgggcttttaaaaagcgctgttcatgcgcgggagtgcttgtcttgccgtgcgtataatagggcaggtaacgccaaataacgaggctctgaggggatgccatgtctcaagaaaccatccgcgcggccgagcgtgccgcgggacaggtgaagaccatgtcgacgtatgatccggactccgaccagctgcatgaggaatgcggcatttttggtgtgtgggcacccgatcgcgatgtggctcgactgacgtactttggtctgcgcgcgctacagcatcgcggccaggaatcggcgggaatcgccgtgggtgatggcggcacggttatggttcgcaaggacctgggcctgctcgaccgcgtgttctccaacgccgacctgtcgacactctccggccagctggccgtgggccacgtgcgctatggcactgccggtgccaagagctgggaggcctctcagccgcacctctctaccatcaatagcgtcattatcgcgctcgcgcacaacggtaccctcgtcaacaccgacgagctgcgccgccagctgatcgagctgggcgtgccgttcctttccaattcggattccgaggtcgcgactaagcttatcggttactttactcagcgtacaggccatctacgcgagggcattcgcaagaccatggagctcgtgcgcggcggctatgccatgacgctcatcaacgagcaggcgctctacgcattccgcgatccgcacggcattcgcccgcttgtgctgggcaagctggtggacgagggtctggaccaagccgatgccgcatccgtttcgcagctgccgtcgcaggacggcgccgcgacggtcgacgccaccacccatgtcacccgcgccggcggctgggtcgttgcttccgagacgtgcgcgctcgacattgtgggcgccgagtatgttcgtgacgtccgtcccggcgagatcttgcgcatcagcgccgagggccttgtgtccgagcagggcgtgcctgccgccgaagagcctgctaactgcatctttgagcaggtctacttcgctcgccccgactccatcatgaacggcaagagcgtctacgcctgccgttatgacatgggtcgtcagctggcacacgaggagcccgtcgaggccgacctggtcatcggcgtgcccgattccggcctgccgcccgcggagggttattcgcacgagagcggtattccctttggcgagggccttatcaagaaccgctacgtgggccgtacgtttatcgaacccacgcaggagctgcgcgccatgggcgtgcgtatgaaactcaacccgctgcgcgacaacatcgagggcaagcgcctggtcgtcatcgacgactccatcgtgcgcggcaccaccatggtgcagctcgtcaagatgctacgcaacgccggcgccaaggagattcatatccgcatcaactcacccgaggttatctggccgtgcttctacggtatcgataccgacgtgcagtcgcagcttatcagcgccaacaagacggtcgacgagatttgcgagtatatcggcgccgattcgctggccttcctttcggtcgagggcctgcttaaggtcatgcccaagggcggttactgcgatgcgtgctttaccggccgctaccccgtggcgattcccgagagttttggtcgcgacaagttcatggagggctttaagccccgcaacctggacaagccgctgcactttgatgacgacgccgtggtcgagaaatacgacgaccgcagctgggaagaggaacacggcgaggcctaaaacctgccatgtagggacaggtttattttggtaggttttacctgctgttttgttgatatgacggcgcgcgttgttatggcgcgcgccgaaatgaacgcaactatgagcaccgtttggcgtctgtgcgtcaaacggtagtgggagaggaaggctcagatgagcgacagcaagcatgtgacgtatgaggatgccggcgtcgataccgccgagggcggccgcgccgtcgacgcgattaagcagatggtcaaggacaccaatcgccccgaggttatcggcggcctcggcggcttcggtggcctgttctcggccgccgcgcttaaggatatggaagacccgattctgattagcggtaccgacggcgtgggcaccaagctcgtgctcgcccagatcatggatcgccacgagacggtgggccaggacctggtcgctatgtgcgtcaacgacattctggcttcgggcgccgagccgctgttcttcctggactacgttgccatcggccacatcgaggccgagcacatggcaaagatcatcaagggcgtggccgatggctgtaagctcgcgggctgcgcgctcgtgggcggtgagatggccgagcaccccggcgtcatggctccggccgactacgaccttgccggctttaccgtgggcgtcgtcgaccgtcccaagatgctcgaccccgcaaacgtccgcccgggcgatgtgatcctgggcctgccttccaccggcgtgcactccaacggctactcgctcgtgcgcaaggtcatcggcgtcgacggcattaagccgggcacgcccgaggccgccgctaaggcggaggagctgagccgtccgctcgaggagctcggcggtgcttcgctggcagacgccctgctggctcccacgcgcatctacgtcaagccgattctggagctgctgcgcggcggcgctccggtgcacgccattgcccacatcactggcggcggtattaccgagaacctcaaccgcgcgctcgccgacgacgtcgatgccgtggtcacccgcaacggcgccgagatgggctgggatgttccgcccgtcatcacctacgtgtcgcgtcaggccgagctcgcgcccaatgaggcatgcaagaccttcaacatgggcgtcggcctgtgcctgatcgtcgcccccgaggacgaggctgccgtgaccgaggctctggtcgcgctgggcgagaagccgttccgcgtgggcgagtgcgtcgagggttccggtaaggtcgtgtactccgatgagcgctaacgagcagatggctgccgccgagggcctgggctttgtgccctacacccgtccgaccggcaccgatacggccgagccgctcaagatcggcgtgcttatcagcggttcgggtaccaacctgcaggcgctgatcgacctgatcgccgccggcaagctcaacgcctcgattgagcttgtggtgtcgagccgtccatcggctaagggcttgcagcgcgccgagcgtgcgggtatccagacgctcacgctgtccaaggacgtctatgccgaccccatcgcggctgacgagatcatcgcgcatgagctgctcgagcgcggctgcgagtacgtggtgatggccggttacatgcgcatggtgcacacgccgctgctggcggcgttccccaatcgcgtggtcaacctgcatccggcgctgctgccgagctttaccggtgcccatgcgattgacgatgcgtttgctcgcggcgtcaaggtgaccggcgtgaccgtgcactttgccaacgagatctacgacaacggccccatcatcgcccagcgtgcgctggctgtcgaggagggctgggacgtcgacgtgctcgaggagcacatccacgcgatcgagcatgtgctgtatcccgaggtcgtgcagatgctcgccgacggtcgcgttcacgtgctggagagcggcaaggtcgcaattgatgcgccgcgctagcgcgtgtaaacgggtcacctaggtttctctgaggcgtaaacgactataaagccgattggggcatatggaatcacatgtgccccaatcggcttttactatctctttgacttcgggctcctgataacgtgacgggtgggacttcggaaaatgagggcggttggccgcgagcatgatatggatatcagcggcgatttctccatctcggcaaaaaatggcttcaagttgagcatcggctcggacttcgagggggcggacctgttcagcgaaaattcttacactgacactcatgccatgagccaggataactagccggtatagggtcacttgagtgggtatgcgtctgttcaagtcacccatcgatttgtttaagaaatagttaaactacgaaacaaacggcacgtgggtaactcacgactcagcgagagtaaaaggaataggagaagaaggttcatgttttgccccaaatgtggcagcaagattggtgatgatgcgcggttctgtaccgaatgcggtctgcccttgggcgggctctcgggcaagactgcggccgaggaggggcccaaggccgagccgtcggagcgagaatcatcgtccgctgaagtcataatggaacccacagataccgaaacggactctgcgataggatccgcgaatgccgagtccacagcagaaccgagccccgagccggtctcgaagaccgcgggtagcggtcactcccagatgtacaacttctttatgcaacgctgtcaggtcggtaaccgcctagtgccgcagtttgctatcatgatcgccgcatttatcgccgctgcaggcatcgcttacgctgctttcatgctctacaagaacgtcatcgagcccaatctccagcagcaatccgtgcaacaggagcaagcgaccgaaaggcccaagaaggacgagagagcggtcgaagaagttgtctatacgttggaggcaaagtcattgacggtgtctgctccggtcgaccctatgctcgaacagggcgagcggagggacatggaatggtcctatccgcaacttaagagctccaccaaagacgacgttgcagacaaaattaacaaggcgattctcgagccccttcaaattgacgcggagcgaacaaatcgagcatcagataatgagcaatcagatgctgagttgtaccccgacggcgaatttccctgcatatcgagaaacgtgacggtaacgtacatggatgagaactttttctgtatccgtgacgagcgctattcgacgggatggggtccgcatggcggcacggttgtgactggtgttatttttgatttgcatacgggtgatactgttagtcctcaggacatgtttggcattgataccgaggatcttgccagttccatgagttcggcagtttggccgtatcttacggaaatgggcagagaacatccgtctgattacaattcgatgctcatgcggagtaattcttcggactattcaatcaagggctcaacgtgcttgtgtgtgacatccaagggactggtgtatcacaccgaagactatgagctcggtacttttgcggacggcaattgcgagattttggttgcgtcctgggatgatgagtctcaagtggggtccgaagtaacccctgatgaggtcaaggacggtacaacggtgaaagtcgataaggaggactaacatgttctgtcccaactgtggatttgagcttgatggcgatttgcgatactgcaccgagtgtggctatgcactcgaagatgcaaaggcggtgctgaactctgccagcaacgaagtggcagaagagccttccgttatcaatgaggctgcggaagagattttcgctagtgacgaaacggagaaggagccttccgccggtgccgaggcgggggaggaaaagtcgcccgtggagagcgggcccgtagcggacgaagaagacgaccggcccaaggacgacgtgtcgtccgatgcaacgccttcgattccagccgtgcgcgccgaccggccaaagccgatcaatccggtcgccaagcccgtcgcggcgccagcccctgcgcctgcggcgaatgtatccgcacagaaaaaggagcccaaggcgctctatatcgttggtatcgtcgttggtctggcagtcattgccatctttagctatctgctgttctttagcaagtccggcgacgttgcccattacggccaggacaaggccatcgtggtggcccaagaatccaagattaccccgaccgacgcaaagggcgagaagatcaagaagtactcggtgaccctgaacggcgacaacggctacagcaccaatgctgaggttaagggtgacgagggcttcacggtaagccagtttcccgatatcaaaccgggaaaatataccctcaccgttagggactccaagtcaaaagtcgagtggagcattcccgtcaaagtcgtcgataactctaaatccactgatgccgtaaaagaggtttccctcgaggtgcctaaggccaacgaggacgatacaaagacaggcgaaggcgacaagaaggatggaggcgccgctgcggacaataccgctgcgtatgccgcttacaagcaaaagtgccaggaatatctcgcgtgctatggagagccacgaattgttgaggcgactgattctgtctatgcgatgcgggggctttgtcttgtcgacctcgttgattttgatcaggatggccagcctgagctcttgaccgttgtgaacggtatgagcgatgacgaattaaagagcgcttggaatggagatatagagggacttcagaagtcctacaccgtagaggtttggtcggcagctgatggtggcgtcaagaggctttacagtcaaaattggcttgataacagcaacggaggaacgatgtttcttccgctgattaaagcggatgacggcagcatcctcgtaagccaaagtacatatgagatgagcaatgcgattacggcattgcttgctggcaggcaggctttggctggggacaatacttcggtatacggcaagaaaggcgatgttttttcgcttgtaagcaactgcgagtcctggggagttgcgccgagcgagggcaatggctacgaatactattatgcgtcggagggcaaggacatttccgagacggactataatgccctatatcagcaatttggctatgggcacaattaccggacatactacttctttgatttttcaacctcaggttacggctctatttcgggggaatcccacgtcgatcccaatcaagttgcggaagtcaccaaagatacgctcaaaaaggtgggaatcgaataaaaactgaaaggggcttggaaaactgtttccaagcccctttcttatagtagttgctcgagtccaacaagcctcgcgctgcttgcttgagccgctctattttgacacgctttggtaaatccactcttgctaaacaagtaatactgttcgatcggccgacccagcagcgcgctgcgccgctcgagtgtttcaagaacatcggtatctacgggctcgtttctccatttgcactcgccaacgatgagctccccatcggcgccctctaacacaacgtcaatctcttcttgccggcgcgtgttcgggttcgtgccccaccaagagccgattgccttgggcagcacatccagctcgctctcaacaacctgccgcatcaaccactggcggcacacttcttcaaatgcaggacctacaaaggtggacaaatcatgcttggcgatacgcgcggccacagcggctccgagcccctcctcaattgttcctgcgtactgtggaacaaaacgataccaaaacctaaacaggttatcgcagatccgatagactacctggcgttttgttgcctttacaacaggcgtgacgcgctcaacgattcgcagctcgatcaatgcgtcgagcagtcgcgcgacctgtggcgttgcgaggtgggtaacatcggcaatctctttggagcgtacatagccgttggcaatggcggttatgacggcattgtagatagccgggctgcggacctcttgcagcagatagttctggggttcggcatacaaaaacgcatcttgacgcaacagcgcatgctcaaggttccattgagtgaaacgcgtgccatcgagctgtgatagatagagcggcatcccgccaacaacggaatacagctcgatgaccctttcgatgggtgcatcgggaagcatgagcgccgcgtcgaagatggtgaaggggtcaatgcgcagctgcatggtgcggcgtccataaagagggctttggtgtcctagtacctggtgttccataaagctcatggacgacccgcagagtacgaggaacagcttgctcgtgtctttatgtcgatcgataagcgtttgcaagcacgaagagatgcccggatcgctctcggcgaggtagggatactcgtcaataatcagaacgattcgctctgtcttggcgtgttcgaagacggattcgagtgcaacctggatagaggggaacgctgctcctgcggcgctatcgccaagtatctcgcggctgagcagcgcgagattttcgcttgcaacggtttgctgcccagtaaagaagatcacatggggtttgccctgtgtaaaggcgtgaagcaggctggttttacctacgcgacgccttccatagactacagcaaactgaaaagaactcttttgataggcggtttccagggattcaagctcttcccgacgtccaacaaacatgatgcgcctcgctcatatacgtattactaacatatatattactaacacgtatatgagcaactttccacccgtcaatcggatggcaaggaaatgacagcgtttctacttaacgaggcgcttgagcttggcatagtcctgaatttgctttttgcgcttggcgttgaggaggttgttgaggtcgagcttctcagcggtgcagcgtttgagtagcgcggagctatcaaagccgtttgactcaatgtcttcatccagatcgtgcttgagcttggtccatttattgagctgcgagcgcacgtaggccgcgggacgttctatctcgttggcgatgtcgcgtacactggtgcccgttccaaacagctcgcgtatctttgccgtctccttgcgcgtgcgctcatttttggcatcggtcttgcatcgatcgctgcagtagtgccgtttgacgccacgatgcccggcaagtgaataggcgcgtccgcactgctcgcaataaccaattttgacggtgctcagcttgcgtgaaaaatcaaaccagagccacgagagatagctgtcaaaggagaggaaccctgtggactcgttaccctggaacacatccacgtgcgcgcccgagagatgcgagatcacgagcgcctgcaccaaagcagtgagtgcatcgcggtcatcattttcaagttcttcgcggcgctcctggatatctgcttgagggtcgattacatagaagctctcctcgctattgctgaccttgagtcgcgctgaaatctccgagctggagtcttcgtccatgtagaacatcgcctgcaaaacactgaagtcattggcggtgagctcgtgttcaaaagagagcacgttgagtgcaacgagggattcttcctcgtcgatcataaacataaaggcgtagaaatatcccgcatcggattcgattttgcgcacgatgggcaggcttttgaatgagtcggtataatcaccgcccgccctcaggatagtggtgtagatcttgaaggatgacccgtttgccgcgcaggtcaccactgatttctcgattctttccaatgcggagacctttgcgatggtgcagctcccgttgaggtattcctggatgcgcatggcaataagtgctgccatcgcggcattggcccaatcgcgtacggattctattgcgtgcttgccaaaaagcggcccggtctgttcggcgtaatcaagtacgttaaagaggcttgcgcggaagggctgctctttaacggcggtgggttcgatgcatgatgccagcctgatcagatcggcatggcgctcgctgtgtgcgggcccttcgttgcttttgttgccggccagctcggtgggcatgtagagttcaaagacaagctgggcctcgccaacgggcctattgggttcgttctctatgaggttgactttcttaaacggaatcgaaccttcaacggtgcgtgtttgggagaactcaaacattgttacccctgtctctagctgcaggtttaatagcgtagcacgtttaggaaaattacccggtcaaaatctctatatcggataaacgacaaatcgtatcttgtgatcgtcaagaaaaggggtaacgagaaaggacccgattatgcattgcaaacagtgtggagcagagattaacgacggcgccaagttctgcggcgtgtgcggaacgcctacggtcgcggctgcggccagcgcggtgggggacgcgatttacgtcgaggcccagccgattgagagccagtctgtcgaggctcagtttcaagcggcggaggatgcagaggccgctgcttgcctgcaggattcgcttcacgagtccatcgggtcgcttgggcgagcagcggtgatttcattgctctatgtgctctttttcaattacgtgctgggaggtggctcgctgggacttaacaatatgattccgctggcgctgcttctgattggtccctggaaggtgattatctcgctgtaccgcagcggtgtaaggcttccccttgtctatggtagcggcattatcggtatcacgattatgctaatcgagcttgtggttctcgtgggccttcctgtcgtggttctgatgcttttttactggttgggcagcgtgattcacggggcggttcctgttattcccgaatcggttccgatgacgatcgtggcgctctggcctattgcctcggttgccaacatcatcttcaaggcaatcaagctgcacatggctcgcgcctagcaagtagcccgtcgcatgccttccgcgtggggtcaggcgaatttgaaaggtgaaagaaaaggtttacagtcgagcaaattgctcctgggccttttctgtttgcaggctgtgggctatcgtttcgatatgctgaagttctagggggatttatgtactgtgcaagctgcggggcaaagatcaaagacggggcgcgattctgttctgcatgcggaaaaccgttggatgtggatgatgcgccggcgaatgctcagcagccgcttccttcaggtacaccaaaggcgtctgctgatagaaaagcgacaagcgatcctgctgtatctcgcgcagagggcccttctctggcgccctctgatcatatgtcctttgcggcctttatgatgcagcgtcggcagatcggccgttttgctgtgcctacgtttgtcaccattcttgcagcaatcatctttaccgctggtgtcgcttacgccctggtcaaagcttacgaagcctttgtgctgcctcaagcgcagcagcaggagcagccggctgcagtcgaggagaagtcgtctaaaaagaaggtcgcggcaacaaacaagaaagcacgcagggcttacgagggcgtggttgcgcgttacgaggactttgcgagctattgcgagcggaagggggctggtgctgccagctacgacgactgggcccagggacgcggtgatgattctggactggggcagatattcgtttataacaaccagactgcccccggctttttaagctactactatgctttcgatgatttgaatggcgacggaattgacgagctgcttgttgggtttgtcgatgcgcagaacgatatttcggcgattgtgggtgcctactgctttgttgatggagaggccgtttcggttatgccttcgtcagagatggtagaaggctccagcaatatgacgaatcagtatgacggttttattgctcagggtgagagccaagtcattactgtctgtaaggacggcatcgttaaatttacttgtagtcaggattgtaaccaggcagatttctatatttcgcttactgcaaagggtcctgaggtcgtagacgcggtgcaaattcaaaataaggaattcgataggcagaatggcgcctacttggtgaggaccgttgaggatggtggcaaaccgcaggaggcgatggtccaggggcgtgaggaagcgtgcagaattcttgacgagctcgccgggaagtatccggaggccgacattgaaatgccgtccgcaagcagcgatatgtggaaggcattcaaaggggtggagccttcggagggctctttgaaggacggctctggcactgcggacgatcgatctggcgcatctcaagcaccatctgaagcggcatccgatagcagcgacgatggggaggccgctgcgcgcggcgatggcgtgatcgccgacatggatgcgttcattgcaaacgccaagcgcgagttgattgtgccagatgacgcctctattacgttcaaggtcgctgataagccaaactattgggagggggcggcaacgtacgtttggtacgtcgagttttataaagacggaaaggtcgtagcgtctgcggaatgcggctccgaagggtacccatgtcggtcgattatggcctatcacgagagctggtaactttaaccgagccgttttggcattacagcgcgcgcagctcttatgcctttccccttgttccatccgacgagtttagttgcggctaaaacggacgttacgaagagctgaccgagaggccgaacgcgctcgcccgctcagcgggtatgccccaaaagggcatctggggttcgaaccctcccggttcttcgtcagttgaccaaaggtgcgacattattgccgctcatcgggggtggctaaatgagatgacttgagggctataattagccaagctaagttggggacagattgaggcgcacaggctttcgatgcgcctgtcgactcggcagttcacaatttattagacacgcggaacgcgtggtttgggattaacgaaaggaatcagcatgtcactgttccatagcgataacgaaaaggaagaaaagcacagcggaattctcggtgccttttctgtcgacaatatcaaatgggagcctggcaacgacgaagatgcctcgcttgtctcattccgctatccctacgaggattttcccaacgggtcctatcttcaggttgcgcaatcgcagattgccgtttttaccaacaatatgggggcgggcagttctactgacgctacgggtgccggcgattctcaggtaagcgtgtttgtcggtccgtgcaagatcaagctcgacacgggagacagccgattcgccccgttccgcaatgccgcccattcgcttaccggcggtagctcggcgtttcattccgttgtgtactttatcaatactaactacatgaacgagctgcgctggggcacgaccgagcccatcattgtccaagaccctgaggaagacgtcaacgttcatgttcgcgccttcggtttgtttggcgcgcatatcgagcagaatgactcgagcctggttcccattcaggtgaggaagttcctcgttaaggtcgtgggcacgcgagatcgctatacgcgagaagaacttacttcctttatgcgggcaaaaatccttgagtatgttcctgacctgcttgccaaggcgattgttgaccaggaggtttccgttcttaaaattgcgacgcatctgagcgacttctcgtctcagatgcagggcaagctcgttaactatttcgatgagtttggtctcacgctcgataacttctcgttcaacagcatcaagcccttcgaagaggatcttgctgccatcaacgagatgaagatccagcgtaagcggagcattctcgaggcgcagggtaacgctgcccagatggacatcgagtccgaggcacttgccaggaagcgtgcgcgcgaaggctacaactatcagcaggagcgcggcatggacgtaatggagagtgctgcgggcaatgaggggagtgccgcatcgggcctcatgggagccggcatgggactcggcatgggcgttggcatgggcggtgcatttggagctggcttctccaacttggccaaccaggccatgggcgctgttgctcccatggttggaacggcttccgcgtccgcaggtatgcaaaacggtcccgtgtgtcccagttgcggaaacgttaatccgatgggtgctaagttctgcctggaatgcggacaaaagctcgagcagggtgttgcgtgtttggcgtgtgggcatcttaacccggtcggtgccaagttctgcctggaatgcgggaaccggttgatctcgccaaggtgcccgagctgcggagccgagttgcccgaagggaccaaattctgccccgattgtggaactaagatccaataaggagaaacaaagatgaacggttctgttaaacgtgtcattttgggcgaggcaatcgtcttggtggcgtggcttgtaatcatgtttgtctgcaaaaacgcgctgatgaaccctatcgtctttgctatgtcgcttggctttggggttttggcttttgcggcggcttcgatttcggctgccatgtccgataagcagtccacggtcaaaagcacgaccgaaatccattatttgccggtcgcatccagctgtgcctactttgtcgttgcccttctggccaacacgtactttgtgtttgcggcatatgggtggggcggcagcacgattccagtcgtcgtaaacgttgtccttcttgctgtgcttgtccttgtgcagatgggtctgggcttcaatggccgccaggttgaccaaaaggttgctgccgtggccgcaaagacggttcaaacggcgcagttcggatcgtatgtgggacagctcctcgccgtggcgcaggacgctcaggtcaaagccgaactcaaagcgcttaaggatgacatctcctttagttccaacatgtcgcaaccccatgttcaagagatcgagcgacagttctccgccgcgcttgaggcggtctcgaattccatgagtgccgatgagccggcagatgttacggttggccttgtccatgatgcgcgcaatatctggaaaaagcgcaatgcggcgctgaccgctgtcaaataagggctcgcgctgctttttgccagggcactttgatggttgaagtgggggaagctattggaaatcaacggtataacttgtgagggctgcggcagcaccgatgtcgagtttgaccccgcaactcgaaaggttcattgcaaccagtgcggtcgcgagatgtactattcgcgggcgcgtctgggggccacgggcaaaatcgcgtttgccaaggacaatgccatcaagttttttaagggtggtaactttccggaggcccgcaaatttgccgcggacgtgctcaatatgatgcaagacaacgcggcagcacagtttatggttgcgtactgcgatgagttttgcgaaggtctttcgggttcgatgacggttttctttaaaagggccgaagatatccctctcgaatatgacgaagtgcgtgacttgatcgacttgtttgagtcgacgctctacaacatgcgtgactttgaggttcagatggtatcgctcgtggtcgccaatatgcagagcatggaggatcggtctcggcttgagagctttatcgatgctgtgtgcccgttctgcatagcgcggtatgcttcggaagactttatgaccgcagagcgggagagcttctatcaagatatcgccgccaactgcaacatacccaagacgtgtctcgcactactcaagggcattagagagaaccccgggtccccctataaaactggttcgtttgcgttacgaagaaggacctcgtactttctcgaacactatgtggagcccgtcgggcgcatcgtcaattcgatgaaggcaagccaatacaaacagaagtttctcgtggcctatcagcaggtgtccgagcaataccgaagcatggcctctcaataaagcggatggcgggtgcttactcgcttaaagctattggatgatctaaacagttcaaactgaaaggtggtacagatgagtgattcgggtttagatactgcccttatcgagcgcagaatcgccgctattggaacaaaagttgaccagatgaccacgaaggtcgataaggtcgaatcccaaatggaggaagtgcggaaggaccttaaaaagctccgaaaggactttctcgagatgatgctcgaacagcgtcgtaccgccgcacttgagcaggcgactacggagctcgtgagcgtccggcaggagatggacaagaagttcggcaactactcggtggttcgaaacaccatggtcggtattctccaggcaaccgatgcagcgctcgtgcgcaaggcgacgatttcgacggtctccgaggagttaatgatttctaccccggactactggctggcgcctgtcctggttgcccttgcggcatggatcaacaacaaccgagatcttgcagagcgcgcaatacgcgaggctgtcaaacgtgacaacgagcacacgtcgcttgcgatggctctgatctgcagacgtaataaccgcacggctacgtgctacgaatggctagcacgctacttctcgacgcaaaacgccgcccgcatcgatgccgatgcgatggtctacatcgatgcttatatcaacggcatcttcggaaccgacgaaaagcacctgtgcgacgactatatggcgggctggatcgagcagatcagaaatcagagccctgagttcgagaatgagcagtcagagtcatgggcggagtactttaccggctacgaggaggatatgagctcgagatatccggcactcaaggtggtggtcaaggagtttgactacatcaataagtatctcggaaaagtcgaggcaatcgagagcatctccaatgacttcgccgacctcaaggcttctgatgttgacgagaggacgcttgccgagcaggttgacaggcatctgatggagctcgttaactccgatgactccaaggagcgaaatttgcgccgccaggaggagtatcttcttgcggtcaaggcgtttggcggagacgtggagcgcgcccgagagctcgtcaatcgtcgccgtgatgagaagcgtcagcagacgatgaatatcatcgaccagatgacacgctcgatgcgcgaccagagtgcgtctgtggatgtgcataaaaagaagaccgcgattcagtttttgggttcctatatcaacggtggtttcaaccggtatcgcaagagcgatgtccccgaatttccgcaggcgatcacccttgacttcgacggatggacaagcagagcggtcaccggcgatgagggcaatgcgctgcgcggcgattatgttcgctatgtcggtgaagagaagaaaaaggagctcgctgagcttgatgtcaaggttgcgaagggcaacaagagccacaagatagcggccgttgtcctcgctgttttgggagtagcttgctttgcgtttgtaaaccaggttattggcattctgcttcttgcgggggctggctattgtctagtaaagacgggcctctcgagcaagcagcgcgctgcggaggcagaagagattgaggccaaatactccaaacgcatccaggaaggctgttccgagatcgatctggcgcttaatcagtggaagagcgcgaaggaagcggcggccgagcgcagcgacctgcttaagctcgataaggttgcctagccgataggattgactcgataaccatgaatggagtgaaatagatgactgatgaagtgactgatttcgaccataacgatgccgcgatgcaggacttcgatgcattgagcgagctcgatagtctgtttgaagaggacgagcgactgaagcaagctgagaacaatgttttgactcaaaatctctcaggctttgcaaactgctttcccgattgggatttgcatccgccggtagcgtagaaaagcgcttgaaacacaagctgcgatcatttggaaacatcgatgtttctgcgggctagaagccatggggcttttggcccgctgtctttcatatgccggtcggcggcatagggcatcaaccgtattctaggttcttggatgccaggccgactcgcttcggatcgggcgctacactaactttctcgagactaccaatctgacagggcctcgtccgcgtgtggacggggcccttttgcgtggccttttatgtctgctatactgctagcacgtagaaaggagccgctatgggaacggcaatggtgcagctcaacacgcgaattgatcctatgctcaaagctggtggcgatgcggtcctaactcgcaatgggttggggccgagcgatgccattcgcgcgctttgggtctatcttgtcgagcatcaagcgctgccgggatttatggtggcggataagcgcgaggcgccccgtgcggagagcctggccgagcaggggtgtggcctagctttttcctcgttggggctaagcgcttcggattttgcgccagctgaatcgtctgcggaagactgggatgccgtacgcgatgatatgtatgacgcgatgattgccgacatggaggcgaattgccgatgatcgaggcaaagcacctgcttgtggatacgaatgtgtggcttgattattacctgcaagagggggcattcgacgaagcgaagcgcctggtggaacttgccgaggcgggaaagattgaccttctgtacgcgccgacgacggcaaaggatgtgttctacattttgccgcggcgcctagcccggcggaatgcgaatgggatgaacgtgccgtttgcctcggcgtcatgggcctgcatcgagcacatgatgcaggtggcgacggcctctccgctttcgttggcagagtgcgaaatggcgcgcatgcttggcaagcgcatgccggatcttgaagacaacctcatcatcgcttcgggcgagacggcagatgtcgactacgtggtcacgagcgaccgacgcatgctggaggcgatgcccgaggtgtgcttgacaccggctcgtgcgctcgagatgatcgggatcctcggctaaccttgtctgtttcgtttcgctatcatatggggcattgtgaacctcatgcaactttggaggacagtatggcggataacgaagcattgtttacgcctgagctggtgttttttgattgggagtgtgcgacgccggatgaggtgtttgcgcaactcgaggacgagctcgctccgcgtggctacattgcgcccggttggctcgacgccgttcgcacacgtgaggatgcctatcccacgggccttgccatgccggcggccaacattgccatcccacataccgatccgggatttgtggccaagccctatatcgcggtggtgaagcccgccgcgcccgtgacatttaacgctatggctggcatgggcgctccggtgccggcgcagatcgtcatcaatctgggcatcgccgagccgggcggccaggtcgaggccctgcaggcactcatgaacatctttatgggcgccgatgccgcagccgacgtgctcggccagaccacgccccagggcatggtcgacgccatccgccgccacttctaaggtggggctgagtcggcacttggggactgtccctaactgccggctgccagagctgtcccctttgcaccaaaatggtgcagattaatctgtccccaatgcaccaagcgtgccgcgggggctgcgttgtgacacaatggcgtttgttcgattcgttatgcgaaaggccaactatggcaaataagaaaaagaactccgaggccgcgccgacgcccgagcagcaggcccgcgctgcctccagctctcgcaagaagcagcgcaagacgtacgtgtctaagaccgtcaagatcgttctggtggtcatcggcgtgctggcgatgctgctttccgtctcggcgatggcgtgctccggccttatgtcgcaggctgaggacacctcgggctacaagctgaccggcggtgttgctgccactatcaacggcaccaaccttaccgaggacaccgtgaccaagcagatcatgagcatgcgcacgtcctacggctacaccaaggatgaggattgggcgcagtatctggttgacaacgacctcacgcccaagaagtaccgcaagcaactcatcgactcctacatgcagcagattctgcttcaacaggcacagaaggagaacggcgtgacggtgtcggacgaggaggtcgagaaggcttggaaggacgcgtgcaagagcgcgggcggagccaaggcctttaagaagaccctcaagacctacggctataccgaggacacctacaaggactcgctcaaggagagtctggcgcaacagaaactcaaggatgccgtcgcgcccacgagcaagcccaaggacagcgagattgtcgattacatcaacgaaaatctgtccagctacaacgacgcccgccgctcgtcgaacatcctgatcaaggttgattccgacgcttccgacgaggacaaggctgccgccaaggccaaggcgcaggagtgcctggacaagatcaactccggtgagctgagctttgaggacgccgttgagcagtactccgaggacaccggttccaaggagaagaagggcgatgtgggctgggataagctcaccacctttgtcgacagctaccagacggcgctcgagggactcaacaagggcgacgtgagcgaagtcgtcgagtcgacctatggctaccacatcatcaagtgcaccgactacttccatgtcgataatcaggttgatgacatcaaccaggtgcccaaggacatcaaaaagtacgtctccaacgtggtgaagacgcaagcggccagcaccgcgtacagcgagtggctggagcagtacaagaaggatgccgacatcaccgtcaaccccatgcccaaagacgtaccctataacgtgagtctgaagggtgtcaccaagagttcgaccgacgattcgtcgacgactgagtaatcatggggcggtgctcgcgcgagtgccgcccacactattgaggaggatttgcagatgaccaacgaagagctgcagaaggaaatgattgcggccatgaaggccaaggacaaggttcgcctgtccatcattcgccaggttaaggccgaggtgaagaatatcgaggtcaatgagcgccgcgatgtgaccgaggaagacgtcaacagcatgatcaagcgtctgatcaagcagacgagcgagacgctggagatgtccatcaaggccggcaccgaccaggagcgtaccgacaacctgaccgagcaggtcaagattctggagagcctgctgcccgcgcaggtttcgggcgaggagctcgaggccctgatcgagcaggttatcgccgagctgggcgccacgtccaagaagcagatgggccaggttatgggcgcactcggcaaggccaccggtggcaacttcgataagccggccgcggcaaagatcgtcggagccaaactcgcgtaggggccgagcggtacatagttgatgtttaggggggcgtggccgtcatggtcgcgcccctttttgctgggctgggcactcattggggacaggcttaaatgagtgcccaatgagcaggtactcatttaagtctgtccccaatgactaggtggaaggttgcgggttctttacgggaatgtagtgtgggctgcggaaacgtgattctttccgtacaatagttcaactcgtgtaaacgcagggaagggacattcatggcagacatgatcgagatcaagcatctcaacaagtactttggcgacctgcatgtgctcaaagatatcaacctcaccgtcaaacgcggcgagaagctcgtaatgatcgggccttccggttcgggtaagtcgacgctcatccgttgcgtcgattatctggaggagcccacgtcgggcgaggtcgtcatcgacggtacgccgctcaccaaaaagaatcacctggagatggctcgcaagtatagttccatggtgtttcagcagttcaacctgtatcccaacatgacggtgctcggcaacctgacgctcgcgcccatcaagcttcaaaagaagagcaaggaggaggcgaccgagatcgctgttgccgcgctcaagcgtgttggcatggcgcataaggccggcgagtatccgcagaatctctcgggcggtcagcagcagcgcatcgccatcgcccgtgccctgtgcaccaagcagcccatcatcctgtttgacgagccgacctcggcgctcgaccccgagatggtccaggaggttctggacgttatgattgagctcgcgcaggaggacattaccatgatctgcgtgacgcacgagatgggctttgcgcgccaggtggccgaccgcgtcatctttatggaggacggccgcattctggaggagggcacgcccgagcacttcttcgataaccccgagaacccgcgctgccgcgagttcctgtccaagattctgcactaggcgcggtgatggacatgacggatatgacgagggcggccgtgtcgcgccgtcactttttgcagctggcgggcgccggcatgcttgcgctgacggggaccgcgcttaccggttgcggcaactccaccagcggcgagggctccgacaagggctccaagcttgcggccatcaagtcgcgtggccatctgaatgccggcgttaagaaggacgttcccggctatggctattacgacaccgccaagggccgctttgagggcatggaagtcgatttgtgctaccagatcgccgctgccgtctttggcgtgagctacaaggaggcccgtgctcaggagcttgtcgagtttaccgacgtaacgcccaagacgcgcggtccgctgatcgataacggccagctcgacgtggtcgcagcgacctacaccatcaccgacgagcgcaagaagagctgggatttctcgacgccgtaccgcaccgactacgtgggactcatggttaagaagcgttcgggctttacctcgattgaggatctggacggcaaggtcattggcgtgagccagggtgctaccacgcagggcctgatcgagcagatgatcaaggacaacggctttagctgcaagcccgagtttagggcctttagtggctaccccatcatcaagagttcgctcgacgccggcaatatcgatgtctttgccatggaccgctccacgctggccggttacatgaacgagaccgttgagctgctgcagcccgaggtcaagtttggcgagcagggctacggtgtggcgaccaagaagggctgcgacctttcggccgtggtcgatcaggtgatttgcgatcgcctggccgatggctggctcgaccaagaggtcaagacctggggtcttgtataggcgcatcgtccaaggaaggaatcaaatgctcgaaggattatttgacgccgaccgttggtcgacgacatttcaaaacatggggcccttctgggagggctttggcgtgacgctgcaggtggtcgttgccggtctgctgctgtcgctggtgctgggcacgctgctgggcgtgttctctaccactcgctcgcgcgtgctgcgcgccataagccgcgtgtacgtggagttttaccagaacaccccgttgcccgtgcaggtgctctttatgtacatggccggtccgcagtttttgcaggccataaccggtgccgaccagccggtgcgcattgcgccgttcgtgctgggcttcttgggtgtgggtctgtatcacgcagcctacatttcggaggtcatccgcaccggtatcgaggcggttccgcgcggtcagatggaggcggcccagagccagggcttcacccgtgcgcaggcatactggtacatcgtgctgccccagacattcaagatcattctgccgccgctgtgtaaccaggcgctcaacctggtcaagaacacgtcggtgctggcgctcgtggccggcggcgaccttatgtaccgttccgacaactttgtgagtctgtacggttacctgcagggatacatcgtctgctgccttatgtacttcatcatctgctttccgctcgccatgctggtgcagtggctcgagcgccgctccaaggagcgtccgcgcggcgtgagcctggccgagctggggctcgacaacgtagaggaggcctagcgcatggaaatctttaacgcgaccaacctgctctacatttggggcggctttgttaagacaatcgagatctcggcgctgtcgatctttttctcgctcatctttggcacggtgttggcgctcgttaagagctatgcgccccgcccgttccgtattttggtgagcgcctatatcgagctgttccgttgcacgccgaacctgctgtggatcctgtttatctactttacggtgcagggtttggacattgtgatttcgaccatcgcctttacgctgtttaccagcgctgttatggccgagattgtgcgcggcggcctcaactcgattccgcgcggccagtttgaggcagcgcagagccagggcttcggcttctttgccaccatgcgctacatcattctgccgcagacgtttaagacgatcattccggcgctgtttagccaatgcacgaccgtcatcaaggacagctcgtatctttcgggcattaacgtggccgagctcatgtacacggcaaacgtcgtgatggcgcatgcgatcgacctgtcgcaggtgcttatgctctacggcctggtgtttgcgatgtactttgcactcaactttggcatttcgctgctggtccgtgcgtatcaacgtcgagtcgtagccgcatagtcctgcttccccaagcacggcaccttgcccctcaatcgtcgcttgcgtacatttagtacgcggcgctcctctttcgggacaatctgccgcacttgggaaaccaggacggtcgtaagtgacaaaatgagaaacgaggacagcctttttctcatttgttagaaaggattcgcgatgagcgatctggtgaacaagaagagccctgtggtcattaccatcgcgcatgactttggtgccgagggccacgagattggccgtatcctcgccaacgagctggggattccgctgtacgacaacgagctgctggtgcgcgcgtcgctgcgcgcgggtgagtcgctcgataagatggcggcctacgacgagcgcctggccgtggagaacatggcgtttctgcccgaccgttacgatgcccgttcgtactcggacaaacttttccaaaaaatgagccaggtgattttggacctgggcgagaccgagagctgcattatcgagggtcgcctgtccgattatctgctgcgcaacaaccccaaccacattgccgtgctggtgactgccccctttgaggaccgcgtcgagatcgttcgcaagaagcgtggcctcaacaaaaagaagggtgccaagctggtcaagcaacagcagaaggcgcgtgaggcgttttacaagcgctacagcgccggcaagtggaagatgacgagcggcaaggacatcgtcgtcaaccgcgccaagctgggccgcgagggctgcaaagatgtcatcgccgcagcctaccgctacaagctggcgcggctcgaaggctagtcgaccgaaaccaccacaaaggggacaggcacctttgtggtggtttttgttttaggctgagggaaaggctttggtgaggccggcgcgcgtttgcgtgtcggtcttttggtagatggagctcaggtggcgctgcaccatgcgcatcgagatgccgagctcctcggcgatctgtttgagcgggcgctcgtcttgggttacggcgaacagcacgtcgacctcgcgtggggtgagagcgtgatcggtgatgaaggctcggcgctgttcctcgatgctgggtgctgcgagtgcctcctcggctcgttgctggtgttcgcgctcctgctcggtttggggcaggcggaacaggccggcggcaacgaacgcaacactcgccgccacaagcagcatgagcgcgccgatcatgatgagggcaacattgcccgaggcaaccagtgccagcgagacgcccgacgtagtgaacgcgcacacgttgttggctgcgcgacccatgccggcccacagggcgggtgcatgcatgcgcggtgccagctgtgtaaacgtggcggtaaagaacgtgacgaaaaagcccgagctcaggtaaaagacgacgaggcctaagttgaggtcggcgccggcttccacagccaaaatcgaaatggtggagagcaccgtgacaccgagcatgacgagtcccatgtagcggcgctcggcaaggtcaaagacgatgccggcgacgagaccgctcgctgccaaaaagaggcgtggccaggtctgcaccgcaatggtgccgtgggcgttggaaaacgtgacgacgttatcgagcgtcgagaacaggcaggcgagaatcatgacgagcgcaatgctccagcatgcctgcttggcgagggcgtgcgagggctcggtaaagggattggcaaggtcgccggagctcttggcggccttttggggagcggcgctgagggcggcgatgacaattgtcgccgcgccaagaatgatgagctcgacgatgccgccgcaatcaatcaggttagtggcaaactgcatcaggatgccggcggcataggccgctcctgcgccggtagcgagcttggggtcgtcttggaacgtcatcgcgaaggtatgatgtgccgcggcacccagcaggccgagtccgaggaatgacgtgcaccccagaatctcgagcgcaagcgtgcccgcggggaactgaatctgggtcaatcccaagatggcgatggggacggcagcggtggcgattgcctggggctgccttttgcgccggcagatggcccgcatgcgaatttgtaccccgggacccggataacttttcgtaacatggtgttacagaagcacccctttcgacaaggaggttcacatgcaaaagcaaatccatgacagttcaatcaaccgcggccgcgcatgctcgctctcccacggaacgtggcgtcgcgtgggcgccaagctcgcctgtgcaggggcctgcgtgctcatggccggtcagctgctactgccgagtgtggcgctcgccgccgagtgggtcaacgtgggcggcacgcagtacaacaggggcacggccgccggcgacgaggcgggaacctggtcctgggacggtggcgacgacatgaagctcaacggctacgacggcgccggcatcagtgctcagggcaacctcaatatcggcgtgacgggcaataacaccatcacggccgatgccggtcagaacgctattgctgttaaaaacggcaacctcgccattaccggcgacggcacccttaatgcgacggctcagaacgatgttattgcggcggaaggcgacggcaatgtcggcggcgatgtgaccatcagcggcaccagcgtcaacgtgacggcttcgggtacatcggatcatgtgacgggcattcgcgcgacggccggcagcgtgacgatcgataagggcgccgatgtcaaaatcgaggcgaaatcggcggaaggatcttggcgtccaatgcagagcatctacggtatctttgccgataacattcccaacagacacactgctcaggaaggcgagcaggaagagccggattcctcttacgagcgcggtgccgatgtcaccatcgatgacgccaatctgtcgattaagactgccgatgccccgtgggcttccgcgtgcatttatacggtcggtatcaagaagaataccttcatgaaaatcgttaacggagccgatgtcgtgctttccgccggtagtgcggcctcgttctcggcgggcatcggcgcacgctcgcaagacggtgcggtgtggatgcttgtcgagaagtcgaatcttacgtctcgaagtctatctgccgcaagcagcatcgatgccgcccgcaatcaaagttttggaatcatggcagaggcaaacaccaggtcggaaacgcctcgtatccagattttcaactcgaagatcgaggcttcgggtgcgactgcgggaatctatgcgatcaaccgcaacgtcgtgaatgcgacactgttccatgccgcgatgattgatttgcgaggaaatgcgacgattacgactccgacggatggtgccgttcgcgatgtgaaaaaggttgtcgatacagggcaatggctgagttcccagaacgggcaggtcatcggtgttgccggttcgtctgcgatttcggatatcgtcggttctgccgaggttgcccatgatgtggtgattaattttggggacgggcaggagccggaaccagcgccggaccccgagccgactccggaccccgatcccatgcccaatcccgagcagaagcctgacctcaagcccgtagataaggacgcaaagaccaccatgaccgttgcgaccaagactgctgccggcgccaaaagcgcttccggtgttctggccgccacgggcgacaacgccgcgacggccgcagccgcccttggtatcgccggtgcgtccgtcattggcgccggcttcgtcgcgtccaagcgccgcaagcgctagattttggtggctgccctcggcctcgtcctcagcaaaatctcaatctataacacgtagctgctcaaaacggtcctagatgttacagattgagatgaaccgtctgactgccaacctaatgtctcgatctgtaacaccaaacgagtaatttgggttccagatgttacagattgagacaagctggcgagtgtcggaacaacgtctcgatctgtaacacgtggcgggagatttggcctcttactgttatagatcaagatgaacgggcgaagcgccgacataatgtctcgatctgtaacatctacggggatcagcagggtctacctgttacagatcgagacaaaacggtcggccgagtctaaaaccaccacaaaggtgcctgtcccctttgtggtggtttgggcgagcggtatagaaaaagtccccgccgggcgtgtgctcgacggggactttgccgtttgatggctagcgctgcgggtgattactcgcccagcaggctcttggtgatggaagcggcggccttcttgccggcgcccatcgccagaatgaccgtagcggcaccggtgacgatgtcgccgccggcccagatgcgaggatcggtggtctggccggtctcctcgtcggcgacgatgtagccccacttgttgagctccatcttgccgccgatcttggcggcgaaggggttggcgttggtgccgatagccgagatcgcgacgtcgcaggggatctcctcgatggcgccctcgatggcaaccggacgacggcggccggactcgtcgggctcgccgagctccatcttctggaccttgacggcgcacacggtgccgtcctcgccagcgacaaactcgagcggggagacgagcggcagaacctcgacgccctcggccttggcgtgatgcagctcggcgcgacggcagggcatctcgtcctcggtacggcggtaggcgatgatggcgtgctcggcgcccaggcgcttggcggtacggacggcgtccatagccacgttgccgccaccaaagacgacgacgttcttgccgtgcttggtgggggtgtcgtactcggggaacttgttggccttcatcaggttcacgcgggtgaggtactcgtttgcgaagaagacgttgggcaggttctcgccggggacgttgaggaacttgggcaggccagcgccggtcgccacgtagatggcgtcgaagccctgctcgaacagctcctcggccgtggccatgttgcccacgacggagttgtactcaaacttgacgcccatgtcctccaagccgtcaatctcgcgcttgacgactgccttgggcagacggaactcggggatgccgtagaccagcacgccgccaccggtgaagaatgcctcgaagacggtaacgtcaaagccgttacgggcgagctcgccggcgcaggtgatgccggacgggccggagccgacgacggcgaccttcttgccgttcttgggggccatcttgggcgtggaggcgagttcggggcggtcacccaggaagcgctcgagctggccgatggccacgggctcggacttcttaccacggatgcacttgccctcgcactggttctcctgcgggcagacgcggccgcagatggcgggaagcatggagtcctcgcggatggtatcgagagcgccgccgaagtccttcgcgcggatctgctcgataaagcggggaatgttgatgttgacggggcagccctcaacacagaacggcttcttgcagttgaggcagcgctcggcctcggccagcgccatctcctcggtgaagcccttgtcgacggggcggaagtcgcaggcgcgctcggcagccggctcctcgttatcgggggtgcggggcgacttcatatcggcaacgaaacgaccgttaactagtggcatgcgcagctcttttcctcataggccttgagggactcgccctcttcggaacggtaagcggcctggcgggcacgaaggtcatcccagtcgaccagggtggcatcgaagtcggggccgtcgacgcaagcgaacttggtcacgccgcccacctcgacgcggcagcagccgcacatgccggtgccgtcaaccatgatggggttgagcgacgcggtgatgggggtgtcgtacttctgggcggtgagggttgagaacttcatcatcggaacggggccgacgcagaagacctggctcacggccttgtcctgcagcaggcgctccagcggagcggtgacaacgccctgctcgccgtaggaaccgtcatcggtagtgatgtggatgtggtcctcgtcgaggagctcgcggaactggtcctccatgagcaggaggtccttggtgcgggcgcccatgatggcgtgcacctcgtgaccggtctcgaccaggtgcttggcgaccgggaaggcaattgccaggccgacgccgccgccaatgacagcgcaggggccctcggccatctcggtaggaacgcccagcgggcccacgacgtcgcgcagcgactcgccggcctcgtaggtggacagcatctcggtggtctttccgatcaccatgaagatgaactcgacccagccctcgtcaccgttccagccggccagggtaaacgggacgcgctcgcccgtctcgttggcgcggaccatgaggaactgtccagcgtgcgcatgcttggcgattgcaggcgcctcgatgcggaacttgaacaccttctccgagaactgcgtcttctccaggatcttatacatagaacccctctcttgttagggccgccgaaccgtgcctccacggaaatggacggtagcccgaataaaaccgtacgcgcacaggcgttgtgcagacatacggtgcaaattataccctcatggacatgtcgcttacgtgtgtctttggcaggcgggaaaagtgacctgccatttagggacaggtttattttggcaggttttatcaggcaaaacggcaaagggggccggcctcgcgcatcggtgaggccggccccctttggagcgttgtgtatgcatggcggtgcggcgtctattgcgatgcggacaccggggcgtttccgtagataaaacccgccaaaataaacctgtccctttttggcaggttttagtgcttgccgttggcagaggcggcgccgttgacatggtcgcgggcatagaccacgccgtgcacgatggcgagacccgcggcgtcggccgcgcgggtgcaggtgtcctggaagtcctcggcctcgcgggtgcgcagccgcttgagcacgtagtcggccacggccatcttgccgggagggttgccgatgccggtgcggatgcgactaaagtcgcggctgcccatcttgtcgatgatggagcgcaggccgttgtggccggcgtggccgccgcccaccttaacgcgtacgtcgccggcgggaatgtcgagctcatcatggatcacgagcagctcctcggccttgatcttgtactcgcggcagagcttggagatggggccacccgaggtattcatatacgactgcggcttgaccagcacaatctggcgcttcccgccctcttcctcgggatcgttgatgttgatgagcgcgacctcggcgcctgcctggtttttccagtacgtgacaccggcctgacgggccaactcgtcgattgctttgaagccagcgttgtggcgggtctcggcatattcctcgccagggttgccaagtccggcaaccatgcgaattttaagcggctgtgcagctgccatatttgtcccttcgttacacaaatagttcaatcaacgacaaaggctaccacgcccgccgaaggcgaggaaaggttgcagcaaagtcatttcagaaaacagctgcccctagacagcaggaagccccggacacgccgggaggggttatcaaagcgaacatcccgcagccgcaaagcggcgaggacgttcgcgtgataaccccgcaggcgtgaccggggcttccggagggatgcgagggtcgagcgactacagcgcgaagtcgccgccgacgagcgtggagacgggctcctcgtggtaaacggcggagatggcctgagcgaactcctcggcgaccgagatggtcttgatcttaccgccgacctcgacgggaatggcgtcggtgacgaggcactcgacgatcggggcgtcgttcagacgctcgatggccggaccggagaagatgccgtgggtggcgcagacgtagatgtcgccagcgcccatagccttgagctccttgacgttggcgcacagggtgccagcggtgtcgatcatgtcgtcgttgatgatgcaggtcttgcccttgatgtcaccgatgatgcccatgacctcggcggcgttgtggcgcggacggcccttgtgggcgatggccaggtcgcagccgagcatgtcggacagcttcttggcggccttggcacgacccacgtcgggggagacgacaaccaggttgtcggtgtcgaagtgcatgttgttgtagtactggccaaacagcggcagcgcggacaggtggttaaccgggatatcaaagaagccctggatctggccctggtgcaggtcgagggtgatgatgcggttgacgccggcgcgctcgagcaggttggcgacgaggcgggcggtgatgggctcgcgcgggccggccttgcggtcctggcgggcatagccgtagtgggtgataacggcggtgatggagcgggcggatgcgcgcttggcagcgtcggtggcgatgagcagctccatgagcatgtcgttaacgttgccgccggccacggactgaatcaggaagacgtcggcgccgcggacggtctcgtcgtagcgggcgtaaatctcaccattggcgaactgctttagcgtaaggcccgaaagctcgaccccaaggtactcagcaatcttctgagcgaggggacggttggaggaaccggaatacacgcggatggacttgcgcatattctccgacttctcgggatcattaatcggcattacccttctcctttatatcgaatgccatatagatgccttgttgcattgtaaccgcgcggcggggtttatcgagtcttgataacgtctttaccgtcaacggacacgaaccgaccactcatccggccacgcaggtcagcatagaaaaaggagccgtcccccatgggaacagctccttagatgcttggtaaaacgttatacctcgtcgtcctcgtgcagacggcggcgataatcggcggcccagccctcaatatttacctgacgggcgcggcccagtccgagcgcgtctgccgggaccggctcggtgatgacggagccggcggccacgagcgcgccgtcgccaatttgggcgggcgcgaccatcatggtgtcggagccgatgaaggcatccttgccgataacggtcttgtgcttgtggacgccgtcgtagttgcaggtgatggagcccgcgcctacgttgacgccggagcccatggtggtgtcgccgatgtaggacaggtggggcaccttggaaccctcgccgatcgtggacttcttgatctccacgtgcgtgccggccttggaaccgtcgagcatatgggtacccgggcgcaggtaggcgcgcgggccgcagtcgacgccgttctcgatgacggcctcgatggcgatggtctcatcgatggtgcagccgctgccgacggtggtgtcggtgaggcggctgttggggccgagctggcactcttcgcccacggtgacgcggccgatcaggtgcgtctgcggccacacgacggtgtcgcggccgatggtggcgtcggggccgatccaggcctgcgtggggtcgatgaaggtaacgccctcggccatccagtgctcgttgatgcggtcgcgcgcgatggcggtgagctgtgcgagctggatgcggctgttgacgcccaagccgtcgcggtagtcgtcacagtggaagatggagaccgcctggccgtgacccttgaggatttcgagcatgtcgggcaggtagtactcggactgcgcgttgtcgttgccgatctcgttgatgtgtgcggcgagctgcgcgccgtcgaaggcgtagcagccggcgttgcactcgagcagcgtggcggcctgctcgggcgtgcagtccttctgctcgatgatgcgctcgatctgaccatcggcgcccagcttgatgcggccgtagccgaaaggatcgggcggggtcatggtcatgacggtgcaggcgagctcgccggtagcgacggtctgcgcgaacttggcgacggtgtcggcggtgatgagcggcaagtcgccgttgagcacgacgacggggccttgcgtgatgccgcaggcctcgagcgcgaccttcacggcgtgaccggtgcccaggcgctcagtctgctcgacgcactcgaccttggtggcgctgttggcgtaggcgccgtcgataagggcgcgcatctcgtcggcgtggctgccgatgacgaccacgacgcggctgcagccggccttgatggtggcgtcgacgatccactgaaccatgggcttacccaggatcttgtgcgaaaccttgcagtggttcgacttcatgcgggtgccctcgccggcagcgaggataattgcggttgcgtccatgtgatctcctgttacgttatagagacgtgtgtttggaaacgatacacggcgcaatatgataccgcaggcatatgttgagcgcgtagcgattggctcatggcggccgatgtcggtgccgccggcgtggcgtttgcgctgcttgcgtgcggcgttggcggtgctgcggagctgtcgtttgagcgaggggacgggggtgcccgtggacaacatacaagaggagtttggcggcgagcccgtcgcggcattctcgatgtcgcatccggctgtgccggccctctacatggtgctgacgctggggctcaccatgttctcgatgcagccggtgctgattgcgctgtcacttgcgggcgggctggcgtatggatttgcgacgcgcggggctgcccgcacgctgggcgcactccgctggcagctgccggtgattttgattatcgcgctggtcaatccgctgtttagcgcctcgggctcgacggagctgttccgtattggcatgcgcgcggtgtatctggaaagcatggtatacggcctgtgcatgggcgggctgtttgtggcgagcgtgctgtggtttgaggccgcggcgtcgatgctcgaatacgacaaggtgctcgcgctgctgggcaatgccgcaccggtgattgcgctcatgatctcgatgtgcatgaggcttatcccgcagtttttacgccgcggtcgtacggtgctggcggtgcaggatgcgattgatgtgccgggccgcgcgcccaccgatcccgtgcgatcgcgcctgcgggcgtcgagcgtgttgatgggctggggcatggaagattcgctggagcgtgcggacgccatgcgctcccgtgggtggggcgccgcgacgcgtcgaacgacgtatgcgcggtatcggctggggcgcggcgatgttgccgcgctggttggacttgcgctgtttggcatggccacgacggcagtggcgtggactgcgacgatgcagtattcgttttacccgcaactatcggtgccggcgccgtggctgggctatgtcgtgtacgctgcctggatgatgctgccttgcgcgtcgcacgcgattgatgagaagaggtttggctgatggctcggttggataggagctcggcggcgggtgtggcatatggctcggccgcgccggcgattgaggtgcgaggccttagttttgcctatcccggggccgaggcaccggtgctcgaggggcttgattggcgtgtttcccaaggtgcgtttgcactgcttgttggcggtaccggttcgggcaagtcgacgctgctgtcgctgctcaagcccgagatcgcgccggcgggtacgcgctccggcgagctgcgcgtgctgggcgagcccgtcgccgacatggatgtgcgggcatcggcggagcgcgtgggctatgtgttccaggatcccgagaaccagatcgtgtgcgaaaccgtgtggcacgagatggcgtttggcctggaaaacttggggctagcacgtgatgagatgcgccgtcgcgtagctgagaccagctatttctttgggctggaagattggcttcaccgcgatactgacacgctttcgggtggtcgcaaacagttgctgtcgttggcggccgttctggcgttgcgcccgcgcgtgctgctgctcgacgagcccacgtctcagcttgatccggttgcggagaagaatttcctgcacgcgctgtttcgtgtgaatcgcgagctgggctgcacggttgttgtggcgacgcatcagccgcggccgatgctcgagtatgcgacgtgtacgcaccggattgagggcggtcgcgtgcgcgaggtggcggatatgtcttctttgggacgccgagaatcgctgttttccgatgacatgttggggtggggtgccatccgatgtgcaaaaaacggagtattcagcaggcgtgaggacaatttgggttctctggagccgcccggggacgtatcgagcgcgaaaaaaagttcggaattggacaaatcgtccgaatttgtggcgcaaacgtcgctcgagaacggctcggaagccttctcgcgcacggatggaagcagaatactccaaaaaatgcacggcgggtcggctaccaccctgtcggaaggctggtttcgctacgatcgagcgtccggctgggtgttgcgtgggctcgatgcgtcgttttcggccggtgcggtgcatgcggttgttggcggtaacggctgcggcaagtcgacgatgctctcggtgctggcgaagaccgccaagctgcagcgcggccgcatggtgcgcggagcggcctcggcggcgctgctgcctcagaatcccaaagcattgctggttgccgagacggttcgcgatgagctgatggaatgggcctcgacctgcggatatgacgagaacttggcgcgggagcgtgcggcgagcttggggttgtcgggtctggatggacgccatccgtacgatctttcgggcgggcagcgtcaactgcttgcattggcaaaactgctgctaatcggccccgaactgctattgctcgatgagcccaccaagggtctagacctgttcagccgccgcatcattgcccgcgccctgcgtgaccatgcgaaggctggcggcaccgtcatcatggctacgcacgatttggactttgccgagcaggtagccgacgacgtcgtcatgatgtttgacggcgagattgcctgcatggagccgccggccgacttctttgccgataacgtgttttatagggcgtgatgggatgacggattatcgcgtcgcgcgcttgcttgcaaaactggaggtcccgctgttgttggcggtgccggcggtgatggctgccgcgttgctgtcgggtgttgagcaggcagcattggccatgctggttgtggtggcgctggtgctcgcgctgttctttgcgggttacgaggcgtctcgtccgggtttgcgccagattatgcccacgctggttctggcagcattggccgcggcggggcgcatcttgtttggccccattcccgactttaaacccgtgagtgccatcgccattatcgcgggggcgacgcttggtcgccgcaatggttttatggtcggtgcgttggcggcgctgaccagcaatttcttttttgggcagggcatgtggacgccgtggcagatgtatgcctgggggctcgtgggatacgttggcggtgcgctggcgcatgccggcgcttttgatcgcgccgatggcaccgtgcgtatgccggcgctgctgacctacggctttgcttcgggtttgctgtacggcgttgtgatcaacgcctacgacattatcggttttgttcaaccgctcacgtgggcgggtgccatggcacgtcttgccacggcagtgccgttcgatatcacacacggcctcgcgacctgcgtgttcttggctgccttgtacaagccttggtgccgtcgcattaaccgtgtcgtcgtgaaatacgggctgtaaggcatttcgcgttccctcacgagcttgcggtggaatggttctcgtttttggctatttgctgcccaaacaggaactattccaccgcaccttatagagggagaggggtcacatgatctgttttcctctgtcccctagaggaattacttggggctagagctctagcgtgagggtgacggggcagtggtcgctgccaaagatgtcgccgcggatgccggtgtcgcgaacgttggcggcgatcgaatcgcttaccagaaagtaatcgatgcgccagccggcgttgttcttgcgggcattaaagcgatagctccaccagctgtagacgccctcgacgtcggggtttgccgcgcgccaggtatcggtaaagccggcgttgagcagctcggtaaacttgccgcgttcctcgtccgaaaagcctgcgttgccgcggttggacttggggttcttaaggtcgatctcctcatgcgccacgttaaagtcgccgcaggttacgacgggtttgccggtctcgcgctcgagcgcgttcaaaaagccgcggtaggcatcgtcccaggccatacgcacgtcgatgcgcgcgagctcattttgtgcgttgggcgtgtagacatccacaaaccagaatttgtcgaactcgagcgcgcagacgcggccctcggttgcgacttgggcgacgagcacggccgcctcgcctccgccggcgtagggcagcagcgcatcggcgcgcagtacgcgcagcggctcctggcggctaaagaccgcggtgcccgaatagcctttacgctcggcgtagctccaggtttggtgatagccgggcaggtcaatatcgacctggccttcttgcaacttggtctcttgcagtgccaggatatcgacgtcgagttcttgcgcgatctggataaagctcgggtcctttttgagcacggcgcgcaggccgttgacgttccacgaggcgaaagtgtaagtctgaggcatggtgtcctttcgacggggttggcaggcttaagattagcgcaacaggggcggggtgggatccgcgcatgctgacttaaaggccgcatgctgggacgtcgctcaacgctgcccgactaacaaggacggaggactcatatgacgcaggcaatatcggaccccaggcaggcctccgccgcgctggcggatctgtttgacacccacaagcgcgtggtcttctttggcggcgctggtgtttccacggcaagtggcatccccgatttccgcagcgtgggcggcctgtatcaccagcagtttgcctatccgcccgagaccatgctgtcgcatagcttttacgaggcgcatccggccgagttcttcgacttctaccgcaccaagatgatcgcgcttggcgccaagcccaatcgctgccacaccaagctggccgagctggagcgcgccggcaagctgaatgccgtggtgacgcaaaatatcgacggcctgcatcagatggccggctcgcagcgcgtgttcgagctgcatggctcggtccaccgcaatgtctgccagacgtgcggcgcagtctacagcgccgaatggatttgctcgcgcgagcacgaggacgccgcgggcgtgcccgtgtgtcctgcgtgcggcgggcgcattaagcccgatgtggtgctctacgaagagccgctcgacgagcatgtgttgaccggtgccgttgccgccatcgccgcggccgatgccctcatcgtgggcgggacctcgctcgtggtgtatccggcggcgggccttacgcgttactttaccggcgatacgctggccatttgcaaccttgctcccaccgatcaggatgcaaatgccgacctgctgatttcttgcgacatcgcggccgcgtttgcgttctagcccgcgcgcgcggatacaatagaaagactgagtgcaaagcgaccccgccgccagctccccaagctcggcggcgtgggcattttaggaggatgttcatggcgaacgacagcaagacatggcggtgcggaaagtacgagctcagctttgaccgtccgcgcatcatgggcgtcctcaacgtgacgcccgattcgtttagcgatggcggggagcacttcgacccggatgctgccatcgagtacggcctggcgatgctcgacgccggcgccgacatcatcgacgtgggcggcgagtccacgcgccccggctttaccccggtcaaccccgacgaggaggctcgccgcgtgctgcccgtggtgcgcgcgctggccaaggagggcgccatcgtctcgatcgacacgcgtcatgtggcggttgccaaggcggccgtgcgctgcggcgcctcgatcgtcaacgacgtgaccggcttcaccgatcccaagatggtcgagtttgttaagacgagcacctgcggcgtcatcgtgatgcatgccggcgaggtcgccgcgcccacccgcacgcacgcaacggtgcagctcgatacctcggcagcggcgtttgttgccgagaaggcgcgcgaggcggctgccgaggccgcgcgtgaggccgagaagccggctcgccgccgtcgcggcaagctgctgggtgagcccaaggttgaggccaagcttccgggcggcgtggtgcagccctcgttgccgtttggcgaaccggagcccacgtccgagcccgcaaccgagctggggcaggagacgccggccgccgagcaggttgctgccgccgagaccgtcgcgcccgcgcccgaggccgcgcccgcagccaccgaggtcgcatcggagtccaatgaccacctggcagccatgatgcgccgcagcgcccgccgcgaggaagcctacgtgcccacctcgcagctccgccgcttcaccctgcccgattcggcgcccatcatgcgccgcgttatgggctttctgtccgaccaggcccgcacgctcatccatgccggcgtgtctcgcgaccgcatctgcatcgatcctggcccgggctttggtaagtcggctaacgaggacatcgtcatccagcgcgagactgccaagatggcgtcgctgggctacccgctcatgtgcgccgtgtcgcgcaagcgctttgtgggcgctgtctcgggcgtgaccgaggccgccgcgcgcgatgccgccacgtttggcgtgtgcctgggcgccatccaggccggtgccaacatcgtgcgcgtgcacgacgccgcgggttttgcgcagttcctgaacggttactgggccgtcgccaagccgcagccgcgccgtgcgtttgtggccgtgggctccaacctggggcatcgttgcgacaacatccgcgccgcgcgcgacatgatcgccgagattccgctcacctgcgtgtccaactcctccaagatctacgagagcgagccggcctacgagacgcgccaggacgcgtttgccaacgctgtcatcgagattaagaccgagctggcgccgttggtgctgctcgacgagctcatgaagatcgaggtcgagctggggcgcgaccgctccaaaaaggtcaaggtcaacggcccgcgcaccatcgacctggacctgctgtggatggacggcgagacccacggcggcaaaaagctgcgcctgccgcatccgctcattggcgagcgcgactttgtgctggtgccgctcgaggacctgatgcacgacccggcgcggttcttccgctacaacggcgtcgaggtcaaggagcccgaggaccgcgtgggtcatatcgtgggcgaattggggcgtatgtagatgatcgagatgaatgctgttgccgccggcaccgagctcgacgcggcgcgcgacgcgggccgcgagggcgtgtccgcgggctggtgcgcgtggagcgcgggcgatgcttcgctgacgttttcgctggtcgtgcgtccggatgtgaacatgcatgccttccacggcctgccgtttgtggccgcgatgggcatgatggacgcgctcgtgggcacggcttcgacgccggggttgggccttgccggtaaggtgggtatccagtggccgagcgatatcgtgtgcggtgcgcctgcgtttgagacgtcgctcgcgcgtgttgccgtgaacggcggtgccggtgctgcgggcatgttcggtgccgtgacggtggatattgagcgttcggcgttgagcgagctcggtgtgggtgtggctgacgaagcgctggtcgaggcgctggccgccgccatgctggcccgcgtggacgcctgggcggttgttgccaacacgccgcaaggcgccgcggggccgctggctcccgtgctgggcgagtacttcgacatggtgccgctgctgggccgccaagttgcggcggtgtcgcccaacggtttgccgcttgcggtcggtgtgtttgcgggcctggacatctggggccgagcgaccatcaagaccgatgccggcgagcaggagtttccgcccgaggctgtacgaattcgcggactgtagcgtctcggcttcgccagagcctacgctaactcctgcatgcggcggtagatttcgcagatgcctttgatggtgagttggccgtcgactatgtcgaaggcgtcggtcgaatcggcgacgatgctggcgaggccgcccgtggcgataacggtggcatcctcgcggcccagctcgcgcttcatgcgcgcgaccaggccctcagccatggcggcggcgcccgttacggcgccgaccttgatgcactcctcggtatcgcggccgatggcgtgctcgggcgcctcgagcggcacgctggcgagcttggcggcacgggcggcaagcgcgtccatggagatgcgaatgcccggcgcgatcgctccgccaatgtaataaccgtcctcatcgatgacgtcgatattggtcgcggtgccaaagtccaccacgatcgccggcgcgccatagaaggtctcggcagcgacggcgttggcgatgcggtcggcaccaacggcctgggggcgcgccgcccgcagcttggttacggcggccgtctgcggcccgatgacgatggcgtccgcggcaatgcggtcggccacggcgtgccactcgcgcgagagctgcggcaccacgcccgcaaaggcgatcgcgtcgaccgcatcgagcgaaaggccgtacatcttaaagaaacccatcaggcgcacatggatctcgtcggcggtataggagcggtcggtgggcatgcgccacgactgcaccagctcgtctccgtcaaacaggcccatggccgtctgcgtgtttcccatatcgatagcgagcagcatgtctactcccggtgttggcataaaaggacgcgcaccattgtatacgcgccgccgacggcgctcggctgcgattcgtttacggtgataggggctgaggggtttaaatatgaaggaattatgctctacgagattttccttgccgtttaccgaactcccgcgtaatattctttcttgcgcacatgaggcgcccagacattgcggggtggagcagtctggtagctcgccgggctcataacccggaggtcgtaggttcaaatcctgcccccgcgaccaagaacttgcagctcgtcggcctagccggcgagcttttttgttatttcgggaccgtgttttcggtccaattctcggcctctcaaacaaaatctcgatctgtaacatctagacccgatttgggcggctaggtgttacagaccgagatataccggtgggttgggtcgtgtttgtctaaatctgtaacacgagggacggattttgccgagttgttgttatagattgagattttctagcaggcgggtttggtttgtctcgatctgtaacagtaagacccggttttgccgcgtaactgttacagattgagataaaccgacgggccgccccgcccatccccatccacctgctgccacctgatattcgccgatttccgttgcgctgttgtattcccatgccatatcctctagataactacgcggcatcatcgccgccgcgcctacaagagaggaatgtccatgaccacacctgcatccaagctgctccagcccattacggttggcccccttgagctcaagaaccgcattatgtttccgccgctgaccaccggctacgaggagcgtgacggttccatcggcgagcgcagcctggctttttacgagcgcttggcccgtggcggcgtgagctacatcgtcatcggcgacgtcgctcccgtcatgaccgcaagccccacgcccaagctggcaaccgacgcccagatccccacgtttaaggcgctggccgacgccgtccacaaacacggcgccaaggtcgcgctgcagctgttccaccccgagtacgacgtgcccggtgtcggccgcatggtcatgggatccatggctgccgccaaggccgcgcaggaggccaaggccgccggcgacgaggagacctttgccgccaagatggccgagtccaacgagatccgcaaccaggcctacgccaagctgcatcacgacatgcagcactttgtgaacgaggcgagcgtagagcagctcacccagattaaggaggccatcgctgcctcggccgctcgcgcacagcaggccggcatcgacgccatcgaggtccacggcgaccgcttggtgggttcgctgtgctcggccatcctcaaccagcgcaccgacgagtacggtggttcgttcgagaaccgcgttcgctacgcgctggaggtcgtcgctgccattaaggaagccgcgccgcagctgatggtggagtacaaactccccgtgattatggagaaccccgacggcacgccgcgcggcaagggcggcctgcagcccgacgaggcctgcgagtttgccaagctgcttgagggcgcgggcatcgacatgatccaggtcgcacaggccaaccacaccggcaacatgggcgacaccattccgcccatgggcgccatgccctacaactggacgctgcccgtggccgagcgcgtcaaggccctggtctccgtgccggtggcaaccgtgggccgtgttgtctcggtcgaggccggcgagaagattctggaagacggcgcggccgacatcatcgcctacggccgctcgctcatgtgcgaccccgacattgcgctgaaggccgccacgggtgagcccatccgcgagtgcctcaactgcaacaagggttgcgtcgacgcgattcaaaaccgcaagtacatttcgtgtgtgctcaacgccgagaacggcgacgaggcgaccatcgccattaagccgggcgagggcgacaagaagattgccgtggtgggcggcggcatcgccggcctggaggccgcgcgcgtggcggccaagcgcggctacgacgtgaccgtctacgaggcgagcgaccatctgggcggccagattgtgctggcggccgcgcccccgcgcaaggacgagatcatgcgctcggtcgagtattacgagaagattctgcccggtctgggtgtgaaggttgagctcaaccatgccgctaccgctgaggacctcaacgccgccgacgccgcgattgtggctgtgggcgcacacgacgtggtcattcccgttccgggcgccgattcggacaaggtcgtctcgagctgggacgtgctggccggcaaggtggagcttacgggccgcgtcgccgtcattggcggtggcctggtgggcaccgagactgccgagtacctgctgcagcacggctgcgaggtggcgatcgtggagatgctcgacaagattgccgcgggcgagtccgagaccattctgccgctgatcatgagcgactttgccgagcacaacgtggagcagcacgtgaagacccgcctgaccgccattaccgacgagggcgtggaggctgttcgcaccaccgaggacggcgccgaggagccggtgaagatcgcctgcgattacgtggtgatggccgtgggctccaaggccaacgcgtttgacctggatggcgtgacggtgcccgtgacctgcgtgggcgactgctcgggtgagcgcaccgccgacattgcgagcgccattcgcacggcgtatcacgcggccaacgagctgtagttgaacatcgcggccaggcggggcggtagcacggatccgtctcgcccggctgtgccccgtcgggtgtcaaccggtgcggggcctgcaagcgcagcaggtcccgccctttttgttttgctccggtggatggcaatgcgcggtaaccatgaggagtgaggacgtctactgcctcgcagatcactcaaaattattgggggaggggttaataactatatcctctatatcaaaggacataaagagatgccaattttgttgacaagcgaatgacgattagctgcgagtcagctaccagcgtaaataatcgataaagaaatgtcgtaatttggtgccaaatgcccagataacgccgcgtctattttaattaactgctttgagcaaacagtaaaatgctactatctaacttgcacgtaagaaagcagattaacggttaaggctaagaagtggcaggtatgtcggaagcaactaggactcgcacgcatgcgcccgaggttaggcagcgcgccgtcgagatcctccaagagggggtcggtcatcgcgccctcgccgcggagcttggcattccccaggccacggctcgtcagtgggcccgcgcgtatgccgtgggcggtgccgacgccgttctcaacgccggttcgcatcatcacacctattcgtacgaagttaagctcgccgtggtcaaggaccgcttggaaaacggcttaacggttcgcgaggccatgatcaaacacaagattccaagcgagtcttcggttaaggcctggtgccgccagtatcgcgagagcggtgagtccgcactggtcgataagccgcgaggtcgcaagccgcgcgttaaaaaggcggaatagcaaacgggatggtgcgcccacaggggcgcatttttcttgccgcctctctgctccaaagcggacgtgcccttaccccgtacgcctaaaactccccagttgaccgaaaacctgccgccgctactcctcaattgagctataacgttaaacaattgcagcgtttttgcacgggggagtgatggtatgacgctactgtatttccttaccctgtttccgctggtaccggcgctgggcatgctgctcgcgcgcggtgaccgcgcccgcgatgcggtggggctcataggctccggcattattatggcggtgacagttgtagtcgccgtcatgttttttggcatgggtccgcagagctttgaggttgcctccggcacctcgcatgtgctctcgatcatcagctccgtcatcgacgtcatcctgtgcgccgtaatcctgtacaacgcgtacaaatataggaacgcgctcgccacggtgctcggcatagtccagctggtgggctcgttcgcctttgcagccatgacgctgcccgcggtcgaagccgtcacggcgacgccgctctacctggactacatgagcgtgatcatggtcctcgccgtcggcattgttggcagcctcatctgcgtgtatgccttgggttatatgaaggacttccaggcccacgacgagcacgaggccgcactgcgcgggcagaccgcgcccgaccgtcgcccgcagttcctggcgcttatgttcctgttcctctcggccatgttcgtcatcgtgacgagcgacaaccttgagtggctgttctgcggctgggaaatcaccaccgtgtgctcgttccttatgattggctacacgcgcacgcccgaggccatcaagaacgctttcacccagatcatccttaacatgctgggcggtatcgcgtttttggcgggccttatgttcttgcacgttaacggcatgccgctgaccatctcgggcatgatcgagctttccggcgccggtaccgcgcaatccgcactgctggtgatgccggtcatcctgttgtcgctcgccgcactcaccaaggccgcacagatgccgttccacacgtggctgttgggtgctatggttgcccccactcccacgagcgccctgctgcactcgtcaaccatggtcaaagccggcgtgttcctgatggtcaagctgagcccgctctatgccatctatcccgtgaccggctttatggtcacgagtgtgggtgccatcacgtttttgctcgctgccctcatggccatctcgcagagcaacgccaagcgtgtgctcgcgtactccaccatttccaacttgggcctcatcagtgcctgcttgggtgtcggcgcgcccgaggccgtatgggcggccatcttcctgatcctgttccacacggtggcaaagtcgttgctgttcctgtgcgtgggcacggccgagcatcatatcggcagccgcaatatcgaggacatggacggtatgttcagccgcatgccgcacctgacgcgcctgatgatgctgggcatcatgggcatgtttgtggcgccgtttggcatgctcgtgtccaagtggggcgccctggtggcgtttgcccagaccggcaacgtgctcatgatcatggttctggcctttggctcggccgcgacgttttacttctggggcaagtggcttgccaagctttcgggcgtcgaccccacggctcaaaacgttgaggtcaatgtccataagaccgaatggatggcgctcaacaccatcgccgcgttgctgattctgtgctgcgtggcgtttccgattatctcgagcggtctggtgtcgccttacttggccatggtgtttggccgcgtgccgtacgttatcggcaaggacgctatgtatctgatggtggttatcgtggcgtttatcgccgtggtgctgctgacttcattccgcgtgagcaacaagccgcacgtcaacgtgtacctttcgggtgtgggaaccgacaaatatcgccatttccgcggctcgatgggacacgaggtgaaggccgaaaagcgcaattggtactcggaggacgcccttggcgagaagcgtattggccccgcgggtagcgtcgtgtgctgcagcattatcttgtttgcgctgctgtgttgcgcgtggattgggcccgagagacttgccatgagcgcgccctcggtgctgcgcggcaagtattttgaaggttcgggcgtcgtgggcatttttattggcaccgtggcgtttgccttgctggcgccgcttgtgggcggtctgatcgacggtcttgaccgtaagctttcggcccgcatgcagggccgcgtgggcccgcgcctgctgcagcccttctacgacgttgccaagctcctgcgcaaagcccctgccagcgtaaacaccatggacgatacctacatggcgtgcgcgctcatctttaccgtggtgggcggcggcatctttgtgtcgggttccaacacgctgctgtgcgcttttatggtgacgctcgccgcgatctttgtggtgctggcgtccgcctcgacgcaaagtccgtttgcccaggtcggcgccgatcgtgagttgctgcaggttatgagttacgagcccgccgttttgctgatgagtgtgggcctgtatcttgccaccgacagcttcgattccatcgccgtaacggggcagtcggctcccatcatcgtgtacagcgcgcccattttccttgcgctgctcgcggtgctcaccatcaagctgcgcaagtcgccgtttgacctttcgtactcgcatcatgcgcatcaggagatcgtccagggcgtcgccaccgagatgagcggcggcacgctggccaagatgacccttatgcactggtgcgagaccgtgctgtttttgatgtgggtgggcatgttctttgtctgggacaaccccgtgagctgggttgtagccctggtcgtgatggtcgcgacgtattttgtcgaggtcctgatcgacaacaccttcgcacgcagcacctggcgcagctgctttaggctcggatggggcgtggcgctggtgtttggcctgctcaaccttatgcccatactcgtcgatgtgtttatttaggaggcagcatccatggatcataaaatgtcgcgctcgccgtgggttattcattacgacggctcgagttgcaacggatgcgatatcgaggtgctggcctcgctcacgccgctgttcgatgcggagcgctttggcgtggtcaacactggcaaccccaagcatgcggatatctttttggtgacggggtcggtcaatgcccagaacctgcccgtcgtgcgccagatctacaaccagatgctcgagcccaagtgcgtggtggcctgcggcatctgcgcgtgttcgggcggcgtgttccgcgatgcctataacgtgatcggcggcgtggaccgcgcgattcccgtggacgtgtacgcgcccgggtgcgccattcgccccgagacggtgatcgacgccattgtggaggcgtgcggcattctggaccagaaggaggccgtgatgcgcgctggcggtgacccgcttaccgtgggcggcgccgctacctgggatggtggcgttgagctaggcgaggacgggtttgtagctgctgcgggggccggggccggtgtcgacgcaggcgcggctgacggtgcgcccgccgctgcaaaggaggccaagtaatgcaaaaggctatctataccaccgtcgggatcgacgagctcctgccgcatgttcaggtgctcaagggcgtcggcgcgcgctttgtgcaaatgcacgccgagcgcaacgtcgacgacggcacgtatcgcttggtctatacgtttatcaacgttcgtgctgctcaggagcagaccgcgcgggacggaaactatgcgattgagaatctggtggtcgagggtatcgaccagtaccaggagattccgtccatcagctcgtactatccggcggtattcccgtttgaaaacgaggcgcacgacctgtttggtcttgccatcaccgacatgcagatcgactttaagggctttttctaccaggtctcgactgccgaacccatgagcgttatcacgcccgaggtgaaggccgcgcgcgagaaggccatgaaggtgcgtgccgccgccgaggccaaggcgcgcaaggccgctgccgagaagtccgccgcggctgcggctgctgcaggggagagcgctgcgagtgccggcgatgcttcggctgcggcgagcgcccagtccgctgcggctgccggctccgatgctcagcacgatgaaactgctgcgaaggccgcgctcaaggctgccgagatggaggcaaagctcgctgccatggatcccgagaaagcagccaaggtccgcgcggcgcttgccgccaaggccgcccgcgacaagcagaaaaaggaggcgtaaggcccatggcacatcgctccgttattccgtttggcccgcagcacccggtgctgcccgagccgcttcatctggacctggtgatcgaggacgaccgcgtcatcgaggcaattccgcagatcggttttgtgcaccgcggactcgagaagctcaccgaaaagcgtgacatgcaccagtttggctacatcgccgagcgcatctgcggcatctgcgccgtgggccacagctgcggctatgccagcgcctgtgagcgtatgctcggcatcgaggtgtccggccgcgtgcagtatatccgcaccattttgcacgagctttcgcgcatccactcacatctgctgtggctgggcctgctcgccgacgcctttggcttcgaggcgctgttctatcggtcgtggaccctgcgcgagcagatcctcaagatctttgagagcacttgcggcgggcgcgtgattctgtcgattaacgagatcggcggccttaagcacgatatcgaggactccgagctggcgggcattgtcgagacgctcgacgccatgcgccccgactacgaggccctggtgcatacgtttttggacgacaacagctgcggcgagcgcctgcatggcgtgggcgtgatcagcaagaaagacgcgctggagctttcgatggtcggtccgttcggccgcgcctcgggcgtggactacgacgtgcgcatgttcggtgacggcgcctatgcggacttggccgcgtttgagcccatcgttgctaccgatggcgattgctatgcccgctgccaggtgcgttgcgccgaggtcacgcaggccatggacatcattaaggagcttgtgggcaagattccgcacgacgggattggcgggcgcaccaagcttacgccggccgacggcgcgcgcggcgaggttgtgattgagcagccgcgcggcgaggcgtattactatgtgcgcggcaacggcaccaagaacctggaccgtttccgcgtgcgcacgccgacgtcgcagaacttggcgggtctgacgcatgcgctgcagggcgtactccttgccaacgtgcccatgattatcctgaccatcgacccctgcattagctgcacggaaaggtaggcgcggcatgagtttgctgacatttgccaagacggccttgggctctatggtcaagcagccggtaacggtgtgctatccgcaggagaagctcgcggcacccgagcgcttgcgcgggcatatcgtcaacgacatggacgtgtgtatctgctgcggcatgtgtgcgcgtcgctgtccggcgggcgcgctcgcggtcgatcgcaagggtggaacgtggtcgatcgacccgtatgcctgtgtggtgtgcggtgagtgcatcgagagctgccccaagcactgcctgactatggacaccgcccgcaccccagtcgcagcggacaagactcccacggtagaaactaagccggagtagcgctggaatagagctggaataggggccggaggggcaaaaatgccccaccggccccgcgcgtgagcgcgcggttgggctgccacgaacaaaactatgccggattacggggctggatagcgaacctcccaccatgcagaaaaacgcaaaaacaaaaccgcaggtagatagcctgccgtttttcaaaaaatggtggtatggatgagggccccgactttagctccgtaatccggcatagttttgaaatgacaccatatccgtaacagcccttgatctcccgtggacagagggaatcgggtcattttggccttgcgagggctgtcacgtgacccgtctgccacgaaatgggctcatctactacgtttaagccgctaccctcaaccatggcaagtaatgcgaaataaaaactgcaggtagaacgcctgcggtttttcatgaaaagcgggtatggtcaagggtatcgagtcaaacgtagtagatgggcaggtttcgtggcgagcggtttcggctgatcccttggggacggaggaaaacggctcattttggtcccgcgaggctggcggagacactcgtgcagggccgcccgaacaaaactatgccggtttactacgatgaatccgagattcctgaccacaccagcatttttgcaaatatcgcaagtgttctacctgcggttttgtaagtgcgcaatttgccgtggtcggagatatgcggttcatcgtagtaaaccggcatagttttgaaatggcatcaaattggcggcagccagcggctagcctcgcagataggcgatggcgatttgggtgcggttgcgtagccccattttggctaggattgagctgatgtggttgcgcacggtgccttcgcccatataggcggtggcagcgatcttcttgttgtcgaggccgcgggcgatgagctcggcgacttcgaactcgcggtcggtcagaccggcaaaggcggcgggccggcgggtcgcgccggcctcgacgtccgccccatcaaagttgatatcctcgatcgccttaccctcgagcacgcgtttgccatccatgacctgtgtcaacgcgggagggatggcagcgacgtcggttttaatcaagtagccgcgggcgcccagcttgagcgccgacacaatgtactcgtcatccgagaacgtcgtcagaaacaccacgcgcgccgcagggtcgtgctcaaggatctcgcgcgcggccgaaaggccgtcgcgtcccggcatctggatgtcgagcagcgcaatatcgggtgcgtgctcggcgtagagcgccaccgcatcgttgccgttggcaccggtgcccaccacttcgatctgcggctgggcgcccaagataatcttgagcgaatcgaccaccaagcggtcgtcgtcgacaacgatgagcctcatcggccctcatctccttgctgtttgggaacggtggcaaacacacgccagccgccggcgccggcacgcgggccggcggtgaaggtgccgccaagcgcctcgatgcgctcgcgcatggaggcgagccccatgccctccgcggtgccgcggccgcttgcttggacctcacccacgccatcgtcggtaacaatgagctggtaaaacgacggatgctccatgcaccgtacggtgacggtctgggcgcaagcgtggcgcatggtattggagagcgcttcgcgcaggaccgctgcaaagcagttggcgacgtttgcgggcgcatgttcggccataacttcaagctcaatctgcgggccgccgtccgagcgtgtgccttcgacaatgcgttcgagctgcacggaaaggtcgacggcgttgtcgttgagcgcgtggacgctggtgcgcacaagctggagcgcctcgtcaaccgtgcgtttaacgtcggcgaaatcggcggcgacgccaggctcgtcggcgtggaccacgcgtagggcttcggcctgcagtgaggcgcgcgtgagctggtgcctgacgttatcgtggatctcgcgcgcgatgcgggcgcgttcggcgagcgtcgcgagctcgacttcgtagtcctggcgatcggcaagatcgcggttgcgcgcctcgagcgcgagggctcgttcctgcagctcgtcgcgggtgcggcgcatgcgccgctgctcgcgctccaactgggcggtgcgtagcgatagcaaggtggcggcaaccgaaaggatggcggttaacagcagcgttcgggtggtgagcacgccaccacgaaggtccgcgacaagcgcgcagacaaacacggcgccaatcgccagcgcgggccagattcgttcacggcgaacgcgtcgcgcgatgtcatagagagcgagaggcgcaaacggcacaaacggcggcacgaagacagccgcgatgatgcaggcgtagctcgcggcctcgctcacacggcgggcgcggtttccctgtacgacctcggccagcgaggtggcaataacgccaaggcaaaacgccgcgaccaggcgagcgtccacagcaagacccatggcggccgcaatacagcacgccagcacgatcgatttgtcgaaaagcctgttcatacgggtattgtacgcgaagccgcgcgtggtggagggaccgcctgcgcaaccgtgacattcctcccacgcggcaaagcggggacgtcggcaggccgcacggccaagctccgcactcgtgacaaagctcactggtgcgcgccgctcgctcctgcgatgatgcaatcgtaccgggccgcaatcaacagaagggccgcctcatgacagacatcgtccacgtcgaaaacctcgtcaagcgctacgacgaccttatcgcgctcgaccactttagcctgagcatcgcccccggcgagatctttggcctgctgggccccaacggctcgggcaagaccacgtccatcaactgcattctgcagctgctcgcctacgacaaaggcaccatcgagctgttcggcgagcccatgacgcccgcccgctacgacctcaagcgccgcatcggtgtggtgccgcagcaggtggcggtgtttgacgagcttacggtgcgcgagaacatcgactatttctgcagcctttacgtcaacgaccgcaagcgccgccgcgcgctggtggacgaggcgatcgactttgtcgggctgggcgactttaccaagtttcgccccggcaagctctcgggcggcctggcgcgtcgcctcaacatcgcctgcggtatcgcgcacaagcccgagctcatcttctttgacgagcccacggtggcggtcgacccgcagagccgcaacgccatcctggagggcatctgccgcttgcgcgacgagggcgccacggtggtgtataccagccattacatggaggaagtcgagcagatttgcagccgcatcatgatcatggacggcggacgtgtgctggcgcagggcaccaatgacgagctcaaacgcatgattcaaatgggcgagcgcgtgactgtcgaggtcggcgccgccgagaccgccacggtcgagcggctgcgcgccctcgagcacgtgctttcggttgagctgtccggcggcgagctcgtctgcacctgcgaagcgagcccgcacaatttggtcgacatcctcgacacgctgcgcgccgccgatgtggcgctcggccgcgtgtggagcgagccgccgaccctcaacgacgtgttcctcgagatcaccggccgcgagctgcgcgactagggggcagtcatgttcaacaccatcatcactacggtcaagacgctgctgcgccggccgagcacgtgggtctggggcgctctctttcccatcgcactttccacgatgttcatgtttatgtttgcgaatctgagctctgacggcacggtcgacccggtaccggttgccgtcatagcggacgaggcctgggacgcctcgacctttaaggacgtggcgacgtcgcttgccaaggagagcgacaatcagctgctcgagatccacgagtgcgacgacgcagccgatgcgaaccgtgtgcttaaggccggcgaggtcgcgggcatctatacggtcgacgacgcgggcgcacccaagctcacgttgctgtcgagctacgacagctcgcgtgcctcaacggtgctcaccgaccgcagcattctggagacggtggcaagctcgtatacacaaaatgccgagctcatgtctcagattgcccaggacaacccggcggcgctcgccgacccggaggcggttgcgcgcgccctgtcgctcgagggcggcacccgccgcgtaagcctgacacgcaccacgcccgatggcacggtcatctactattacgcgctctttggcctggtcgcgatgatgtctgcggagtttgccgccttgagcgtcgtcgatctgcagcccaatctgtcgggccttggcgcgcgccgctgcgcgggcggtctttccaaaacggcgtcgctggccggtatctttgtgggctcgtggctggtctcctttgcctcgatggcgatcgcgatcggctacgtgcgcctggttgtgggcgtcgactttggcgggcgcgaggggctgtgtctggtgggcggtgccgcttccgcgcttgccgccacgggcttgggactctttgtgggcacgcttcccgttaagggcggcaaggcatccaagtcgggcatcctcacaggctttgccaccacgtgcgctttgttcgctgggctctacggcgaaccggcgatggcgcttgccgatgacgtcgcccgcgcctgtccggccgagtgctggctcaaccccgtcaagctcatctgcgacatgttcaaccgcctgtatttctttgaggacctggatccttttgccgttcgcgccggcgcactggtcctcatggcactgctgttcgttgccgccgccacgctgatctttggaaggagccgctatgagcacctttaagaccgcgcttcgcatggcgctcgctcacccgttctacctgctcatctacacggtgttcatttcgctgatgggcgtattcatcgcggcatcggtgagctggaactcgtcgcagctcaccgagtacaagccctacgacgccaacgtgatcgtggtcgaccgcgatggcagtgatctttcacgtgcgctcaccaagcacctaggttcgcggtttgacctggtcacgggcgtcggcgatgacacgtacgaccttgcggacgcgctctccaagagcaacagcgccaagggcagcgccgactgcgtgttctttatcccggaggggttcgaggacgacctggtcgcggctgcccgcgcgggggagtccctgcccaagctcgatgtgacctacggtgccggcaccatggcggcggcgctttcgtctgccgaggcctcgcgctggatctcgctcgcgggcgctgcggcggcgcttgagcccactgcctccaacggcgacgttgccaaggccgccgaacatgccgctgcaaagcgcgcggaggtccagatcgagcgggtcaaggtcgactcggctgctgccgccacgctcgagtcgtacttcaactttggcgcgtacgcgattatctcgtcggtcatcgtatcggtggggttggtgttctcgggcatgaacgagcccgagcgcgtgcgtcgtatggatgccggcccaatctccgagcgccaacgttcgcttgccgtgtttgccgccgccgccgtgctcaccgtctgcatctggtttgtgtcgagcatgatgggtgtcgtgggctttgccggcgcggtcgctgaggtcggcgtgggtcgtgtgtgtctggcgctggcggcgacgtttgccctggcgtgcacgcctctggccgttggctttacgttgtcgagcttgggcgcgcgcgaggaactgctcaacggcgtgggcaacctgcttggcatgctcatgacgtttttgggcggcgcctggatgccgctgtcgctcatgggctcggccgtgcagaccgtggcgcattttgtgccgacatattgggtgaacgacgcgatcagcaaggcactcgcctcggatttaacgtccaccgtgctgggcgacatcgcctgcgacctgggcgtcacggcactcttcgccgtggccatcgccgccgcaggcctcgccctcgcacgcaccaaatcccacgcctagccacctagtcatttaagaacgtccccaatgactggtctgaaataaatccccggcctcgctccaaaatagttcgccatggtttactattacgctcataaagtagtacgaggctaacaacgggggataccatggcaacgcaggaagcctatgtccaggtgaaggatctcaaaaagcattacggcgacggtgatgcgcgcctgacggtactcgatggcatcgacacgtccatcaaccgcggcgagatctgcgtcatgctggggccctcgggctcgggtaagtcgacctttctcaacctgatcggcggcctggaggatgccgatgccggctccattctggtggacggctgtgacctcacggtgctcaaacctaccgacctgggcgagtatcgccgccgtgagctgggctttgtcttccagttctacaacctggtgcccgacctcaccatcaaggaaaacatcgaggtcacggcatgcctgtccaaaaagccgctcaacattgacgacctgctacgctcgctgggcctctacgagcaccgcaacaagttcccgcgccaggtttcgggtggtcagcagcaacgctgtgccatcggccgcgcgctcgtcaaaaacccgggtctgctgctgtgcgacgagcccacgggcgcgctcgactataagacgtccaaggaaatcttgcagctcatggaggatgtcaatcacgagtacggatgcaccatcatcatcgtcacacacaacgccgccatcgcccgcatggccaatcgcgtgctgcgcctgcgcgacgggcgcatcgtcgaggatgagctcaacgagtcgcccgtcgcggccgccgagctcgattggtaggcggcgccatgacacctctcgcaaaacgtctcccgcgcgagctgcgccgcaatatcggtaagtacctgggcatctttttgcttatgtgcggaagcattgcccttacatcgggctttttgctcgcggcgcattccatcggctgccttatcgacgacatgcgcgatgcgtacgcgatcgaggacggccgcgtgaccacctccttcgaggccaccaaagaccagctcaaggcagccgaggacgcggcagacgacgtcggtggcgtcacgctctacaagaatttctccatcgatgccatcatcaaaaagaccgccggcgacgatggaaccaagcgcacgctgcgcacctatgcgcaccgcaccaaggtcgatatcgcgtcctactgcgaaggcaggcagcctaaggcggacgatgaggtggcaatcgaccgtgtcttcgccaccaataacaacctgtccgtgggcgataaagtcgagctcgagggtcgcacctacaccatctgcggcatcatgacccagcccgatagccaggcgctgttcctcaacaattcggactttacggtgaacaccatcacgtacggtgtggccgaggtcaccgacgccggctttgccgcgcttaaggacgccggcggcgcgcctgcctacacctactcctttacctttaccgatcgcgatctctccaccgcggatcgcgtcgatgcggagcaggatatggtggaggcgctcaccgatgccgacgcacgcgtggatgacctcatcgacgccgattccaaccagggcattggctacgcgcgcgacgacgtagacggcgactccatgatgtggatgacgctgctcgacatcatcatcgtgatcatggcgttcgtctttgtggtccttaccgacgccaccatcgaggaggagagcgccatcatcggcacgctgctcgccagcggctatcgtcgacgcgagatcgtgctgcactaccttgcgcttcccgccatcgtgggcgtggtcgcggtgcttttgggcactgcgctcggcgtcgtgttctttaccgagcccatgcgcagcctcgattacggctcgtacagcctgccgcccttccaggtgtactggagctgggagatctttgtgaagtgcgccgtggttcccgccgctgcgctcatcctcatcacgctggtgggtctgcttcgcaagatgggcaagacgccgttgcagtttcttcgccacgaggcgagcggcaagtctggcaccaagcgcggcctgcagctgccggagcgcatgggctttgtctcgcgcttccgcctgcgtatcttcctgcgcaacctgggcaacttcgccacgctcttcgtgggcattgcgtttgcctcgctgctgctgctctttggcctggcgattctgcccacgatgacgcactacgcggacaacctcgagacgagcctggtcgccgagcaccagtacacgctcaaggctccgctggagctcgagggcactgccgaggagcgcgagcagtggtcggcactcgagtgcttgcagtcggttgacggcgcgctgctttctgccgcccaagatgccgatgacgagctcgacgacgcggccgatgcggcgcaggcggcagccgatgccgcgaccgcatccccgtctgccgagagcctggctgcggcgcaggacgcgctcgccaaggtccaggacaagaaggatgcgctttatgcgcgcctcgatgaccttgccgatgctctcggctgcgaccacgatgaggctatcgacctgatcgacaaggcctctaagatcgacactgacaacgacgatatccacccggtcaatacgaccgataacggcgcgggcgcaatcgcacaggccgagaaatacgccgtctaccagctgcaatacgaccgcggcgacggaaatggcgaggagacgatttccatctacggcatctcgcccgattcgcgctactggaaaggactggacgtcagcgacggacgcgtcgtctttggcggtggcttgctcgacaagtttggctggagcgagggtcagaaggttaagcttcgcgacaagtacgagggcgagaattattcctttgagtacgtgggcaaggactgcgtttggggctctaagtcggatatgaatgtctatatgagcatcgaagactttaacgagctgtttgacaacgatgcggcctactttaacggctacgtgagcaacgagaagctcgacctcgacgcgcgctactttgccggcgataccacgcccgacgacatgcgcgccgtgggcgaccagttcatcggcatgatgagcaaaatgatcggcatgatggttgggcttgcggtgttcatcttcttgctgtttatgtacctgctgaccaaggctgtgatcgaccacagcgcccgttcgatcagctacatgaaagtctttggctatcgcgatagcgagatttcgcatctgtacatccgctcgatcacgttgtgcgtggcagcgtcactcgtgctgagcctgccggtcattattggctcgctaacggccatcttccgctcgatgctgctcgcctataacggcaatatcgagatctacgtgcccgcttggtccatggcggcgtgcgcaggaatcggctttgcgacctacctggtcgtggcgctgctgcacacgcgctccatcaagcgcgtcagtctggccgaagccctcaaagtccaagagtagtcatttaagaacgtccccaatgactaggtgccgtacttgactttaactctgctttaactggtaccatcctctatgtctgtaacgccatatagaccgaggggatagatctatgaccgcaactgcacccgctaaggtgtacttcaccaacctgcgcacgcatgctcgcgagagccagctcgacaagctcaagcgcctcatccgtcacgccggtatcgagcagatcgacttcgagaacaagttcgtcgccatcaagattcactttggcgagctgggcaacctgagctttttgcgccccaactacgcccgcgccgtcgcggatgtcgtgaaggagctgggcggcaagcccttcctcaccgactgcaacacgctctatgtcggtagccgcaaaaacgcgctcgagcacatcgataccgcctaccagaacggctttaccccgtatgctacgggttgccagatcatcattgccgacggcctcaagggcaccgacgaggcgcttgttccggtcgagggcggcgagtacgtgcacgaggccaagatcggtcaggcgctcatggatgccgatatcgtgatcagcctcacccactttaagggtcatgagcaggccggctttggcggcgccatgaagaacctgggcatgggcggcggcagccgcgccggcaagatggagcagcatgccgccggcaagccgaacgtctcgaccgagcactgcgttggctgccgtgcctgcgaaaagatctgcgcgcacgacgctgtctcgttcaacgacacccgcgagcgcgagcttgccaacggcaacacccgcacggtgcacgtggccaccatcgaccacgatcgctgcgtgggctgcggtcgctgcattgcggcatgcaaccaggactgcatcaagcccggctatgacgccgcggccgacgtgctcaactgcaagatcgccgagtacaccaaggccgtcgtcgacggtcgcccgagcttccatatctcgcttgccatggatatcagccccaattgcgattgccatcccgaaaacgatacgcctatcgtcaacgacatcggcatgttcgcgagcttcgacccggtcgccatcgaccaggcctgcgccgatgccgtcatggcatccgagccgctgccaaacaccgagctcaccgatagcgcggccaagatggagcacaaccacgagcatctggagggcgagcaggccaaggatcccttctgcatcacgcatcccgacaccgactggcgcgtgtgcatcgcgcatgccgagaagatcggcctgggcacgagcaagtacgagcttatcgaggtcaagtagcgcctagctattggacaaaataagcgcctttgtagcgtaagttgagcaaaagccgcccgtgagcacagcgcccacgggcggctttttggaagtgcgaggaaaatcgaatagcgccgaccacaaaccgatttttggcaacaaaaccccagacgttgctttttgcctaaaaatactcgtcgaggaagtcgtcgaccgtgttccagtagagttcggggtcgacctgcgcgctcttggcgtgggtggcgccatggacggtgagcttttgcttgaccttgctggcgcacgcgtcgtagttttggtcgagcatgctgtacggcacaaaggtgtcttggtcaccgtggataaacagcatgggaaccgtcgcgcgcttgagctgttccacgctgctcgccttatgaaagtcgtagcccgcgcgcacgttgcacaccaagtttgctacatcgagcaagggaaagctgggcaggccgaacacgtccttgagctgcagagaaaactcgtcccaaacactcgtataaccgcagtcctcgataatgcatttcacgtttgcgggcagagattcccccgcgacgttcatggcggtcgccgcgcccatggattcgccaaagaccaggatgcgcgccttggggtcagcctgaacgattcgctcgatccatgcgacgatgtcgaggcgttcgggccagcccatgccgatatagtcgccgccggagcgctcgtgggcgcgggcggcgggtgcgagtacgttcatgccgcggtcgtggaatcgcttgacgtatcgggccataccgatgggctcgttggtatatccatgcaggcagacggcgtagtcgtgtgcgctctccgacgcagcaaaataccaggcggcaagctcggtcccatcgtccgcggtgaggctgctgctctcgcggttctccttaaaccacgcccgcgcctcggtatcctcggcatccggctgctcaccttctttgtcgttcttgctatcctgcatcatcttcatggtgtatggcgcgcggggattcagcgcgaagtcaaacagaaagttgccggcaaatccgagcagcgcaacgacaaccactagtgcaacgatgccggctatcttgagctttcgatgggaacgtgcgttttgagccatgcggtattctcctataagatgttaatacatcaacatttaatgcaagcgcattatggacgttcgccgttgatgcgtcaacaggcaaagaatgggtaaacaaagggtcacgtatggtgcaaatttcgcacgtacctagacgctttgatatagtgttgagaactctttacgttggaggatgtaaccggcatgtccgattcgagcgacagttctaagccgcgacccaagaccgcggtcgttccacactacacagtgggcgaggagatcatgaactccgtcacccatggtgtcggctgcctgctgggtatcgcgggcctggtgctcctgatcgtattcgccgccctgcgcggcggaggcccggcccatatggccgcggcgattgtctatggcgtcagcattatcctcgaatacctagcctccacgctctaccacgcgattcagcccgcgcgcgccaagcgcgtgtttcgcatcatcgaccacagctgcatctacctgctcatagccggcagctatacgccgttttgcctcatcacgctcgcaaacgacggcggcgctgtgctgttctttgccgtatgggccatcgccatcatcggcatcgccctcgagtgcttcctacgcgagcgccagccgcattgggtaagcggcctggtctacctgctgatgggctggctcgttgtctttaagctgcccgaacttgttgcgctgctcaatcccgtggcacttgccctgctcgccgtcggcggcgtgtgctacaccgcgggcgtgccgttctatatcgccaaaaacgtgcgctatctgcacagcgtgtttcacctgtgggtgctcgccggcagcatcttccagttcatggcggtgatcctcttcgtaatctagcgaccatgcctgcgcgcccgcgttctcgtttgggcgccggtgcaattgccgtatccgccatcaacgttttaacctgacgtcccgaatcttggaggttcgagaaactcccgatggacataaccatctcccttatcaccaccctcgttttgaccctcatcaacggctacttctctatgtccgagatggcgctcaccacggccaagcgcgccgtgttggagcacgaggccgaggaaggcgacaagcgcgccgagcgtgccattaagctggctgccgactccgaccagctgctcgccaccatccaggtcgccatcacgctcgtgggcttcgcctcgtccgccgtcgcctcgacgagtctgtccgacccgctcgccacgtggctcatgagctttggcatcgcgccgctctccgccatcgcgcgcggcctggcgccggtcatcatcaccgtcgcggtcgccttcgtgtccatcgtgatcggcgagcttgtgcccaagcgcatcggcctggccaacgccgaaggcgtgtccaagcaggtcgtggggccgttgtcgtttttccaaaagatcgctcgtccgctcgtgtggctgaccggcgcttgctccgatggcctggcccgcatcctgcgcatcaagagtgccgacgaccgtcagaacgtctcggaagaagagatcaagtacatggtctcggagcaggacgacctgctcgacgaggaaaagcgcatgatccacgagatcttcgacctgggcgacaccgttgcccgcgaggtcatggtgccgcgcgtggacaccaccatgtgcgaggacgacgagacggtcgccgacgtgctgtccaccatgcgccagaccggcttcagccgcatccccgtctatcacgaggatcccgacaacgtcgccggcattgcgcacatcaaggacctgatccaacccgcgctcgacggcaagggtgaccagcccatcgccggctttttgcgcgacgccacctttgtgcccgacaccaaggacatcctgccgctactgtccgagatgcagacctcgcacgaccagatcgtggtggtcgtggacgagtacggcggcacggccggcattatcaccatcgaggatatcgtcgaggagatcgtcggcgagatcgaggacgagttcgaccccgacaacaagtatctcacgcgcctttcgcgccgcgagtggctcgttgatgggcgtttttcgtgcgatgacgcgattgagcttggttggccgctcgaggaaagcgatgattatgagaccatcgccggctggattttggagctttgcgactcggtgcccgacatcggagaggtgtttgaggtcgcggggtacaagtttaaagtgcagtcgatgcgtggccagcgcatctcgctcattcgcgtgatcgctccggccgaaaccgataagaaggattccgagtcttcggtagacgagccgacgacgtcgggtgcgggttccgcgaatccgcacgacggcgacgagtaggacaaggaagagtaggggagagttatggcaggcctgttcaacatccttaaggtcaccgtcagtgaggacaagatctgcgcgcatgtgctggtgaaccccggcatgccgctcatgacctcggaggacatcgaggccacggcgcgcgtgtactacctggtgcccgcgattgccaagcacctgtgcctgggcgattccggccgcgagttccaagactgcatgggccagaccgagctctgccacctgttggagcacgtgacggttgagctcatgaacgagaccggtcttgccggtagcatctcgtgcggccgcacccgcgtaagcgaacacgatgagcgtgtctttgaggttgagctttcgtgccccgacgacgcactggccatcggcgcgctgtcttcggccacctttatgatggattgggcctatctgcacgccgaccagcctacccccgacgtggaaggcacggtcgcgggcctgcgcaacctggtgctgggcatgcgcgccgaggccgagggcaaggatcctcacgaggccgtcgccgctgcgaacggcgaagatgctgccgaggacgagggcgctgacgagggcgatgtgccggtcgaccccgagcccgctgccgatgtgaccgccgagcccgttcccaccgagccccagggcgtccccaactttgacgacgagccccaggtggcgatcgataccgagggcgcggttgccgagaaccacgaggcttccgcggctgtctttggcggcgcggcgacggttccggcaggacctgcgcatgagggcggcctgccgctcgtggacggcgccggcgaggacccgggtgccacagtggccatgccggctatgcctcaggagtaggcctactcgtttatcaccatcacgtacctgcgcttttgccgtacgcagatgagcggagcggcaagtgatgcgctgcgggtataatggacagcattcaaacggtgggcaccgacgtgcccgcaggagaggaatgatcatgggtaagactttcagctttgtctccggcgcactttttggtgccgctgccggcgctattatcggcgttgctctggccccgcgctcgggcgccgagacccgcgccatggctgccgatatcgccaacgacgcctgggacaatatgcgcgacacctacgagcacggcgccgaggaggcccgtgctgcggtgaatgactttggcccgatggtcgacgccaagaccgacgacctgcgcgccaaggtcgacctggcccgcgagcgcatggaccagctgcgcgagcagctcaacgacgccatttcgggcggcaacgtgacgcctgccgccgacgtcgtggtcgagaacgccgtcgaggctgataccgaggctgcggagccctcgaccgaggcataatgcgcgctggggattttgtcggcgccaagatctatcgcaagcctaccgaggacaagcgcaccaaaaaggacggcacgccgcgcagccctaaaaagctcggaaagattcactttccggtctttaccccgggcggtacgcgcgtggtcggctttatggtccgccagtccgatatcgcgggcatgatcgagcgtcccgaccgattcgtggcgctcgacgccattggtgtctacgagggcgccattgcggttgatgacgtcaaggacacgtacgatgccgccgccgccaagcgcctcgacatcaacctggacgattgcatcatctgggtcggtatggacgtgcgcacggaatcgggcgacgtcgtgggctattgctcggatgttgagttcaagccacgctcgggcatcgtgcaggcattctatgtgaccgccggtgctgcttcgagtgttttggttggtgacacgcaggtgccgccgacgatgctgcgcggctacgagaacggcgcgatggtcgtctcggacgaggtcaagtcgctcgggtattcgggcggtgcggctgccaaggccgccgaggccagcgtcgtggtgggcgacaaggtcaaaaagggcgccaaggtgctcgacgacaagggatcggttgccgtggacaagggcagtcgcgcactgggcaagcagctcggcaagacgcgcggcatgttcaaggcctttaaggacgaataccaaaaggcgagcggaggctcgtcaaaagctacaaaatagcgacgtaccaaatgatgggaggcaagccggagacctgttgctccggcttgctgtgtttatgggggagggcacatgcgccaaaacggatccaacttaaacgggcgttcgggtgcgcgtccgacggcgcgccgcgacctggggcagctgcctagcggtcagcgcaagcgtcaccgtaagcccggcgcgatgtatctcaaccatagccgcggctttagcgatcgcagcgctcgcatcggcaacagccgcacaccccgtcgttcgtctcgcctgccctatgcgctcatcgccgtgggttgcgcgctcgtgctgtttatcgctgccgtcgtgggctacgtcaaccgcagcgtggacgtggagctcaacggccagaagaccgcggtgcgcgtgggctctacgctgcagaatctcatcgacgaacaggatttgactgacacctacgacgcaggcgacctgctggccgtcgatgacagtgtgctcaagcgccatggaggcgaaaagctgtcggtgaaggtcgacggcaagcgcgtgaagcagggcaaatgggatagccgcgaactcgagggtggcgagaaggtgacggtcaagaatggccgtaacacctacgagaaacacgaggttcaggctacggttatcgagcccaagctcaaggtcgagggcacgggcgctatcgagtatgtgcagacgtggggtgtccagggccgctccgaggtgtgggttggtgagcagtcgggcaagacgcaggatcgcggcgaggttgtgcccgccaccgattgcgttgttgcgtgcgccagcgtggcgcccaagggcaacaaaaagtacgtggcgctgacgtttgacgagggtccgagcggcgccaccaaacagatcttgcaggtgctcaaggaaaagggcgtcaccgcgacgttcttcctttcgggcgatgcggtcgaggcctcgcctgccacggccaaggcgattgtcgatgccgggtgcgagatcggatccaacagctacagcgacgattcgctcaagggtcaggaccgtgaggcggtacgcgaacagatcacgaaaggcaccgatgcgattaagtcggcgaccggcgtgaagacgatgctactgcgtgctccctacgctgcctttgacgagcaaaactggattgatgcgatggacctggtctccgccgtggtctcgtggaatatcgactcgggcgactggctactcaacggtgccgacgagcaggtctcgacggtgctcgattcggtgacgccgggcaatatcgtgctgctcaccgatagagacgaatgcgccgagcagacgctcgaggcgctgccgcagattatcgacggcctcatcgccgacggctacaagatcgtgacgctcagcgacctggtcaagacggacacgtcgctgagcaaaaagctcacctcgctgacgaaggccaccatgcccaaggacgctgtgctcccccaacttgccgaggacaatgacaccacagagtagttattgggtagtcatttaagaacgtccccaatggctatgtcacggatacgtcagcgtttggtatgcctgcaatgtgcagcgcataaattcgatgccgcagggcgatgctgatgctatagttactgcggttaatgagggtcaagagaaaggttacaggtgaaatccaaacctcgaccatacagtcgatgaccccatgcaggtgctttttgcgcatgcacggggtgtaagcgtcgagcggcgtgcagcccgcgcatgcgtatacatatccagaagcccccggacgtcgcacatgcggccgcgttcggaggaataatgatggggagcaccattgaattatctgagtgagatgctcaaattgccggtcttggacgtcgatggcgaaaagctcggcgtggtcaacgattttggcattgctaccggcgaagtttttccgcacgtgacgtcgctcgcgttccgcggacccggcaagacgccgtttatgatcagctggcgcaaatgggtcgaccgtatcgacgagacgggtgtacaccttaagacgtcggccaccgaaatccgtttttcgtacctgcagccgaccgaactcttgcttgcccgcgacgtgctcaacaagcagattgtcgacacgcagggcatgaaggtcgtgcgcgtaaacgacatcaagttttccatgtcgggcgaaaaccagctgcgcctgctgggcgccgaggtcggtgctcgcggtctgctacgcgccatcagccccgcgctcgagcatatcgtcgaaggctttatgaagcacctgggcaagccactcagtgaggacatcatcgcttggtcctacatggacctgctcgaccgctcgaccaagaacattcaactctcggtgtcgcacaagacgctcggcgagctgcaccctgccgacatcgccgacattatcgagcagctcgacccgcgcctgcgtgcgcaggtgtttgcacagctcgatactgcccaggccgccgaggccatctcggagttcgatgacgacgagcttatgaccgagatgctcgagggtctgtccgacacggacgcatcgtcgatgctggccatgatggacccggacgacgccgccgacctgatcgacgagctcgattacgagaaggccgagaagctcctgcgcctgatgggcgtcaaggaggagaaggcgattcgtaacctgctgggctatgaggacaacaccgccggccgcatcatgacctcggagtttgtctcgctgcccgccacggcgacggtcggcgatgccatcgaggcgattcgcaaactcgatgaggacttcgagagcgtctactacgtctataccgaggatccgagcggcatgctgaccggcgtgctttcgctgcgcacgctgatcgtagccgaccgcgacgccacgctgggtcagctggcctatcgcgacctggtctatgtgtcgcccgacgaggaccaggaagacgtgacggacgagatgaccaagtacgacctggttgccatccctgtctgcgacgagaaccgtcatatcctgggtatcgtgaccttcgacgacgccatggacgttatcgccgaggagcatcaggaggacctgcagatcgccggtgtcggctcgggcgatagcgcgtcggacgactcgacgaacgtgctcagctggttcgtgcatcgtcagtactgggtcgtcgtgtggggcatcgcctcgtgcattatggcgacggtgctggggacggcgctgggctccgcgcatctggtggtgttccccatgtgcgccatgccgctcgtgctgctggcggcctcgcgcatggtgtcgttcgtcaagaactacttcctcgagtacgacggtcacgacgacgagcccaaaccgtacctgggattcttcttccagagcacgggtatgggcctgatcctttcgcttgttacttacctgtgcgcgcagctggtgcgcactgccgcgttccccgatgcgcccatgtttgaggagcaactctttaccgggtgctttaatatcgctgccatcatttgcctggttggcaacatgagcgccgtgatttacctgatggtgctgttctggcgtgacgagcatgacctcaacacgtcgggcaccgccatgaacgttattgccgtcatgatctcgtgcgtagcgtactgcgccgctgcggtgctgctcaccatgtcggtcatgggttaggtggtcgcgtgcaaaataccaagcaaaagtcgggcaccaagcaaaagttgaccatcgcggccatctttggcgctatgggtcccggtctgctggcggcgctttcgggcaatgacgccggcggcattgcaacgtattccagcgcgggcgccagctatggctacaagatgctctggatgcttcccgtcatgactgtgctgctcatcgtgacgcaggagaccgcggcacgctgcggctgcgtcacgggcaagggcctggcatcgctcattcgtgagcgctttggcgtgcgcaagagtgtacttgctatggcggcgctgttgatcgccaacacggctgttaccatttcggagtttgcgggcatcgccagcggccttgctctctttggcgtgccggcgagcatttcggtgccgttggtggcgctgctggtgtggatgcttaccatgtcgggtagtttccagcgcatcgagaagattctgctgctggtgagctgcgtgttcgtgacctatattgtcgccgcgtttatggctggccccaactggggtgaggtcgcggtcgacctggtcgtgcctaacattcaaaatgaccccagctacgtgtcgctcgtggtcgcgacgatcggtaccaccatcgcgccgtggatgattttcttggcgcagaacaacgtggtcgataagaacgcgggcgaggacgatatcgtgctgcagcgcatcgataccgtgagcggctcgcttgctgccgatgtcattgccggctttattatcatcacgaccggtacggtgttgttcccggcgggcattcagattagcgatgctgccgatgctgcccgcgcgctggagcctattgcgggtcagtggtccacggtactgtttgcctcgggcctggtcgcggcgagcttcttggctgcctgcgtgctgccgggcgttacgtcgagcgctatctgcgaggcatttggctgggagcgcggtgccgaccgcagctgggacgaggccccggtctatcgcggcatcattacggccatcatcggtatctctgccgtgctggtgcttatgcccggcgtcgatctgttccagattatgatgacctcgcaggtcatcaatggcgtgctactgcccgtggttctggtgttccaggtggttatcgccgccgagcgtcacattatgggcgccaaccgcaacggccgcgtgtggaacgtgctcacttgggcgactatcggcgtgattacggcgctcacggtcgtcatgtttgtcctgcaagcgatgggctacagcgcttaacgcccacttttgcttccgaacaggccgcagcgatggactgcggcctgttttttgcccgcgacctcttggggccggctcgaaaagagtgattttgggttgtttgctgcgggctatttgtcggtgcccagcttgtgcggcttgaaggcaagcgcattgacgagtgcgtcggtggcagacttgacggctgccggctgcggatcgttgacgtgatcctcgggatgcacgggcaggtccttcttgacggcatcgtggatcaagttgaggtactcagtcacgccagtggtcgataggtgcgtgccatcgccatcgaacaggtcgttgcggttggcgctgtatccgtaccagtcgataacgcgcacgttcttgtagcgcgtagcggcgttagcgatggcctggttggtagagccaacccacggctgcgggctgcgcgtgttcacaaacaccacaatacgcttatctcctgcatcgtccatgatggcgtcgatctggtcgtcggttaccaagccgttggtgcccagtgcaaagaccacgatcttgccggcaaggttctgctggatatagccctcaaatgtcgcgcggcccgcatcaaactggcggcccttttcggcatcgatatggctgtgcgagaacacaccgtcaaaggtgtctacggcacgcagcgacacggagtcgccgatcataagcagatcgtaggagccatcggggaagccgtcgttgtccttgtcggtgtcgtcggccgcctgctggtcggtgggcgcggtgttcttggcttccttgttgaggacttcggcgccctcgccgctcagcgcagacgtctcgggcacaaagatcaggccgcccagtgcaacgaccaatacgacagcgcaggctgcgcagacggggacgtgcgtgcgtgcccagttggcgggcgtggtggtgccatcgcggaattcggcaacggtgcgcccaaagccgcccttcctaaacggcgtctcgataaagcgatatgagcattcggccacggcgaccaccaacagcacctgcaaaatgtactgccaccacggtgtatcgttgatgttggcgaccgggttcatgagcaacagcaggggatagtgccacaggtagatgctgtacgagcgcttgccaacccatacgagcggctcggcggacagcgcgcgggcaactattccctggggctgcacgcaggccgcgatgaccatgagtgtgaggatcgagcacagcagcgtgcctccgcgatactggaacgcggtgtagccgttggtgagcgcgaccatggcggcaaggccaaccagacccacgaggcccaacacatcgatggatgcgggcgaggaccaaaagcgcacgagggcgctcggctgtgccgggccggtctcggctgattcgtcggccttctcgccaggcttgccctcggcgttcttgccgtgcttggcggcgccggccaggcgattgagccccaaacgacgagcgagacgcaccggcgccaggtcgcgatcggggataaaggccatccaggcacccagcagcagcgagaacacgcgggtgtcggtgccgtagtacacgcggctggggtcggcggcagggttgtaaagcaccatcatggcaagggcagataccgcggcaaggcccagaaccacgcggcgcgtgttgggcttgctcatgtgcatggataccatagcgagcagcagcgggggccaaaccaggtagaactgttcctcgatggcgagcgaccaaaagtgcgtaagcggcgagggatcgcccagggcgttgaagtacgagacgttttgggcaatctgccaccagttgttgaagaacagcagcgacggcaggatatcggggcgcatcttggtgagcatcacgtggttgaagacggtgcacagcgcacaggtcaccaccacgacggtcaccacggcggggaccaggcgacggatgcggcggatccagaagctcttgaggtcgatacggccggtcttagcgacttcgttgagtagcaggcgtgtgatcagatagcccgaaagcacaaagaagatcgtgacgccgagcagaccgccctgcgcccacgtgaggttgaggtgatagagcaccaccgcgacgacggcaagcgtgcgcaggccgtcaagggcagggatgtagcgggacttggggcgagcaggcatctgctccgcggcgggagtgttggcgcggcccgcgttgttggcagaagcgcgatgggggctcgtggtgcgtcgcggctcgttggcacggcgttcgctcttcacgcgttcgtgcggcgccggctcgttgcccgtgcggcgtcgaccgcgcgagcccgattgcgagaattgttccataaaacatcatccaatgacgagaataatcagcacgtattcattgtagctgcctgctcctgtgaatgcttgctgctggcgcaacctcaagggtgcgttcacatcaaagtgaactaaagttatagaggtgcgaaggcgcgcaatcgacggtcgacggtgggtgcaaagcccgcagatgaggaggtttccatggcagatcgcggcatcgttgcggtgttcggcagcatgaacatggacctttcggtggcgtgcgagcgcataccgcgcgcgggcgagaccgtcggcggcagcgggtttatcaccaacgccggcggcaagggcgccaatcaggccgtagctgccgcgcgtatgggcgcgtgcacgcacatgatcggcgcggtcggtcgcgacgcgttcggcgcgtcgctcgtggtggggctccaagacgccggcgtggactgtgactttgtagtgcatcgcgatgacgtggagacgggaacggcgaccatcgttcgctgcgagggcgacaaccgcatcgtactgtcaccgggcgccaaccatgcgcttgcgggcgcggacgttgcctgcgcgctgaggcgtctggtggctcatgagctcgacggcgacgccagcgagattgccccggctgccggaagcgtctttatcgcccagggcgaatgtgaccttgcagcgacggccgaggcgcttgtttgcgctcacgagctggggttctatacggtctttaatccagcgcccgcctgcgagctgcctgcggaggtctggcctgcggtcgacttggtctgccccaacgagaccgagtgccaggtgctgacgggcattctgcccacggatgacgcgagttgcgtcaccgcgctcaatgcgctgctcgacaagggtgccggagctgcggtcatcacgttgggcggtgccggctcggttacgctcggcgatggcggtgagctgctgcgcatgccggcactttcgagtacggtagtcgataccacggccgccggcgatacgtttatcggcgcgttggcggcggctcgcctagagggcttgccgctctttgagtgcatggccgcgggtgctcgcgcctcggcagtgacggtgtcgcgcctgggcgctcagcaatcgattcccacgcgcgccgaagttgaacattggtttggttaaacgataaagacggagaagcggagtagaacaatggcaatcaagaagctgatccttgatctggatatgggtgttgacgatgcgatggcgctggcctatgccatcgcgagccccgaggtggagctcgtgggcatcaccacgtgctttggtaacgtgcgcgtcgagcaatcggcgcacaattgcctggcggtgctcgatctgctgggtcgccccgaggttccggtgtacctgggtgccgaccgtcctctgcaagcgactgagccctatacgccgccggcgtccaccgcgctcattcacggcaagaacggcatcggcggcgcgagcgtgcccgcgtcgccctacgagccggtgggggcgacctcggccgacggcaacgctgcggtcgattatctgatcgatgccgcgcgcacctatggtcccgatctggtctacgtagcgactggcccgctctccaacctggcgctcgccctggagcgcgatgcggcggcgatgatgtccatcggccgcgtggtcgtgatgggcggcgcccttaccgtgcccggcaacgtgagcgcgggcgccgaggccaatatggcgagcgaccccgaggcagccgacgcggtgctgcgctcgggccgtaagctcaccatggtgggtctggacgtgacgcatcgcgtggtgctcacacgccgcgacattgccggctggacgggctcgggcaccatggcgggctgcgcatttgcgagcatggtcgagcactacattggctcgtacgagatgaacgcaccctacctgggtggttgcgcgctgcacgatccgctggccgttgccgtggcgatcgaccccacgctcgtaggtgcgctcggctgcaacctgcgtgttgatctgctgggcgagtaccgcggtcgcaccatctgcgatgagcgtcgcctgtccgatccggacaagagcgcgcttgtggcactgaccgtggatgctccgcgcttcctgtccgagttcaagacgcgtatggcccgtgtcctaggctaggctcgggatcgaagcacgcccatctgctcgatgtggccgctggcgggccgacatctaccgttcgccagcccgatggtccccggggcggggagagcgctataatgcattttgcatcttggattgttactcctgtgtggaggcatgcccaagagcaatacaacacggattgttacgtaaggcatgaccgcaatagcactgctattggctatcatgcctttttctgtgagtgttcttgaaaggaggttcaccatgcttgcaattaaaaagcttaacaacaacgcggttctttgccgtgacggacaggggcgagatgtcatcgccatgggcaggggcgtcggtttcggcggagattttcctcgagagctccctctttctaaaatcgagcatacgttttacgacattgatcctaaaggacaagatgtcatgagggatcttccctcggatatcgtgatgtttgcggcgaaagttatggacatcgttgccaacgaactgccctacgacctctcgaccaatgcgacgctgttcatggctgatcacctgtcgtttgccgttgcgcgagcccaaaagggggtccgcatcgcgatgcctcttgcctatgaagtgcgggagacgtatccgaaggaatacaaggctgcccagtttatcgtcatgcgactcgagaaggagctcggagagcggcttcccaaggatgagattgccagtattgcgatgaatctcgtgaacgcacgggttgttgaagccgtcaaagccacggccgagcccacaaagcagttcgacgatatgctcgaggacgttatcgagattctcgaaagcgatttccgcattattgtcgaccgcgattcctttgatttcacccgcttcgccacgcatctgcggtacctgttcaagcgcattcaagccggcgagtcgctgaacagcgccaacatgcagatgtacaagaactttcgtgaggagtttccgcagttggcagagtgcgtgaagcatatcggttcctattgtcgtgaaacgtgggacgccacgctctccgaggaggaggaactctatctgatgatccatctcaaccggatcatctccaaaaaaggattgtaacccgtagccattcggggcatgacctttgccgattcgaacagtaagccaagattgtgcaaaggagccaatgatggcaaattacaaaaaggtggcagagcagattctctccactgtgggcggggcggaaaacgtggcttcggttacgcattgcatgacgcgcctgcgcttcagcctcaaggatgaaagcctctcgaatgatgagaagcttgaggacatctcgtctatcatcagcgtcgtgcacgccggagggcaggtgcagctggtgatcgggcccacggtcgacaaggtctacgacgaggtttgtaagcagggcggattcgaggtcacggtatcgattgacgaggaactcgatggccctcagcttagctggaaggagcgcttggcgcccaagcacctcttcaatcagctgctcgatgccgtgagcggcgctatcaccccgatccttccgatcttttgtgtcgccggtatcttcaagatgctcgttattctgtttgggcccgaaggcgccggttttatgtccgaaacgagcgacctgtatcggatcctttccctggtgggcgatgcggcgtactattacttcccggtatttgctgcctacagttcggctaagaagttcaaaacgagccctgtgctggcactgctcatcgccgttgtgatgatttaccccgacatgctcgctattgttgaggacggaaagcctttcagcgtcttcggcatccccatgcagctcgtcaactacacccaggctgttcttccggtcatcttgatcacctgggcccagtcctatgttgagcgcttctttaagaagatctcgcctgatatgttgcgcgttctgatcgtacccgtgggtacggtgctcgtgatgttgccggtcgcgctgtgcctctgcggccctgccgtccaatttgtcatgggccttgtggccgatttcatcatttggctcgcctctgttgccggtcccgctgcgaccgcggttatcggcgcattctggaatctgatcatcgccaccggcatgcacgtgccgatctataccgccatattgcccgccgcgctccagaacggttacgacgccatcttataccccggcgccgcggttgtagcctacaccacgcttgccatcgcgctcgcctatggcctgcgcgctaaggacaaggagaatcgagccacgggctggaacttgttcatcacctatgccttcggtcgcgtgagtgagcccatcatctacggcatcctgtttcgcgacaagaaagctcttgcctggaacatgattggtggtgctgtcggtggtctgctggtaagccttcttcatgccaacgtctatatcttcactggcgttggtttcccatggatgaacgtgctcatgtttgctcaggatatcatccccggcaccatcgggtgtcttgctggcggtgccgtgacgtttgcgttggcgatggtttttggatttgaaggacaggagaagatgccgttgaagtccaagagcggcgattctgaggctgttgaatccgtcgaggcataagaggctactgcacaaatatgctccccagccgttgcgcggtccgaccccttggccgcgcaacggtactgtgctgttgcgcggcacttgccgagtccgttgcgttcgacagcgtgggccgggaatttgatagaaaggacgacaccataatgtttagagaagattttttatggggcggggctctggctgcaaaccagtgcgagggaggatggaacgaaggcggtcgcggtttagccaattccgacatgctgccgtttggcgatcagcgcatggacgtcatgcggggagaccttgatccgcgtgcgttggcacccgacagcttctatcccgctcgcaaaggcattgatttttaccataggtacaagcaggatattgaactgtttgcccagatgggttttaaatgcctgcgcttatcgatcgcctggagccgcatttttcccaaaggagacgaagccgagcccaatgaagaaggccttgccttttacgaggatgtttttaggacgtgccgcgcgcatggcattgagcctttggtgacgctcaaccactatgatgtccccatgcatctcgtcgatgcgtatggcggatggcgcgatcgcaggttggtcgacctgttcgatcgatattcgcgtaccgtgttcgagcgctatcggggattggtcaattattggctgacctttaacgagatcaacatcatgacgcaggcgtgctttatggcggcggggatcatcttcgagcaaggggagaatcgctatgcaacggttcacacggccgtgcaccatgtattggttgcgagtgcccgtgcggtcggggcgtgtcatgaactgtgccccggggcgaagatcggttgcatgctcaacgcaggtgtcttctatccggctacatgtgatccggacgatgtgctggctgcgcaggctgagaatcgcagccattacatgtttaccgacgtccaggtgcgcggtgcgtacccgagccatgttctcaaggaatacgcccgccatggttttgaggtgccctatcgggatgatgaccgcgaagtactggctgcaaacctggtcgatttcgtctcgttttcgtattactcgacgcgcgtcgcaaaagcgcatgcggaaggtcagttcgattcgaaccttcttcgctcggcgcctaatccgtatctaaaacaggagccttgggggaggtttatcgaccccaaagggctgcgcgtcaccatgaatgaaatctgggatcgctatcaaaagccgctgttcatcgtcgaaaacggtttgggtgctcctgatgtgccggaagattcgggtgaaatagaagacgactatcgagttgaatacctgcgggcccacatcgaggcgatgagggagaccgtcgagctcgacggggtggaactcatgggatatacctgttggggcccgatcgatttggtttcggtcgccacaggacagatgcgtaagcgctacgggtttatctatgtcgatcgagacgatagcggtgcgggctcgtttgagagacgtaaaaagaaaagcttcgaatggtaccgacgcgtaatagcaagcaatggcgaagaccttgcgtaataacgttaagatggacaaatgcgcccgttgggggaatagtcgtgccacttcgcctgacaacaggctaaactagctattaaacatttactattctgtttagattgaatttgcggtcgtttagttgccgagccacggggcggtcaagccacgatgctcggccgcgaccgatgctagggggaacgatggctaaagcaagcgtccgcgagatcagccgcattaccggcttttcgcccgcaaccgtgtccaacgcgctcaaccgcaagcgcagcgtgagcgaggagaccgccaaggtcatcctggagtgcgcgcagtcgcttggctatcagcagtcgacgcagctcgagagcatccagtttgtgcttgcgcgcaagacgggcgccatcctggacgagagcaccttccatcccgcggtcatcgagggcgtggagcgccaggcgcgtcgccacggcatgagcacgagctttgtctcgctcgactttagcgacctggacgccgtgcgcccgcaggtcgagggcctgatcgccgacccgtcggccgccatcgtgctgatgggtaccgagctgggcgaggaggactacgccctgttcgccgacgctgccgcccacctgattgtgctcgacggctggagcgatcgccagtacttcgatgccgtagtcatcgccaacaccgattcggtgctgcgtgccgtggactaccttatcgagaaaggccacaggcaaatcggctatctggcgggcgaccttcggatccgcaactttaaggaccgcgagcgcggctatcgccaagcgcttgaggacgcggatcttgaggccaacccgacatggcgcgtcacactgggcaccacgctcgaaggtgcttatcgcgacatgggcgcatggctcgacagcgtctcgcgcgacgacctgccgacggctttctttgccgaaaacgacgtgctcgccgtaggcgccatgcgcgcgctgaacgagcacggcatacgtgtccccgaggatgtctcaatcatcggctttgacgatctgtctctgggcgccttctccaatccgccgctcaccacggtgcacgttcccaagcacgaggtgggcgagatcgcggtgcgccgcctggtgggcaacatccgcaatcccaagagctatacctgcaagacggccgtatcgacctattttgtcgagcgccaaagcgtgcgcgagatctagtcggaacggcgccagaccccagagcggaaaagtccttctagattacctagaatgatttttctgggacggggatttaaaactcattgatccccgtcccgggtagctcatttgggacggggcttttttgactggtatgattggtgcgaccattcgaaccagctaaaagagccccgtcccaatttaactaccgagaggatctgccatggagcgtatcgcgagtttttccgttgaccatctgctgctcgagcccggcgtgtatgtgagccgcatcgaccgcgatccggcgaccggcgccgccgtcaccacctttgacctgcgcctgaccacgcccaataaggagccggtcatgaacacggccgagtgccacaccatcgagcacctgggtgccacgttccttcgcaatcatgccgagtggtcgagccgcattgtctactttggtcccatgggctgccgcacaggcttttacctggttgtttttggtgagctgacgagcgaggagattctgccgctcgtgcgtgagctgttcgagtttgtcgccagctttgagggcgatgtccccggtgctgctcctgaggagtgcggtaactacctggaccagaacctccccatggcaaactggctcgcacgccgctaccttgaccgcgacctggccgatatcgacgagaagcacctgcactatcagcaggcgtaaggctgctggcaggaatagcgtttgcgccagaagcgctcccgctctgaactgcaccccaaaacctggacggcttaaataagaactacgccgcaagggactccgcaggaagcttggatacgcctaggcgcggtccaagaaatcgtccgcacccccaaacaatccctatttcaccgcaactgcgttaggcggctgtcttcgggccggctagtcctgggctttgatactcggcatcagaatctgggcgaggtagtcggtctcgagtttggtggcggcgtctgcgttgccgtctttgccaaccaggtcgttcttgatctggctatacgtatagcggttgccggtcgtcagctcgacaagctcaatggccgtgtccatggggtaggttgacacgggattctgggtgcgcccgttgatagtctggggcaccacgtgcggatagacggggccgctggcatagacggtataaccgttgcctaggctgaccgtgcccaaaaccgtatcgccgtcatcgggcgtaaaggtctcgccatcgcgcacggcgacgagcgtcacgagcggcgtattggcgtcgtcgcccagatagatgcatagcgtgctgccattctgccaagtctcgaccttgccgtaccactcgacgggaatatcgagctggtagaggtcagttgccttgtggcgagcgtcagcatcacgggatgcctgtgccttttgcgcgctcacggcattgacggcggcgtcgcgccgcgcgattgctgcctgctggagcactttggcagccgcggcggagctcgcaccgccctcttcggcatacttggcggcggcatcgatctggtcgtcagtcactgtgtcggccgaaggcaccttgagcttaaaggtggcctgggcacttaaatcctgtccatcgctcttaacggtgacctgcgtcttggtggtcgggacggtatagatggtgccgtcggccgcgatgggggaggcagcgatggagagcgtgtaatcgccgggcagcagtttgatgccgcggccgtgctcgtcaacatagagcgtttcgctcacggaggagccgtcagaatcctgaccgctcacctgtacgggaatcttggagccagtggaacagtcgaggcccgcggcatgcgcgccaatctgcaccgacatcatcgtgtgggcattggcggcgacagcggcagcctgctcttgctgatatccgttccaggcagcatagcctgcaccgccggcgacgagcgcgacggccacgacaccggcgaccatcagattgcggcgcttgggcgacatcttgcgatggcggacctcggcctcgcgtgccgagggaacggacggcaggggaatatcgcccatggcgatggtctcgtccacggcaggagcggagcccaggccgggaagctcgcgggtcagcgaatcttcggccggcaagctgtcgagcaagatggtttcctcgctcgtgtcggattcgggctggtcgtcggcctcgcattcggtgtcttcgtgatctgcctcatcttcggcaggctcaacgtcgtctgcatcctgatcatcggactgcgcctcggcttccggctcatcctgcacatcaacgctcgaatcgtcaaacgcaacatcgtcaagcgaaatccggtctaggctctccagggcctcggcacacgcttctgcatcttgggccgcatcctcttggcccatcgtctcatcattcatacatcccccaagctcaatatcgggacaacactgtacccaaaaacgggaccccatagagccgcctcatgatttgaaatccgattttatatatgcgcatgtttttgaatagatgaatagagacgcaacgacaaaagcccccgaaaagcgagcgaaacgctttccgggggctctgcgaggcattggatgaaaaacctggcgggcgggcctatgcccaggcgccaacagcgaccaacatgttactcggcgtgagcgtaatcgaccttggcgcgacgagcggtggccttctcccaatcgctggtgccctcaaagacatcctgcttgtagggattgcgaccgagcttcttggcgcggtaggcgatgtagatgatcgcggcgacgttggcgaccagtgcggcgatcgagaccgcggtagcggcgccggggtcgagcgtggagtgggtcacaaagatggactcctcctggaagtacgggaacacctgggcaaacatgcaccaaatggccagcgtgaaggcgcggttctggatccagccgcccttgttccagataaaggcggcgatggtgggcgccagcagcagcgcaaagccgcagaaccaggagtgggtgggcaggcagttgtaggtgtagcagaagttccagatatcgtaggcgatgatgtagacccaggtcatgtcgggccacagcatatcggtctgatcctcggaggcgtagacgctccaccaaccggtcatgcagaagatgttgatgatgccggcgatgccgttgaacacgttgttccagccggcaagctgcgtggcaccctcggaggtgacccaagtggactggcccaggacaaagaagtgataggcgctctcgaagtcggacacgacggcgatcatgatgttgatggcgacgatcacaaacggccatgcgcggaaccaatgcgccttgccgatcttgccccactggtacttaatggcaatgaagccccagcaaccggcgagcgccgcgtataccttggcgtagtggaaccagctgttctggtacacatgggtggggttggtgagcgcccactcggcaccctgtgagacgccgatggcgatggcgacgcagtagatggtcatggccagcggagccacgccaaagatgattgctgcgcccagcttggtgcggcggccgacctcgttgagcacgatcaggccgataaagaccatggcccagccggcccagtggataagggtatcgctaccccaaacatcgaacagcatgctgctctcctttcacacgcccgcggcccctcttctgatcgcgggcagtttggccaaatgtcgtcagttctggggcttgcgctccggatacttggcggtatagccctcgatgtggagtgtcgaggcgatgatttccttgaccgtctcgtcgggcacatcggggtgcgtgcggatatacatcaacaaccccatgatgagggtgtagaacgtctcgtagacatggtcgatgcgtagctcatgatgggcgacaaaatccaccacggtggtgtcgcagatatactgcgccacgcgttggaccacgttgtgcagaaagccgccgtagagcgcaccgctgctggaggtgagcgtactcggcagctcgtggccgctggcgaccaggcgcttaaagagcggggcgacggtgtcgagtgcgccctcgatatcgccgacggtgcggttggcattccactgctcgagctcggagataaaaccgtcgattgcctcgtccatgacggcggtgacggcggcgtccatgtcggcgaagtagtggtagaacagcgagcgcgtgcagccggctcgcttggtcacggccgataccgataggtgggacacgcccagctcggagcttacggtgcgcacggcatcgaggatctcgcgacggcgttcgtcgcccgtcaagcgctttgccgtgctgtcgggcgcggggacggcgtcggccacagaggtgttcgctgcgttactgctcatgtgcttgccgcctttcatccgtttgagcctgaccgttcgcctaacagtcttgaatattgttgacggttcgtcaatactgtttttgacacaatgtcaacaataacgggtgaacggcgtgggggcatgtcgagcccgtaaaaagaggggcgctgcgtgcctgccaggctgcggcaagagaagggacgactatgattctcaacggaccggggattagctacaccgagcccgatatcggtgcggagtttgtgccgccgctgccggagcatccgcgcgaggccatcgtcaaactgtgcgagcactgcactaaccgcctgctgcatcgcgacgagctgctgggctacgagtactggtcgtttgccgaggccgcaactgacgagcaggccgaggtactctgcaagatgaagatgcgtcgtccctacacgctgcccgagatggtcaagctcaccggcatgcccgaggcccagatcgagaagatgctcgacgatatgagctacacgggcctgctcgagtacaactgggaaaatcccgagcgcgccaagcaatgggtgctgcccatgctggtgccgggttccgccgagttcctcaacatgcgcgtgagccagctcgaggagcacccggtctacgccaagttctttgaacaggcatccaagggcccgctgtccaaggccacaccgatggtgccgcccggaggcgccggtatcggcatgcacgtcattccggtcgagaaggccattgacgccgcgagcacgtcggtgcctattgagcatattgagcactggctcgacaaatacgagggtaagtatgccgctagcacctgcagctgccgcgcgagccgtcgcgtgatgggtgagggctgcgccgacgacccggccgattggtgcatcgccgtgggcgatatggccgactacgtggtcgagaccgatcgtggccattacgtgacccgcgacgaggtctacgacatcctgcgccaggccgaggacaacggctttgtgcaccagatcaccaacatcgacggcgagaacaagatcttcgccatctgcaactgcaacgtcaacgtgtgctacgccctgcgcacctcgcagctgttcaacacgcccaacctgtcgcgctcggcctatgtcgccaaggtcgagaaggacaagtgcgttgcctgcggtcgctgcgttgaggtgtgcccggccggcgccgccaagctcggccagaagctctgcagcaaaaaggccggcggacaggtgcccgagtatccgcgccaggagctgcccgacgccaccaaatgggatcacaccaagtggtcgcccaactaccgcaacgacaaccgtatcgagacgcatgagtccggcaccgctccctgcaagacggcctgccccgcgcacgttgccgttcagggctatttgaagctcgcggctcagggtcgctatgacgaggccctagcactcattaagcgcgagaacccgctgcccgctatctgcggccgtgtgtgcaaccgccgctgtgaggatgcccgcacccgcggccgtgtggatgccgccgtggctatcgacgaggtcaagaagttcatcgcccagcgcgatctggatgccgcgacccgctacgtcccgcccgtggttacgccgacgcgcgctggcggctttgatcagaagatcgccatcatcggtgccggtccggccggcctgtcctgcgccttctatctggccgagaagggctacaagcccgtcgtgttcgagaagaacgagcgcccgggtggcatgctcacctatggcattcccagctttaagctgcagaaggatgttatcgaggccgaggtcgagatcattcgcctgatgggtgccgagttccgctatggcgtggaggtcggtcgcgacgtgacgctcgacgagctgcgcgagcagggctttaaggccttctacgttgctattggctgccagggcggccgccttgccggtattccgggcgaggatgccgtggacgtgaccgtggccgtcgactttttgcgcgaggtcaacagtggcaagatcgacgcgttgcccggccgcaccattgtggtgggcggcggcaacgtggctatcgatgtcgcgcgcaacgcctgccgtctgggttccgagcacgttgagatgttctgcctggagagcgaggcccagatgcccgccagcgaggaggaacgtcgcgaggccgttgaggacggcgctcacatcagctgcggctggggccccaaggagattcacctggacgaggccggtcgtgtatgcggtatcaccttcaagcgctgcacgcgtgtctttgacgacgagggccgttttgcgcccgagtacgacgagaacgatctgcgccgtgtcgatgccgaccgtgtcgtcatgtcgattggccagtccattgtgtggggcgacctgctggctggctccaaggtggagctcggccgcggccagggtgcccttgccgatccccagacttaccagaccgccgaacccgacatctttgtgggcggcgacgtctacaccggccccagctttgccatcgacgctatcgccgccggtcacgaggccgcggtgtccatccatcgctttgtgcagccgggctccacgctcaccatcggccgcaaccagcgccgctacaccgcgctcgaccgcgacgatgtcgtgatcgagagctacgacaacgcgagccgcgaggttgcgcatgtggaccgcgaacgcgagaaggctgcaccgtttagcgagtatgttgagacctttaccgaggagcaggtgcgcgccgagaccgcccgctgcctgggctgcggcgcctcgatcgtcgaccccaacaagtgcatcggctgcggcctgtgcaccaccaagtgcgcgtttgacgctatccatctgtatcgcgaccgccccgagtgctccacgatggtcaaatacgagcaaaagctcccaagcctgggcaagtatgctctaaagcgtgcgattaagatcaaattcgggaagaaataacaggacgtaacgagtaagggagcggcgcagagcgtcgctcactgacgtctggccgacatcgcatcaaccgttgttgaaaggtttctaccttgcatgaattgggaatcgtctatcacatcattcgcgatgttgagaacgtggcgcgcgccaatggcgtgcgtcacgtttcgagcgtgacgttactgctgggcgaggtctcgggcgtcgttcccgatctactactcgacgcttggcgctgggcggcagataaaaagcctatcaccgagggcgcggagcttatcgtggagccagtcaacgccgtgacgcattgcgaggcgtgcggccacgactatgcgacggtcgagcatggtaagacctgtccccattgcggtagcggcgatacctatctgctccagggccaagaggtcatgatcaagcagatcgagacccccgacgaggacccggcagatgctgctcctgacggcctctccgacgtccccgatgctgtcgacgccgccaaccctctccacatcgcctaggatcctctataagttgcggtgaaatagttcctaaaaccagccttctggctcttaaacaagaactattccaccgcaattttttttgagtagtttcgaagtgcataagtcatacaaatagtcaagtcatgtctgtttaaacaaaatagcagcagtacaagcacattcgcacttgcttaaaatcgttattaatgaacagcctgtttgtatctgtaaagtacatggcttgatgggcgacgctttggcgggtaatgagtcgaaaagcagtaatgtaatcaacttgtaacaaaaatagacgtttaaacaaataatgcaaccttttacgaatttagctataattccacaaaccaaacaggtatactcctttcatgtcgtgtaggaattacgtagacaaaaaggaggttatgtgatggtaagtattgttcttgctagccacggggacttggcagctggaatcaagcagacgggctcgatggtctttggcgatcagccgtctgtggccgtggtctcgctcgagccgagcatgggccccgacgacttccgtgctaaggtcgaggaagcaatcgcttccttcgaggaccaggagcaggtgctcttcctcgttgatctgtggggcggcacgccgttcaaccagattagcgggctcatcgagggccatgattcctgggctatcgtcaccggtgtcaacctgcctatgctcatcgaggcatattcgcagcgctttgatgcaaagaacactgcacatgcgatcgcaaaacatctcgtgactgaggctaaggctggcgtgcgcgtcaagcccgagtctctggagcccgaggagaagaagccggctgcggccgccgctgctcctgcaggcgccatccctccgggaacggtcatcggcgacgggcacatcaagattgcccacgtccgtatcgacacccgtctgctgcatggccaggtggccaccacgtggaccaagcagatcaaccccaaccgcatcatcgtggtttccgacggcgttgctcacgacgagctccgcaagaccatgatcgagcaggctgcccctccgggagtccatgccaacgtcgtgcctatcaagaagatggccgaggtcgtcaaggacacgcgttttggtgacaccaaggccatgctgctcttcgagaacccgcaggatctgctcaaggccatcgaggccggcgtcgacatcaaggaagtcaacatcggttccatggctcactccaagggcaaggtcgtcgtcaccaacgccgtcgctatgggcgatgacgacgttaagaccctcgaggccctcaaggccaagggcgtcaagttcgaggtccgcaaggttccttcggatgcctccgaggatctcgacgccatgttgaagaaagctaaggccgaactggccgctcaagcatagtaaaggagggtccgatacatgtctgcaatcactattctgcttgttgcgattgtcgcgttgcttgccggtatggaaggcattctggatgagttccagttccatcagccgctcgtggcatgcacgcttatcggtctcgtaaccggtcaccttcaggagggcatcctcctgggcggttcgctccagatgatggcccttggctgggctaacgtcggcgccgccgtcgcgcctgacgccgctctggcctcggtcgcttcttcgatcatcatggtgctcgccctcaacggcggcgccactgattcggccaaggccgttaccgcggccatcgccgtcgccgtcccgctgtcggtcgctggtctgttcctgaccatgatctgccgtaccattgctaccgctatcgctcacgccatggacggttgcgccgagaagggcgacttctccggcatcgagcgctggcagtacgctgccatcctcatgcagggccttcgtatcgccatcccggcagtacttctgtgcgttatcccggccgaggctgttaccaacgcgcttaacgctatgcccgactggctgtccggcggcatggccgtcggcggcggcatggtcgcttccgtcggttacgccatggtcatcaacatgatggccaccaaggagacctggccgttcttcatcctcggctttgtccttgctgccatccctcagctcacgctgatcgcccttggcctcatcggcatctcccttgccctcatctaccttggccttaaggatctggccaagcagggtggcggcacgggcggtggctccggcgacccgctcggcgacattctgaacgattacgagtaggaggggagtgatacatatggcagagaacaagattcagctcaccaaggctgaccgtaagaaggtttgcttccgtcatcagttccttcagggctcgtggaactacgagcgtatgcagaacggcggctggtgcttcgcaatgatccctgcgatcaagaagctctacaccagcaaggatgaccagattgccgcgcttaagcgccacctggagttctataacacccacccctatgtttccgcccccgtcattggcgttaccctcgccctcgaggaggagcgcgccaacggtgctccgatcgatgatgtcgccatccagggcgtcaaggtcggtatgatgggcccgctcgccggcgtcggtgaccccgtcttctggttcacccttcgcccgattctgggcgctctgggcgcttccctggccatgtccggcagcatcgtcggtccgttgctgttcttcttcgcgtggaacatcatccgttacgctttcctgtggtacacacaggagtttggctacaaggtcggctcctctatcgccaaggacctctccggcggtctgatgggcaaggtcaccgagggcgcttccatcctgggtatgttcatcatcggcgccctggtcgagcgctgggtgtccatttccttcaccccgatcgtctccacggtcaagcagtctgctggcgcctttatcgactgggctagcctgccttccggttccgagggtatcaaggaagcgctgacgatgtacaactccgtcggtgctaccgcccttgatcagatgaaggtcaccacgctccagggtaacctcgatcagctcatccccggccttgccgccgtgtgcctgaccctgctggtctgcaagctcctcaagaagaaggtcagcccgatcgtcatcatcctggctctcttcgccgtcggcatcatcggtcgcttctgcggcttcatgtaagcacgcttcggcttaagaccgagaattgctaggcaagggcttttgagccattgaaacggaccgcacccggtgggtacactggatgcggtccgattgttttatttggagggcgaggcgcgcatggcgcaatctcagaacagcacggtcgatctggcaacgccggcaacctgcctgatggggcttaccagccacggtaacgtgatggtgggcaataaggcgttcgagtattacaacgagcgcaatcccgaggattatattcaaatcccgtgggacgaggtcgactatattgccgccgaggttttacgcggcaccaagaagatcacgcgttttgccatcttcaccaaggacaacggtcactttacgttttcgacgcgcgacgacaaagagacgttgcgcgcggtccgcaagtacgtcgacgaggataagcttgtgcgttcgcccgactttatcgatgtgacggccaagggcgccaagagcatcccctccgttatcaaaaacctcttccacaaaggcaactagtcattaaagagcgccccccaagtgggacgcagtttcccatggggctcgatcgggaaagtgcatcccagttcgagcgccgattccgggatgtagtttccggaacggggtcgtttgggaaactgtgtcccgtttcgagccgaaattctgggacacagtttccagcgaggtcccattgggaaagtttgacccagaatttgcctggatagtgggacacactttccggagggctgttccatcgcaacttcgaagagtggctatacgctgtattacaacggcgtaaatctgctacactagtacaacatgcctccgtagctcaggggatagagcaccgctctcctaaagcgggtgtcgacggttcgaatccgcccgggggcaccagaagaaattgcaggtcagacggtataaaacgtctggcctgtcttcttgtataagggtcttattagcggcatttgggtagaaattgggtagaaagattttttgtggaggtctaagcccaatattcggtttccaaccttttccacagcttacgggcttatagaagccctccggctatggaaagcgttgaaaacctaggtcgatgttgtcgtgagcgggcgagtttccaacagtccccggcgtctccgggttttactggggaccctccgacaccggggaccgttgaaaactcgcccctctatccgcaaggttgcccttaccccttaaaatggtccgcaagagacaacgacgcaggaggtccggtatgcctgccagcaagaaagaggcaaaggagttcgtaaagcggtggaagaagcgcctcagcgccatccccgcgggctccaacaatgagcagcaggacacgcagaagttttgggtcgacttgctcatcaatgtcctgggtatcccgtccaacaccatagacagcttcgtcgactttgagcgcaaggtgagaggccgacgcatcgacgtgttcgtctccgaccacaacttcctctgcgagcagaagtcgtggggcatcgacctcgacaagcccgagcctaggaacgggggcatggagacgccgctccagcaggccatgtggtacgcgcggcacctgccgtactccgagcgcccgcgctgggtgatgacgtgcaacttcgggaccttccgcctttacgacctcgacaacgagaggcccgaggacaccgtgcaggagttctccctcgaagagctcccggacagtctgtacctgctctcattcctgacatccaacgagacgagccgcctgcacaaggaacagcagctttcaatcgaggctggggcttacgtctccaggctctatgatgctctcgccaagcagtaccatcacatcgaggagaaggacgagcgggcccaggaggagcagcgctcgctcaacgttctcatcacccgaatcatcttcttactttacgccgaggacgccgatctcctgcaatcgcatcaggcgttcggcaggtactgcgagggagaccccgcgaagctccgtcgcaaattggtcgatctgttcgagaccatcgatactcccttggatcagcgggacgagtacatggacgaggaccttgcggccttcccctacgtgaacggtgggctgttcgccgactcctccatcatcgtcccgcagatgaccccggaaatccttgaggccatcaccgacgcctcccaggacttcgactggcgcgagatctcgggcgtcatcttcggcggcgtgttcgaggggactctgaatcccgagacgcgccatgccgggggtatgcactacacgagcgttgagaacatcgagcgctgcctgaagccgctgttcctcgacgagttgtgggacgagctgcacgaggccgagggtgagaggacggcggcgaagcgcaaacaggccctggcgaggctgcacgacaaggttgcctccattaccatcggcgacccggcgtgcggctcgggcaacttcctcaccgaggcataccggcagctgcgcaccatcgagaatcgaatcatcgaggacgagctcagcgaggagaccggcaacgcgggacagacgtccctcgtcgttgcgcaagacagtcccgtccgcgtctccctgggccagctgtacggcatcgagataaacgacttcgccgtttcggtcgccaagaccgccctgtggatcaccgaggagcagatgcttcgtaagacgcaggagatatacgtcgactatgacttcgacttcctgccgctcaggagcctcagcaacctccatgagggcaacgctctcaagatcgattggtccgaggtgttccccgacgacctcacctatctcgtgggcaatcctcccttcctcggggctcgtaaccagtccaaggagcagaaatctgaactgcttgaggtcttcgacggagcgaaaaacgcgggcaacatcgactactgcggggcctggtacatgaaggccgcgaggttcacgcaggggaagcgcacgcgctgcgccctggtctcgacgaactccatctgccagggtgagcaggtcgccaacctctggaaacccctgcacgacctgggtatccacatcgactttgcgcacaacacgttcaggtgggacaacgaggcggcagataaggcgcatgtcttttgcgtcatcgtcgggttctcccgcgaagcggggaacaagacgctcttctaccacgcgaccccggacagcgacgaagaacaggttcccatggctcgaatcaacgcgtatctgaaagacgcccctgatgtatttatctatagccgcaacaagcctatttgtgatgttccggaaatgggtatcggaaataaacctattgatggaggcttctacctatttactgatgaggagaaagacgatttcctgaagaaagagcccaaagccgaagccttctttcacccatggcttggctcaaaagagttcattcatggctatcaccgctggtgtctatggcttggggaggcaactttctcagatttaaagcagcttcctgagtgcagaaagagaatagagcaggttcgtgaatacaggcttgcaagtaaaagcgctggaactcggaaaattgcagataagccgacaaggtttcatgttgagaacatgcctgagggaagttccatcatcatccctgaggtctcttcaagcagaagaaaacgtgttccaatgggctttgttgggccagagatattttgtagtaacaaggtgagattgattcctaatgcctctctctatcactacggcatcctgcaatcccagttccataatgcatgggttagggtcgtaactggaaggttgaagaacgattaccagtactcggccaatattgattacaacaacttcgtctggcccgagcccagtgaagagcaaaggaacgaggtcgaacgctgcgcccaagccgtgctcgatgcccgagacgtccaggagggtgcgacgcttgcggacatgtatgatcccaagaatgagacgttcttccccgagctgatggccgcgcataaggcgcttgacgctgctgttgaggctgcctatggcgtcgacttcggcggggacgaggagaagatcgtcgcccatctcttcaacctctacgccgagaaagtcggtgaaagtaaatgattcaccccacgcgttttgcccttccagaggaggactatctgacccttctcgggggggcggtttatgtattcaactcgaatgtctccttcttcgttgagaaccttctgcacgctggggctcccgactggtacgagcttgccgacatgatgacggggcagctcaaggatgaaggaaggaagtggcttgtgaatgaaaaggacaaaagagtcctggaactgctttgcgagctcggaaacgagaggaacagaattatccacagctttccggtaacgcatgatgggcgacaggagcttcgaacgaagactaaggccaaggacgaagagcaaccaaactatcagtaccagattgaccgtgaactgctccactccttcatcgacagaaaccaagaactgagcgacgaactgtacgagtgcagggacagaaacgtcgctatggctaagctctcctagggtcctgtcaagcggcttgtgatgcagcaatcggccttgcggccgatgggtcccgcttatgggcgggacccccgcgacgcacggcgtcgctctcgctgcggctccctggcaacgctccccagggtcgcgtttcgtccgcctccgctcacgccggcccagcccgccgaacggctgcgctcgatggcttccagaagtcgccatcgctccgccgtggtcgccgggctgggcctctcgcgccgggtcgccgagcgccgtcgtgcgacgcttcccagggtcgcgtctcctcggcgtcggttcaaccggcgctcacctgcccgggctcgcgttgccttgggcaaccggctcgctccgtgcaggcaagatatggattccgttgcacggaatcatcttgcccgcctgcggcgggacggcgaaccgctccgaggtcgctctcaccgaagggcaaaagaaggggccgggacgcctgttgcgtcccggcccaagtgcttagtccccgcgcccgttctggttctcgtgcgccttgcgctcaagttcccagaacgccctcatcgccgtcgctatcccgcgcagcgtgaagcggacgacgaggccggtcgagcggtcgaccgcgaagccgagcctgccgccgttgaccttccgcacggccccgagggtcttcgagaagaatcggtactggaggctcccgcccttcgacctcgcgagctcgatgccgtctcgcctgagccgccggtcgagctcggccatgcggtcggggcagtccctcattcgcccgacctcctcgacgcggcgggcaaccgccacgcggacgcgggcgttctcggagcgctcggcctgccccttgcgggccatctcgcgttcctccctgcccggttgtctcgcgtgaacgcgcgagttggccttgccgcgttcaagctgcctgagcccatacttctcgtccaaggcgcggacggtcttcaccctcgcggttgcggccttgcgtgcgggaccctcgtcgagccttcggccggtttccagatcactgcggttgatgccgaggtgcacggcgtagcggtcggtggcgtccgcgcggcagcgctcgcggtgcagcaccatcacgacttcctggttggggtagcgctcggccacgtactccctcgcatagcgcatgcacagctccggcgtcatcttcccgccgttgaggtcgcactcgtctgggaggaacccgagtatctggtgctgcatgtaggtacacttggcaccggccttgccgggcatgtcgtgacccatggctgctctcgtgtctgccatctcctgaaaccagcggccttcgtcgatgatgttctgcgtgccgtgggcaagcgccttgtcgcggtcccatgaaaggtagtccctgagacgggagaggtgcctttcgctgcagacgctcgtctgctttattgccgtcatggtcgcctcctagtcgagcgagagcccgctgaatttgctgccacctgcgtccccggccctcttctcgggctcgggccactcggggcaccagacggggatcgcctcggccatcttctcggtcgccgaggcgtcgagccccgcctggtaggcgcggcgattccctgcctcgtgctcgggcgtccccaggccgaagtgctcctttgtgggcgtgttggtgcagtcggtgacgggggagcggaagacccctgcgcggcacgcgggcatcccgttgtccgcatgcttcacgacgatgaccccgtcccggtcgggtgccatgtcgcgccactcccagggatgtatcacgtcgtcggcgctctcgctgtaggacgtcgaggaggatgtgcccgacgcggccctgccgttgctcgtgccttgcgtgtggcgcgtggtcttgccgacgagctcggtgaagtaccggcggtcctcctcctcagcgagcttcatggcgactttgacgccgcagttcgcgagaattttcctgcgcccgtctcgctcaccgtatttattaagctgggatatatcttgcgttgcccccgtccagtaaatctggaacgaccttccaagcgaaaggagggcgggcaggcactcgacgcggggaaggttgccccactcgtcgccgagtatctgcacggggcgggggagcctgccgccgttggagtcggcggcggcctggacggacgcccagagctgcgagaggaatatcgccgctatgcagttgtagggcgagccctcgtcgagcacgtggaggaacacggcgctcttgttctcaaggatcgaacgcgggtcgatgtcggacccggacgtcatccacgcgaccggggctgacgagaacgggcggagcgccaccttgagcgtcgagaggatgctcctgagctcgttgccgcccgaggagacgaactgcgaggccctgttcttcgcggggtgcccgctcggcagggcgcggaagacggacttcaacggttcggccgggtcgtcgccctcggcctcggtgccacggtccaacacctcgcagacggtcgccagatgcttggactcctcggggcactcgtcggacatggagaccagcaggacgagggcggacaggagcccccgcgcggacgcggtccagtgcgagcccttgcctttctcgtcgtcctgtaccacgagctcagcgatggcgtccgccgcctgctcggcctcctggttccggccctcggcgtggaggtcgagcacctgcctgagcgggttgaacctctggccgcgatagggatgctgcgtgtcgagtaggaggacgcggtagccgcgacgggccagctcgtcgcccgtgagctctacgagctcgttcttcacgtctgagacgacgagggtcgcgggttcggagccgtttgagccgtcgccgtagctgagcaggtcgattgaggggaggtagaggaagcgtgacttacctgacccagtggcccctgatacgaaaatcatcttcttcggctcgtagagataacagggcttaccgcgatatttggtgaaaccgtagacgaacccgcgcgacgatggaatcgtcgagccgtcccaggtcacggaccccttcacgacctcgcgacctgtcttgacgtgggcgtcgccgagcacgccgccgtcctcggcccgcgcgttgagagcacttgagtaggcgatgagggcgcaggtgcagagtgcaaggaggaagacgaacaagaccccgaggggataggcggcgaacccgcccgagagccaccagccgaggacgatccccgcgtcgaacgttgcggggattgccgatgtgtcgagcccgtacccggcgacgaacgcgtcgatgggggcagcgagcacggggcatgcgaggactgctaggaaaatggatgatacgagtgctgtgagcagtttcgttttcatggttactccctggctttcgataggagggctgaaagctgcgacgccgtgttcgataccaggcggacggcgtctgcaagttgctgggatgtctgcgcgtctgatccgtatgcgttgagggcgtgacaagcctggtttaggttcccgccctcctttttcagttgataaagaatctgccgcagcgtcgcctcgtcggcgaccctggcgggcttctccccgatgcgaagtgcggactcgcgcataagcgccgatggagtcatgccgaaagcggaggagcgcgccatgatggcggcacgctcctcctcagtcatacggacgttgatgtgcgcggtttttgcgttgccgcgcatggcttaaccctcctgatcgtagaaggtggcatgaggtgcgtcgaagatgagcttggtgctcccaagcgtgccataacgcgccttaaggacccgaacaagcaggggacgaacgtcaagctctgagttgtatttccgctccttcttgtccttgccatcgacctgcaggaagagggcgttgtcggagccatagtcgataccctgcgagcccgcgaagacgttgagctcggtgttcgcgtcgttgtacttgtctcgtgcgacgctgctgatcaggaagacggggacgtcatacgtccgggcgatgtttccgagcgcctgcacacaagcggtgatgacaacgcgctcttcagcgcggacgtcgaaggacgttgcggcgatgagctgtagataatctacgaagagagcgggatgctggccgcgaacgtggatgcagtcaccgatgcaacggcagaggtcttccatggacgtctgaccgtccatgatgcatgagttgggtgctacgctctcggcgtaggtggcgcaagcgcgctcaaatgcctctttcttctcggggatagccccggtcgcttcggaaaggctgaagtctccgttgccgaggcgcgtgatgcccttctgagcaatgcgatacgcggggagttccgcggagtagaagacggtgggcacgccttgggaggcaaggtcgtcagagataaccttgaggagcgtcgttttgccggcagcgggtgccgctccgactatggtcaggattccgggtacgacgcctccgatgagcttgtcgagagaggggaggctgcgtatatgagccatgggcttacgcccgttcatttcctcgatataggtcttgagctgatcggcttcgacgttgaatgagctattggctacaggctgcacggatccgacacctccaactcgtgaaggtactcaaaaaagctggactcgatgacgaagaggcggctatgaagcttgaggcagcgaccgctctctttcatgagcgatgcggcggcaacctccccaagcccggtcagctcacgaatctcggtgacgccgagcagacgctcgcgtcccagaacgacgcgaggaggagcgggtgcgatacccgctttgggaatagcggaatctaccatggtagaatctcctttggtctgctcactcctccccacctcagtttggcgactagaggggaggggtgggcggctttttgtttctatggccttctttgggcacctccattccggcattcgcttatctgtgcaattcgatgatactgcttctggcaatcgaggcgctgaagattcagaaaaatttccgaagattttcggataagcacttttacctcgaaaaacagggttatacttgcaatgaaaaccgattggaggatgaaatggaacgctccaggaaaccgaaaaaacgaaagtttgggacgaccatccttgaacagaccgatgacaacatcagcatgttcaaggaacaacatccgcaagagtttaagactccgggggaagtggtcgaccttctcgcgagcctctgtctccgcgtcaacaagggcgcagctacggaactgagcgctttttgtgcgcaacgggtcaagtctattcaggatgagcttagtggatatggcgatgctgagtccctgtcgctcgctgccgacgacttaaacgacaagctctcttattacaaggctcttcgtaatcacatgttgcgatttgttccgcaagacagccttgttgataaggggccgtcaatgaaacgcgtggacctgcgaggtggctcgtatctcgttgtccccgacgattggccggtggtcaatgagtcgaatgctgcgtcatgcgactatgctttcgtccttgaagtgcggaacgcaagcgacgcaattccgcactatgtttatctttcctcaaaggaagcctgtcctacggatgaggtgcttgatgcgatagctgataaatggccggggattcgtgatgtccagagttctcaggtcgagccgatctatgacaaggacggtgcgattctgaataccgacgaatgggcgaaggcacctataatcggcgtcttccccattcgtgacgcctcatcgttttcctgggaggataaggctccatatggggcgatggtctatcgtcattagcccatctatgttcaaagcaagagaagggccgggtatatctcggcccttcctttatgaactgctcttttgggaaatgagctcgccgaaggcatctgctgccttacggtcgtttgcctcgatggcgtgggagtagatggaaagcgtcgtgctcggagacgcgtggccaagtcttgcctggacggtcttcacgtctgcgccttctccgataaggagcgtcgcctgcgtgtgccgcagggcgtgggggacgagcccactgtatcccgtgcccctcacgtgctctttgccgtttcgctggaatcttctggtgatattgctgtagctcccaaagccgttatcgacgcagaagtcgcggaaccatcggtcgaagttgtggccgtctacgttgacgactgtggcgtatatgccatcctcggtcgtgacgacctttatgccgttgacgataggcgtcttgtcgtcctgatcgagagtgtatcggttgagttgcgcccgctgttccagcttccatttgccgagatagcgggccagggagtcgttgattgctatggtgcgtcggctcatcttcgattttggtgctcggagagtcttgtcattggtgaactgattcgacacgctcaacgtgcgccgcccaaggtcgatgtcgccccaagtcaagccgagcatctcgccgcgtcggagaccacattggagcaggagcatggtgcctgttgccttggccgacagtggttcatccatgaggcaagacagaaatcgtgaagcctcgtctgccgtaagcggagctctttccctgtaagttggtttgggaagcttgatcggcgtgcatgggttacgaaggatgagctcgttgtctacggcgtcttggagaatctgtcgcagcttgacatgtgtcccgtgtaactcggcttcggacattcctcttttgcgggcgtctgcgtagatgcgccgtatatcgtcagggtggaggtcggcaagtcggatatggccgaacatctcttgaatatggctaatgtagttgccctcacgggcgtaggcgagcggtgacttgaagctctttatccttaggctgtggaagtcctcggcgtactttacgacggtgaggtttccgctgtcacggacgataccggagttcaactcctccttgtattcttccagggctttgcggagcattgcctgttgtgtgcgtctactcacaccttcgcagtgcagcgttctcttggatgagtaggcgtatttgccggtcttggggtccttgccgaggttgaagcggtattggaacaccccttctttaacttgatatacgctgccgtttccgacaactcttggtctggtgctcatggtgggattccttgggattaggctaggggcaagcctttaagggcttgcccctagcctaatcccaaaattctacccaggcaagagtatctgggtagaattagggtagaaaatttttgaagcctttatctcgcgattcttgaaacatgccgttttacatgcggctatataaaattgtataaaattataaaacaccagctcagatagaaatacaagacctcctaaagcgggtgtcgacggttcgaatccgcccgggggcaccagaagattatgacggcgtcgcgagagcggcgccgtttctggtttgtggggaccgccggcggattcggaccgtcgacacccgcgtcaccaatttccccgcgggggggggagttttcgaatccgcccgggggcaccagaagattatgacggcgtcgcgagggcggcgccgtttctggtttgtggggaccgccggcggattcggaccgtcgacacccgcgtcaccaatttccccgcgggggggggagttttcgaatccgcccgggggcaccagaagattatgacggcgtcgcgagggcggcgccgtttctggtttgtggggaccgccggcggattcggaccgtcgacacccgcgtcaccaatttccccgcggggggagttttcgaatccgcccgggggcaccagaggaatatcgagcccggtaccgttacggtgccgggctcttctggtttaaggcatgccgtagtattcgctgcttcagataaagaaagcgcccgcttgctgggggagcaagcgggcgcctgtgagcgaatatgtttgcggcgagagccgtgatgggcggtggggtggcgactagttggtcgtaccggaatcgtcacccgtgcccgagccagagcccgaacccgagccagaaagtgcgaccgttagcgtgatcgtgctgtcggtggactgcttgccggtgggggagacgcccgtaacggtggcatcctcgttaccgctcacgggattgccgttctggtcacagaagccaatgttatagaaaccggcgttgttgagcgcggtaacagcggcggaaatgctcttaccgtacaggttgcccgggacagtggccttgccggacttcttggcaatgacgacggtaatcgtggcgccgggcttctgcttgccgctggggttccagctgatcacggtgccctcggtaaccgagtcgttctcctggtagctaacgtcgacgccaaagcctgccatatcgagggcgttgcgcgcctgggcctcggtcatgtcggtcagatcggggacggacgtggtatccgggccgctcgagaccttgtacgagatggtcgtgcccttctcgacttccttgccggcatcagtgccctgctcaaagacctggccttcgtcggcctcgttggcctcctcggttgcgttgcccttcaggcccacgcttgccagcgcggcctcggcctggtccttggtcaggccgacgagctgcggaacctcaactttctcggagggcttggggcccttggagatcaccaggttcaccttggagcccttgggcttcttagtgttgccgttgggggtctgctcggcaaccttgccctcgtcgacatcgtcgttatagctctggtcgacagttccgacctcaaggccggcctccttgatcagctcgatagcggtctgctggtccttgttaagcacatcgggcaccgtaacctgctcgcccccaaagagcccggtggcgaaggccaccacaacgccaaccacggcgattgcggcgactacggcggcgataatcttgttcttgttggacttgggctgatcgacctcgtaggaaccggtggaacccgagacggcgctgcgggggttggtctgtccgcttacgcccgatacggggcgaaccatagcgcgcgtggagtcagacagctcacgggtcttggtagcgcccagctcaccgggggcgccgatgatgcgcgtgggctccgagacgttgacggcacggcccgacaggtagctgttgagcacctgacgcagctcgtcggcggtctggaagcggtttgccgggtccttctccatgcacttgaggatgatgcgctcaaggtcggcgtcgacaccggagttgatctggctcggcggaataggcaactcgttgacctgcttgagtgcgaccgagatggcgtcgtcgccgtcaaagggtacgcggccggtggcgcactcgtacatgacgacacccagcgagtagatatccgaggtggggccgaggtcctggccgcgggtctgttcggggcttacatagtgggcggtgcccagcacgttgttatcctgcgtgaggtggctgttcttggcgcgtgcgatgccaaaatccatgaccttgatattgccgtcgggcagcaccatgatgttttgcggcttaatgtcgcggtggataatctcgtgcttgtgtgcgaccgaaagcgcggagctgatctgcgagccgatctgcgcgaccttcttgggatcgagggcgccgtggctcttgatgccgctcttaaggtcggtaccgcgcaggtactccatgacgatgtaataggtgtcgccatccttgccccagtcgtagacgcccacgatatagggggaggacaggccggccgctgcctgggcctcctgcttaaagcgggcggcgaaggtggcgtcgccggcatactgcggcagcatgatcttgacggcaaccgtgcggtcgaggacctgatcctgtgcacggaagacggtcgccataccgcccgttcccaccttatccttgaggaggtatcttcccccgaggaccctctgttccattcctgctcctaacataactattcgctcaacgatgtgtgtagtaccaaatgtatggccgctggggccgtgtggcgcgttgtcgctagctcatcggccgcggcgcgtcccaagtatccgctttgatcacgggcatcacgctccctgtgcggcgagcgccgcggtcaggacgatgccggcgatcttggccgcctcgacgtcgtgtttgtcgtaatcctccagggccaccgagatggcaaccgtgggtgaatcgtaaggtgcaaagccaacaaacatagagttgacgttggtgccgccggtctcggccgaaccggtcttgccggcaaccttgacgcccggaatctgggcatcggtgccggtaccggactggacgacggcgagcatggcctgcttgacctggtcggccgtggcagagctgacagcctggcccagcgagcgggactgcgtggtcttaaccacggttccgtccggggcgagtatctgggacacaaagaacgggtccatgaccacgccgctgttggcgatagccgcagcgatcacgcaattctgcataacggtggtctgcgggccaggcgtgtggtccatgccgacgggctgtccggcgcctgcccaagcggtctcccattcggtcataagcgacgggtcggccatgatggaagccgcggtggtcagatcctggccgagcttttgaccgtagccaaaggcgttggcaaactggacgagcgagctggcgccgacctcgtttgccacctggccaaagacgacgttggacgacacggcgaaggcctgctgcaggctgatggtgccgtagctctcgttggcatcgttggtgaccggcgcgttgccaatatccatggagccgggcgcctggtacgtgctggtaaggctggcggtgccggtctcgagcgccgcggagagtgtgacgaccttaaaggtcgagcccggggtgtagagcgcgtccatggcgcggtcgtacatggagccgtcctcgccgccgcccgactggagcagcgcatcgatgttggtgttgtcgtaggtgggcgagctcgcgcacgcaaggaccgcaccggtgcgcggatccatgaccaccacagcgcccttaaagcccttgagcgcctgctcggcagccgtctggatgcgcgagtcgatggtgagcttggcggtattgcccggctgggtctgccccgcgagcgacgcgatggcgttgttccagctggagtaatccttggagccggtgagcgtatcgttcatgacgctctcgatgccggcggtgccgtattgctggctcacgtagcccaccacgtgcgcggccatgttgccgttggggtaggaacgggcgtaggtgccgtcctcctgctgcaacgactcggctagcgtcacgccgtcggacgtgatgatggagccacgctggatgtacttggagcgggcgatggtgtggttgttggtcggcatgtcctgatagtccttcgccttgatgacctggacataggtgaggttgccgataaggatggcgaacagcgccgtgaaagcaaacacggcacgagtcagacggttggcaagtgccacgcggccgagcacgccggactctggcgtgtcgagcaggcgacgacgcatgcgagagcccgcggagtggttgccgtggctgtaggaaggtgcgctggcaaaacgcgtaccggtcggggcgacggcggatgcgacctggtcatcggtgatggcggccatggtgccggtgccggtgagctcggcttcgcgtccggttgcctcgtcgccggcgcgcagcagtagcgcgacgatgataaagctcgccagcagcgaggagccgccctggctcataaagggcagggtgacgccagtcagcgggatcaggcgggttacgccgccaacgattaagaatgcctggaagctgatggccgccgtaaggccggtcgcgctaaaggcggcaaggtcggacttggcgcgggcggccgtggtgaggccacgcacggcaaaaagcataaacaggatgagcacggcgccgccgcccaaaaggcccatttcctcgccgatggccgagaagataaagtcggactcgacgacggggatgttgtttgccatgccgttgccgatgccgacgccaaccaggccaccgtcagccagcgagtaaagtgactgtacgatctggtagccctggccctgggcgtccttaaacggatcgacccagacctgaaagcgcacctgcacgtgcgacaggaacttgtaggcgcccacggctccaacggccagcagcgcaaggccgatgatgacgtacgaaaaacgtcccgtggcaacatagagcatcagcaaaaagatggtgtagaacaggacggccgagcccaggtcgcgttcgaagacgacgatgagcaggcacacgccccacacggcaaacagcggcagcagcaggcggaagcgcggaatcttgaggcccaggatcttgcggttggagatggagagcagctcgcggttctcggccagatagcctgccaggaacaagacgatgaagaccttggcgaactcgccaggctggatggtgaagcccgcgatgcgaatccacagcttggagcccgagatcgtggtgccgataaagatcggcagcatcagcaggatgatgccgataatgccaaaggtgtacttgtagcgcatgaccacgtcgaggttcttaaccagtgcgagcgttcccaccatgagcgccaccgagacaaacaagatgatgagctgcgagatggcgaggtcgggggccaggcgcgtcacgaatgtgatgccgatgcccgagagcacaaagacgatgggcaggatggcggggtcggcgccgggcgccaggatgcgcacggcgatatgcgccgcggcgaaggcggcgaacaggccgatcggcacggcgagcgtctcaaaggaaaccgtggcacccgcggtgagcacgtacatcgcatagagcaggatgacggggaacgccgaggcgatgagcaagagcagttcggtgttgcggcgactcataagcggcactccctttctaattcttatcggaggcttcggcctcggctgactgttcggcggttttctcggaatctgactcggatgtggattcctgatcggtgttgtcgcgaatcgtttgcgcgtcaatcacctgacgggtctgctcctcgtcaatctgatggcggtacttggaaatggtgtcctgcgcatcgtcgacgctcgtttgtggaatgcctgccttcaggcggttttgcgtgtcttcgggcaggtcggacagcttgatgctggtttcgctctcgagccagtggagctcgaccccgagcgtcttgccgggtaggccgcgccagacggcgacattgccgtggtaggttcccaagtaataggagccggtgacgcccgtgtatgcccagatgcctgctaccagcacaaagacaagggccaagatggaggcgatggtgacattgcggcgtcggacgcgttttgcctcgcgcatgacgccgtcgtcgaccagatcgacgaccaccacggtcacgttgtcgtggccgccggcggcgagcgccgcgtccaccaagttgtcgacacagatctgtgcgctcgaagactgcgtggcgatgttctcgatatcgctatcgggaatcatgctcgaaagaccgtcggagcacagaatcaggcggtcgccttcctcgatgtgcagggtaaagtggtcggcatacatggcgggatccgagcccagcgcgcgggtgatgaccgagcggttggggtggacgcgggcctcgtcggccgtaatctcgccggcatccacgagctcctccacgtaggagtggtcgcgggtcacgcggatgagcgtaccctcgtggagcaggtaggcgcgcgagtcgcccacgtgggcgatggcgagcgtgtcgttttcgatgtaggcacaggtggccgtgcaccccatgccgggtttgcccaggccgttgagggcggcctcgatcacggcggcgttggcggcctcaacggctgcggccaggcgcgcggcgtcggcggactgcggcgccgtcttggcgatggtctcgacggcgatggaggatgccacctcgccggcggcgtgtcctcccatgccgtcgcacacgcaaaagagcggcgactgcaccagataggagtcctcattgtgcgggcgtacgcatccgacgtcggagcgggcgccccacataagctgcgtggtggtgccggcgtcgtaggtcgagtcggtctcgatgcgctcgtcggtcagcggctcaaagctcatggtcgagccgggatctttgagctttgcctccacggccgcgacatcgatctcggcggtgtcgccgggggagacggtgtcagcatcgttgcccgactcgacgtcggagacgtccggaaggttgagatcttcggttacgcggtcggcgggattgccgtcctgctgcggctcgacagccgtcggctcgggcgtcgcaaagtgcgacggcgcgggcgtgctctggggttgagcggagggctcgggagctgtggcgggcgcggcaacgggctgctcgacttcggcaggcgttgcggatgcgggtgccgcctcgcttgccggggcgacggggaataccggcgcggcaggctcgggggctgcaaacacggcagcgctctcgttaatcgcctcggcgacgggctcggcaaagtgagccggtgcgggcgttgcctccggttccgcggactgctcggcagcgtgcgcgccgatgggggcatcgagctgctcggtgtcggcgtcctcgtcatcgacgagtgccggatattcttgagttacatgcgaaagaggcagggagaacacggtgtcctcgggctccacggtcgcagggcgcgccggagcggcatgagccggcgcagctgcgggggcagtcggcgtctcgggcatggttgcggacttgttctcctcgtcgatcatcgacggttcaccttcatgaccacgtcgccaatctggacctcatcaccctcgcgcagcgttgcgggctccaccagctgacgcccgttaacgagcgtgccgttcagcgagttgaggtcttcgatgatgagtgccgggccctgcagcgaaaagcgtgcgtgcgaggccgagacaaacggttcgttgatgcagatgtccgaggacggcgagcggcccacgatgacggggccgagcatgtctacatggatgccacggatgccgcgcggacccttgtccacatcgatcgtccagatagcggagtcgcggcgctggccgcgtacgagtcccacgccggttttcatgacggcgaacaggaagatgtagagcagggcgaccaggacgatgcggcctgcaaaaaggacgatatcgatgttcataagcgactatcccctaaattcaaaggtgctcaggccaaacgtcagcaggtcgccgttgcgcagcgggcagcgcgtgatgcggcggttgttgacgagcgtgccgttggtggaattgaggtcctcgatcgaccagtccgaaccggtaaaggtgagttgggcgtgacgacgcgacacgttggggtcgcgcagggcgatgtccgaaaccgaacgctcgcgaccgatggtcacctgcgcggaagtgatgctgtggctctcgccgctcacgacgtcgacgagctgggcgagcgggcgctgcggggcgcgggtgctcgccatgttggaggcaataccggccgcggcgccaaggcccacggcggcgccggtcgcggcggctccgcccatgccggcgagggcgtcacgagagacggtctgcggcacggggatgggcgcggcggcggggtcggggacgctgggcgcaaagggatcggccacggcgagcgggtcgggagcggcggcacggggcgacggctgctggggcatggcggcggggtgctgttgctgcggagcggcgaattgctgcttgccggcgcggggagcgctggcggcgcggcttgcggccgagttgttctggcccaggccattctggtaagcgcgttcttcctcgtacaaacgaccgagcgtgggggcgtcgacgttctcggcaaagaccgagaacttaccggcacgcagctgcgggtcgatcataaagcgaacgaggggttcgccgacaaacacatagcggcgcttttcggcctgtgccttcacaaactcgcggacttcgcgcgaaagctcggggtagaacggggcgagcatgggatcgtcgtcggcggcgatcaggatggtatagagtgccggcgcggtgttgacgccgttgatcaccagagtctgatcctccatgtcgcgagcggcctgcttggcaagcttcttaaaggagaacggggcacgggtggcaccgaagatgccggccacgtggtcctcgaagatgttcaggaagttcacgaaagatcactctccgtataggttctttggtatccgagcaaatataggcatatcccaacgattatagaggatagggttcccgcaaccgccgccttgacgacgaccgcgcccgcaaggctggcaatttccatatggtgtgcaagacagagcgacgtcgcggtgcctattccgcagccggcgatggcagcgattgcagccaggttcgagccctgctcggcacgcttggcatgggcgttgagcagcagagatgtcagtgcagctgtcgccgcgacaagcacaacggcagcccagaagagcatgtctcccagcgccgcggcaacattgccgagccccagcgcgcctccggcggaaagcgcaaccgtagccaggcggccaaaaagcgcgcccatccccgtggcggccgcggcgcttgccgggccgagccaaaaggccgcgatgccggcggcgaccccggcggcaaggaggacgtcgcccgttagacagccaagtgccaccgcgcaggtgagcgccgcgctcgcggccgcctcggtgcgtccccaggcgatccaccaaccggacatggtggcggcaaagagcaccgcgacgggtagcatcgacaggatgccctgcgtctgcatggtggcgttggccataagtaccaaaaagcccacggccgagatggccgagccaatctgcggggccaggccggcggccgccccaatcgcgatggccgcggcaataagtccgggaagcgccgcgacgccagccgtctgcatgatcaaaaagctaaaggcaccacacgttagcgccgagatggcgcgcatggtgtaatcgcgtgcgtggctccagcgcgtgccggcccagccgagtgcggggtcgacctcgatggtgtcgtcctcatagggtagcgattcgatatcgtctgccgcgcgctcgtcatccgacagctcgcccaccatctgctccaggctgcgacggccctcgcgcacgctgcccaagtcgtcgagcagctggtcgcaaaatgcctcaatgctgttggggcggtcttgcggcatgggggagagggcgctcatgagcgcagcctcggctcccgggggaaagtgcgggatgagctcgctgggataggtggcaccgccgatgatacggccgagcgagtcgccgggcgtggcggccataaagggagcgctgccgcacaggccctcgtagatcacacaggcgagggcaaagacatcggcgcgctcgtcaaccgtgccagtttcgatgtcgagctgctcgggtggcatgtagccgatggtgccgccgcgcgagccgccaaagccgccggcagacgacagccgcgccatgccaaagtcggtgagctttacattgcccgagtggtcgatgagcacgttggcgggcttaatgtccaggtggagcacgccgttgctatgggcgaaagtgagtgcctggcccagcgtgtcggcaattgccgcggcctcgtcaaaggtgagcgaatggccgtccacacgatgcaaaaactcggctagggacatgccgtcgacatactccatgaccaggtaggcataggcggtatcgtgcgtaaagtcgataacctgcacgatattgggatgttgaagcatggcggcggtgtgtgcctcgcgcaggacatccatgatgtcgctggcgggcatgccggcaccgcttgtgagggggatacgcttaatggcgacgcgacggcgcaggtgcgtgtcgcggcaaatctcgatggagccaaaaccgccggttgcaagcgtctcgagcggctggaaccgcttgagcagctcgcgagagctggtgccctccaagggaacgtccggcgagaaccgggcggtatgttgcgagaaaagcggcatggccaaccctcgtgcgtttaaagttcgtttgcgagcggcgggccagggtcaagccgttcgcggtggcatagatgctgctagtttagcacgctcgggcgcatggtgaaggtagcggggcgaggtggcctatctgacttggccttagcgcttcttcttgttcttcttctgcttgcgctgtttggcctttgcgttcttgggctcgctttcctgcttggccttggcagcggccttttcggccttcatcttcttgcgtttggtctcgatgcgcagctttttgttgatgcgcgccttgaggaaggagccaaactgctcggcatcaccacgtacaaaggtgtccttggggatcgtcacgccctgctcggcgaacatggccacaaagatgcgctcgccgtcgagcacgtggtcgagcttctcaaacgggaagaactgcgacttgccgctcttgccccagaccatcaggccgtcctcgttggcggcgacgcggcggtagcggccgcccatggactcgtcggcctcgacggcttcgataaagtcgcgcgcgagcgtatggtgcagatttttgctccaccaggccaaaaaggcgccgaacacgatcagcacgacgccgaacttgatccagctgccgccggccaccagcatgccgatgccgatgagcgcggcaatcgcggcggcgacgtacagggagccacggcgcctgggcgaggcaaccaagcgggcgaaatcggtgacgaggtcgttttcgtactgatactcgttgaggtacaggatgccgtcgtcggctgcggcctgcttctcgagcgcgacctcgacctggtcggctgcttcggagggaacgaggttgctctctgcgtctgccatgctctttggactcctatcgcggcgggctcgccgtacgggttattatggatgcagtatgccgtgcgaccgcatggccgccgcggcaacaagactcagtatacccgggggagcacccatggaatcgttgtaccgaaagtatcgcccgctcaccttcgactccgtggtgggccagcagcatatcgtctcgacgctcgagcacgccatcaccgaggggcgcctgtcccacgcgtacctgttttgcggtccgcgcggcacgggcaagaccaccatggcgcgtattcttgccaaggcgctgctctgccgcaatgccgaggcggcgcgcgccgagggtgcgagcggctgcatgcccgacggcacctgtgaggaatgcgagctcatcgccgagggcaaccacccagacgtctacgagctcgatgccgcaagccgcaccggcgtagacaacgtgcgcgaggagatcatcaactccgtcaactttgccccggtgcgtggcaagtacaagatctatatcatcgacgaggtccacatgctcacgacggcggcgtttaacgcgctgctcaagacgctcgaggagccgccggcgcacgtgatctttgtgctgtgcaccaccgacccgcaaaagattctggagaccatcctctcgcgctgccagcgcttcgatttccaccgcatcggtaacgaggatatcgagcatcgcctgtcctacgtgtgcgagcaggagggcttcgattacgacgacgaggcgctcgccatcgtggcgcgccatgccaagggcggcatgcgcgacgcgctttccacgctggagcagctgagcgtttttggcaacggagccgtgcatgcggacgatgcccgctcgcttttgggcgaggtttcggaccagatcctgggcgagtttgcgcgcgccattgccgatcgtgatgtcgccgagctctatgggctgattcgcgcgcaggtcgaggaaggtaacgatctgctggaactgacgcgcgacctggtggcgcacgtgcgcgacgtgtatgttgcctgcgttgcccgtgcccgtgccgagttgtttgagggcggctccgagcaggccgaggcgcttgctgccgaggccgctgcctttggcgagcatcctgccgaccgcctggctcgtgtgctgacagtgctcgacgatgccgcactggagatgaggggcgcgagcgacgtgcgcctggtgctcgagattgcctgcacgcgtctggcgcgtcccgaggctgatttaacgattgaggcattggccgagcgcgtggcacgcctggaggccatggttgccaacgccgccgtgccggcgagcgtggctgctgctcaggccgccgcgcctgcagcatccgtacccgctgctgcccaacagccgacgctcatttcgggcgcccgcgctgccgccccggcggcatccgctgcccccgctgctacgtccgcgcgccagggcggtatgccttgggaccgtggtgctgccgctccgacggctcagcctgcgccccgttctgcgtccgtgtcagcttccaagcctgcagcgcctgcacctcagcctgcgccggctccgacgcctcagcccgttgcggcccccgcgcctgccaccgctccggcacctaagccccagtccaacaacgccgcccaggttgccgccgccggtgccgccgagacgcccgcggtcgaggatgccggagagctgcagcgcaaatgggccgaggttgtcgagcgtgtcaaggcgcgtcaggcttcctacgcagggcttttgctcaacgcccgcgccacggccgacgacggctccaagctcacggtctcgttccccgcgggttcgacttttgccatcaagatgctcggtcgcgccgatacgcagtcggtggtcctgccgacggtctgcgcggtcttcggtcgtcgtaccgtcgactatgtcctggatgggggtggcacgccggctcctcaacatgaggagcattctccatctgcacgggctgcggtatctgcggacccgcaacccgtgtcctcggtgccccctgcatcctcgagcgccagcgcgacgcagccaaaagcggcgccggtagcggcaccgaccccgtcggcgcctgaacccgctgcgcccaaaccggctgctccgatccccgcgcccaagtccgctgccgcgcctgcgcccaagtcatccgacctggccaaggccccttggctgcgctccgacaaccctgccggtgctcctgccacgggcaagctcccgaccgagcccgcgccccgagcgcccgagcgcgcgtccgtccccatggctcagccgcctgcgcaggctgcgccatgggaatccgagcaggtgccctacgacgatgctatggtcggtggttttgctgccgatgccggcggggacgatctgcccccgttcgacgtgccgggtgcggcgtccgcgaccaaggccgctgctgtggcacccgcagcctctgcaaacgacgacgtccccgccgctccctgggaatccaatcccggtgctggcagccccttcggccatcagggcgcagccccgagcatcccgcagaccgaggacgaggccaaggccctcatccgcagcgtctttggccaggccaccatcttcaagccggtggagtagctgcgtaggcgggtatactgctcaagaagaggaccccttgtccgggcgcatctgtatttcggacatgtgtagtgtggtgccgcgtatgtcgcatttgagcagacaggtgcgtgacggtcggcctaggatgctgaggtcgatacgatacgtcgcatggctgtccgtgtactcgacttgctcggcgttaatggttgctccgattgccaaataaacgcctagctcggcatcgacaatcttgaagtcctttatcttgaccttgaactcttgatagagggacgggctgttgtagtagacggttcgggttccgtcggtgcactcatcggtcgtctcccatttgacgacgggctggtccgagctggctatcagcagttctgctccaaaagctatggcatgggtgatgacaaccagcaatgcccagccgacaaagagatagagaaccacatatgcaacggggtgttttgagcggatgttttggagcgcgttgggggcattcatggggcacctccaaattactatctatggcaatcaaattataccctgccgccatgtgcgccgcctcgagcagcggttcggcatttagctatttagtggcgcacatgaaatgccggattcggctctactagattgagtgtgcgatattatgcaaccttgcataattcgaccttgcataatctttgagtgcggtttgtattggaggacatgtatatcgactgaggtaacacgtccgccccgctctctcgccgcgcgccgtggtacgatttttgagtttgaaagtcccgccgtgctccggctgcccttgcagctcggcgtgcggccgcacgtaaaggagccatcatggccggtatgaacatgcagcagatgatgaagcaggctcgcaagatgcaggagcagcttgccgccgcgcaggagaacctcaagtcccagaccgtcgacgcctctgccggcggcggcatggtcaaggtgaccgttaacggcgagatggagctcgtcaacctcaccatcgatcccgatgcgctcgatcccgaggacgtcgatatgctgcaggatatgatcatggctgccgtcaacgaggccgttcgcggcgtcaacgagctcgccaacaagcagatgggcgccatcaccggcggcctcaacatcccgggcatgccgttctaagacacgcatatatatgagtgccaaccacagtctgcaaaaactgctcgatgagctgggccgtctgccgggcattggtcccaagtcggcccagcgcatcgcctattacctgttggaggccgacgccgaggaggcgcgccgcctggccgaggccatcctggaggtcaagcaggaggtccacttttgcagccgctgctttaactacgccacggccgacgagtgctccatctgccaggacccgatgcgcgataccactcgcatttgcgtggtgggcgagccgcgcgatgtccaggcgatcgagcgcacgggcagctaccacggcctctaccacgtattgggcggcgtgatcagtcccatggacaagattggccccgagcagctgcacattcgagagctgctggcacgcttgggccacgaggacatccacgaggtcatcatcgccaccaaccccaatattgagggcgagaccacggcgagctatctggcccgtaccatcaagccgttgggcgtcgaggtgtcgcgtctggcaagcggccttcccgtgggcggcgacttggagtatgccgacgagcttacgcttggccgcgccatcgaggcccgccgcgcgatttaggtggcgagcctgctcctgccgtatgttttcctcgcgacgcacggggtagtcataatttccccgtgcgactgtgagtttgttgtgcaacaaagatgcttcgtatccgcttatcgcatggatgcttccgctcgcatccttaatttgtccattcgttgcgcaacctttttggttcgctgatacactcaaatatggattcgaatgaatgcgccgctcccgagcggcgtgtttttgttggaggagaacgcatgcggcccggtggcactcagacaaagcgcggcgccgcggtgcgcatacgacgccgactgggcttggcgccgcgggcgtacgcactgctatcgtgctcgctggtgctggtcatggctggcgtttctgcctatggcatgaccgtgccgtccatgatgcaggcgcatgccgcacgcgaaccgcgcgtggggcatgaggtcaaaagtgatctgggtaccacgactggatatgcttgggcaagtgtggtcgcgcatattgtgtttggcaccgacgatgcggacggcgccgaggccccggacaacgaagtcacgcttgccaatggcaaaaccatcgtgctcaccaacaccaagatcatcgatcgattgtccaacaatagcgtggcggcaacggtgaataaggtcgagcagcaaaaggagcaggacgcccagcagtccggaaagcccggtagctcggatacttctggctccggctcggattcatcgagttcgggcggcggctctgggtcgggttcctctaccggagggcctggaaacggcggctcgacgggcggcaacactgacaacgatgcaaactccggcggcctttccgctgctgaggaagagggcattcacagttggcttgtgaccaagtacaacatgctcgacagttacgtttctcgtgccaatgacgtggtctcgacctataactctacgggagatcccaggccgtgcgacagcctggtcggggagatgtttgtcattcgagccgagttcggtcgtcagacattctcgccccggtcaaagtggtatcagcagtatgccaatctgtggggctgttacaccaacctatgtcaatgggttggccattacggcgatgatgacgtcgcgctcggtaacttcaacaataacgtggcggcgcttgccctatgatgaccgatcttgcatccaccacaccacaatcactcggtcgcgatcccatggtcggcctgcgcctggcgcgtgtcgacgggtttgagccggccattgcgctcggtcaggacgaactgcctgcctatctgcgtcgttttacgatgctgtttgccgacgatgccaccatgcgccgtggcggtatcggccgcgtgacgcgtgccgtcaacgcccaaggcgaggccgtggcactcaagcagctcatcttgccgacgcgcgatgagtttgacgacgatgccgctcacgaggcgctggtcgccaagttcaaggcggcgtttcgcgaggaatacgaatgccatcgcgccctttcgggccttaagggctttccccgcctctatggctggggcgaggtcgacggtgtgcctgcaattgtcatggaatgggtcgagggcgagacgcttgcccgcttgcgttcgcgactcgccgtggacgatgccggacgcctgtcgccgcttgtggcggcgcgtctgggtcgcgacctgttcgatctgctctgccgtatgagcctggtgggcgagggctttgtccatcgcgatatctcgcccgctaatattatggtgcgcacggcgcgtctaccgcttgaccggcagcttgccgagggcacctttgacctgtgcctgatcgactttggctcgtcgctggcgcttgagcctgcgtcggccgtggccggtaccggcggcaaggcgtcgtttacggagcgttatgcgacgctgcgtcgcgcgacggtggcctacgctccgcccgagatgctcaccgacgatattcccgacctgcgcgctttgcgtatgtcgccggcgatcgacgtctatgccgcggcaagcacggtttacgagctcattgccggcgtcgcgccatacgaagccgcgccgagcacttcgggcgcctcgggttcgcgcaaaaggacgcgcgacatcgcgagcccctaccgtctcaaaatggacacgcggcccgactatcccattggtgcccatgcgcccggttgtgatttgactcagctgcttcgtcgtgagcccgatgtggcgctcgccgcggccgagcaggcccagcagctagggcttgagccggattccgaagagctacgcgatgcgctggcgtttgtcgatgcccagctgttcgacgtggtgatggcctgtctgtccagccatcaaaaagatcgtcccgagccggcggcggtcgaggcggcgctctcggcgttttgtgaccactatgcgcaaaatgtcggtcgttcgctccgcggcgagccgctcacgccgtgccccatggatgcgtctggccgcgcggtgcgtcgcgcgctgatggtcggcgcgacggtcgtctgtggcgtggtttgggctgtggtcgtggtttcggccgcgctgctggcgtcgggcgctcgcgtgacggcgactttgggatcgctcgtgtggtctgggtcgctaccgggtattattgccgcactggcgttggcgctgccaggcatagccggcgttgccgcgggggcacttgcgcgcgatcggcgctcgggcttcctgcagggtgtgcttgcgctttctgcctgcgaggttccggtgctggttgtggctgcatgtagcgtattttcccaacgcgccgtgatgggcggccttgttgccgctctggttgcaacctatacgcttacgtggtttttgcttgcgatgggctttgcctttgaacttcccgtttcggcaccgcgacgcacaaaagcccagatggcgactccgcttgccggtggagccgcagctgcccgtacttttggcggacctgtcgaagtatcgtccgattctatttctacgaccaaggaggcctaggtcatggcatctcaagttgagctcaccccatgcggggccatgtttgacatctttaagcgcgcggcgcatctgagccatatcgagctgtgcggcctggtgctttcgtcccgtccgctcgccgacggccgcagcccgcagagccgagccgccgatcgctcttgggtttcccgctttatcgttcgcgcgccggtcggcacgcttcagcagcgctactttgccgaatacggtacctcggctgcgcgtattatgtcgcaactggccctgcgccagcgaaatcccatggactccacggctgtgatcaatatggcgtgcggtcctgcaggtgaaccgatggtacgcgcgctcgaagagtgccaccaggacacgaatctctatcgcaacgcgctcgatcgcctgtcccaggcggcggaactcatgcccgccgagcgcgccgaggccgtgctggtgctgtttgtcgctgtcggttgttcggcggatgtgcggtcctcggtgaactatgccatcgactacgcgcacgcgacctgtggcggaggaacatccacgccgcgttcgcttggcatgtcgatgaccgcgggcgaacgcgaacccgccccggcgcaccccttgggcttgctgcgcgtgcaaaacagttttgtcgtgagcgccccgcgctggattcagccgagcgagcagggtgttgagattggcgcgctggccactggtgagggcgatattaccgacgtcggcgacgatgtctcggcccgccatgcccatatctggtgcgatgctcaaaatatctggcacgtcgaggacttgtcgtccaccaacggaaccgtggtggtaaacggggccacgcgcgtctgcattcaggtcgagcccggccgttccgcccaactcaatcccggcgacgagctcaagctcggcgaatccactacctacgccattctcttcggtgccctctagccagtcctgccaaatggtccctccgtccccaagggatcattttgctcccggcagtcacctgaggtaaacctttaccgcccgcctatatttgccgaaattacacttgacggcggggtacaataaacccgcatgcggatttccgttgcgggcgcttcccatcgccggggcgtgcccgggagcatccggcatgcggcctttgcggcgctcggtcatgtgcaagacgggcggtcgggtctgtggggcgcatcagctggccctcgcctcggcatgtcttctctccacgccacgtacctgctgctgagcctgcctgccagatgattggaagcaacagcgtaaatcccatcacgccaacatcccggcgatcgccggggcctgtatacctatatgagaggagaggggtatatggcgcgtaagtttaagtctatggacggcaacgaggcggccgcatatgtttcgtatgcgtacaccgaggtagcgggaatctatcccattacgccgtccagcccgatggccgaccatgtcgaccagtgggcggcccagggtcgcaagaatatcttcggcaccccggtcaaggtcgtcgagatggagtccgaggcaggtgcagccggtaccgttcacggttcgctgggcgccggtgctctgaccaccacctacacggcttctcagggtctgctcctgatgatcccgaacatgtacaagatcgcgggcgagcagctcccgggcgtcttccacgtctccgcgcgttgcgtcgcttcccacgccctgaacatttttggcgatcactccgacgtcatggcctgccgtcagaccggcttcgccatgctcgccgagggcaacgtccaggaggtcatggacctctcgccggtggcccaccttgccgccatcgagggcaagactccgttccttaacttcttcgacggcttccgcaccagccacgagatccagaaggtcgccatgtgggactacaaggatctggccgagatgtgcgacatggacgctgtccaggctttccgcgaccacgcgctcaaccctgagcacccgcacacccgcggtagccacgagaacggcgacatcttcttccagaaccgcgaggcctgcaacaaggtctacgacgagcttcccgccgtcgtcgagggctacatgaagaagatcaacgagaagctcggcaccgattacggcctgttcaactactacggcgctcccgatgccgatcgcgtcgtcgtgtgcatgggctccttctgcgacgtgctcgaggaagtcatcgactaccttaacgctcacggcgagaaggtcggcctggtcaaggttcgcctgttccgtccgttctccatcaagcactttgtcgacgttctccccgagaccgtcaagaagattgccgtcatggaccgcaccaaggagccgggttccatcggcgagccgctctaccaggacgtcgtctccgctctctacgaggccggcaagacgggcatcaaggtcgtcggcggccgttatggcctgggcagcaaggatacgcctcccgcgtccgcgttcgctgtcttcgaggagctcaagaaggacgagcccaagcgcgagttcaccatcggcattgtcgatgacgtgaccaacctgagcctgcccgaggccgaggatgcgcccaacaccgcagcccccggcaccatcgagtgcaagttctggggtctgggtggcgacggtaccgtcggcgccaacaagaactcgattaagatcatcggcgaccacaccgacaagtacgtccaggcctacttccagtacgactccaagaagaccggcggcgtcaccgtctcgcacctgcgctttggtgattccccgattcgctcgccgtactacgtgaccaaggccgactttgtcgcctgccataaccccagctacatcgttaagggcttcaagatggtccgcgacgtcaagccgggcggcaccttcctggtcaactgccagtggagcgacgaggagttcgccgagcacatgcccgccgtggccaagcgctacatcgcgaacaacaacgtcaacgtctacctgatcgacgctatcgacctggccgccaaggtcggcatgggcaagcgcaccaacacggtgctccagtccgccttcttcgcgctggccaaggtcctgcccgccgaggacgccctgcagtacatgaaggacgcggctaccaagtcctacatgaagaagggccaggccatcgtcgacgccaaccataaggccatcgatgccggcgctaccgccttccgtaagttcgaggttccggccgactgggctaccgccgaggatgccgctcccgtcgagctctccgaggagaccaagtccgccatcgcccagcaggtcaagaacctgctcgagcccatcgatcgcatggatggcgacagcctgcctgtttccgccttcgtcgattgcgctgacggccagtttgagctgggcgcctccgcatacgagaagcgcggcgtcgccgtggtcgttccccactgggacgagaccaagtgcatccagtgcaaccagtgcgcctatgtgtgcccgcatgccaccatccgtccgttcgcgatgaccgaggacgaggccgccgccgcgcccgaggctacccgcacgctcgacgccatgggccccaaggccaagggcatgaagttcaccatggccgtgtccccgctcgactgcatgggttgcaccaactgcgtcaaggtctgccccaagggcgccctcgagatggttcccaccgagcaggagatggaccagcagcccgtttgggactacatggtcgagaacgtctccgagaagaaggagctcatcgcggccaacgtcaagggcagccagtttaagcagccctacctggagttctccggctcctgcgccggctgcgccgagaccgcctatgcacgtctggtgacccaggttgccggcgaccgcatgttcatctccaacgccaccggctgctcctccatttggggcaaccccgctgccaccgctccttactgcaaggacaaggacggtcacggcccggcgtggaacaactccctgttcgaggacaatgccgagcacggtctgggcatggccgtcggttacgaggccgtccagaagaagctgatcgccgctacccaggacatcatcgctgccgatggtccgtccgatgagctcaaggccgccggccaggcttggatcgactccgtcaacgacgccgaggcctccaagaccgctgctgctgcctacgttgccgagctcgagaagtgcggctgcgacgcttccaaggcgatcctcgctgacaaggcttacctcaccaagaagtccttctggatcttcggcggcgacggctgggcctacgacatcggcttcggtggcctggaccacgtcttggcttccggccacaacgtcaacgtcttcgtcttcgacaccgaggtctactccaacaccggcggtcaggcctccaaggcctcgaacctgggccaggtcgctcagttcgccgctgccggtaaggtgaccaagaagaagtccctggccgagatcgccatgagctacggctacgtctacgtggcgcaggtcgccatgggcgccaacccggctcagaccctcaaggccattcacgaggccgaggcctacgacggcccgtccctcatcatcggctacagcccctgcgagatgcactccatcaagaagggtggcatgcagaactgccaggccgagatgaagaaggctgtcgagtgcggttactggaacctcttccgcttcaaccccgaggctgctgccggcaagaagttctcgctcgattccaaggagcccgcgggcggttatcaggagttcctgatgaacgaggcccgttacgcttcgctgacgcgttccttccccgagcgcgccgaggagctcttcaaggagaatgagcaggctgctatggaccgctatcagcacctgctgaagctcaaaacggtgtataacgaggcctaggtctcccaccgcaggatctgagggctgaccttcgcggacgtcctcggacatgaaagaacccccgctgcgcattatgtgcggcgggggttctttcgtcctgcggagtgtccgcgaaggtcagccctcagatcctgctacgactacgtcctcagattgtgtgggcggatgaaggacgtagttggccgggtattccgtccctttcgctgtttcgcggctttgccgcgaaacctcgcgccactttggggatggatgggggacttggctgttgccgccttttcggagcgcttctttattccttttgctggatgaaaagccccttgtttttgcaggggtgcatactcgacttataagtgcatagaatctcgtatagcgcgagtaagatattgcgctgtccgttttgtgtttagcagagatgtagtttgcataatccgacataatcctcgcttcatttaaataaagtcgcacgtaaattacgtagatatgtctgagctggagttctgtacgctgagcggacaaaaacgaccgttcaccgttccgctattttcaaaatgaataaaatgagcgataaagagaatataaaccttaataaactcgcgtatcgcacggacgcgggttattaatgggttgtaggccttttacagaaaggattccagcaatgtctaagcctcttggcaagcccgatcgtattgtcgtcgcccttggcggcaacgccctcggcaacaaccccgtcgagcagatcgaggccgtgagcaacaccgcccacgctctcctcggtctcatcgagcaaggcaatgagatcatcatcacccacggcaacggcccgcaggtcggcatgatccagaacgccttcgccgctgcccacgatgccatcggtacccccgagatgccgctgcccgagtgcggcgctatgtcccagggctacattggttatcacctgcagcagggcatcggccgcgagatgcacaagcgctataagcgttggcacgccgcaaccgtcgtcacccagatcgagtgcgacccggacgatcccgcgttcaagaacccgaccaagccgatcggtcccttctacaccgaggagcaggccaaggagttcatggccgaggacccctccaaggtcttcgtcgaggattccggccgcggctggcgtcgcgtcgtcgcttcccccgatcccaagaagatcgtcgaggccgactccatcctcaacctgctcgacaacgagttcatcgtcatcgcctgcggtggcggcggcatccccgtcgtccgcgactacgagaacaagggctgctacaagggcgttcccgccgtcatcgacaaggacctgggcggcgagctgctggccgaggactgcgacgccgacgttctgttcctgctgaccgccgttgagcatgtcgccatcaactttggcaagcccaaccaggaggagctcgaggacattaccgccgacgaggccgagcgcctggccgacgagggccagttcggcaagggttccatggagcccaaggtccgcgctgccatcaagttcgcccgttcccgcaagggccgcacctgcatcatcggcgctctggacaaggccgccgagaccatggctggcctctccggtacccgcatccacgagtagtctctactctgttgcctctctcgtgggcgccaggcaaagcgcccgcaaactagcctctcttcatgagccccgcagtccgctccgactgcggggcttttgctattcacctagtcattggggacgttcttaaatgactagtcaaacaagagcgtccccaatgaccactcatttaagtctgtccccaatgactagtagtaggcccacatggcttcgacttcgttgaggacctctacgacgccccagcgacgggcgctgcggctggccgagttggggtcgtagacgccaatctggtcggcatcgtcgatgccgtagagcacgatgtagtggcctacgttggtaaacgtaccggggcgcactgcggcgatgacgggcgcacccgagcgaagtgcttgagtaatcgattcgcgatcgttatagagctgtgttccgttgagccccagctgccacgcaccgcctgtcataaacgaccactcggtggcaccagtgggggcgtagttgccggcttcggccagcgcgcatatatcgaccggcgtcttatcggtatggccggtcttaaagatatagaccatggtgaggcaggtaggaccgcaagcgttttcgcgaatagtgccaccggcatagggcagctccgaccatgcggggtcaatttggtagatgtggggcatggtgccggcctcccattgcgagcgtggggtcgagaacgcaaaggagtaaccgggcgcgacgggagctttaagcagcttgtcctcggcagtgggctcaagaccggctgatccgtgggagatacaggatcccaaaaacacaaagacgaggcaggcggcgatggagcaaagcgcaaggcgtaggcggcgggccggaagcgcgtggcttgtggtgtgcgacgcggggtgaggggaggaattgccgcgatcgcgttgaggtcgcgaaaaggaacgcttgacgtagtagtcggtcttacggcgatcgtagcggcgtggctgcgatgtgtcggtctgacgttggcgtgtgctcgtactcacgcggtctgactgctgcacggtacggctttgctgccgcgaagaagccccgggctgctcttgggggcgctgcgggttgtcgttgtcggaggtgcttctgggcgttggcgtggtgcggccggcaaggcgcacgctttgtggccgttggtcgccgtcattgtatccgtatgccattcgaatcaccttgcctcatgtgtaacttgtctatcctacataaaaagatgcacgacacatgggtatgtgcgccaaaagcctgacaaatggtatgaacgttgccgcgccgcgcgccaagcgtcacggcaacaggtcttcaaaagcagacaagatgaaagcgtccaagacgaatgacgtctcccgccgttcgtcccaaaaacggtgccgctcgttttgcagttctgccttcggtcgagctgcgagcggagctgctgcgccaaggccgtatcttaaagccatggaataaaagcgcgcggcaaaacagaccgcgcaaggggtgacgtcaaggggcgtcaaaaaggaaaggaggggaacaatggcggacaagaatgcagaagttgcagtcgaggataacggcgatatgaagaaaacgctttcgctctggaacttcttcaccatcggtttcggtgccattatcggtaccggttgggttctgcaggtcggcgactggatggtcgtgggcggcggtcccgttcccgctatgatcgcattcctcttgggtgcaatcttcctcgtgcccgtcggagctgttttcggtgagctcacggctgctatccccatctcgggcggcatcgtcgagtatgtcgatcgtagctttggccgtacgctgagctacatcaccggatggcttttggctctgggcaacggtatcctgtgcccgtgggaggccatcgccatttcgaccctcgtgtccgagatgttcggcagcctgcctggtcttgagtggctgcgcgccgtcaagctctacaccatcctgggcgccgacgtttacctgttcccgacgctgatcgcgctcggctttgcagcctacgtcatcttcctcaacttccgcggtgccagctcggccgccaagctccaggccttcctgaccaaggccctgctctgcggcatgctgctcgccatgggcgtctcgctgttcaccggctcgccggacaacgccatgcccgtgttctcccgggtcaccggcgctggcggcggcaaggccgctaccgagggcgccagcctgttcgccggcatcgtgtcggtcctggttctgactccgttcttctatgccggtttcgacaccattcctcagcaggctgaggaagcagccgagggcctcaactggaacaagttcggcaagatcatctccctggccctgctggccgccggcggcttctacatggtctgcatctactcgttcggcaccatcctcgactggcatgagtttgttaagagcccggttcccgcgcttgcctgcctcaagggcatcaacatgcttctgtacctggccatgctcgtcatcgccacgcttggacccatgggcccgatgaactccttctacggcgccacgagccgcatcatgctcgccatgggccgcaagggccaactgcccgagaagttcgccgaggtcgaccccaagtccggcgctcccaagctcgcctgcgtcgttctgggcgttatcaccgtcatcggtccgttcctgggcaagaacatgctcatccctctgaccaacgtgtcggctctcgccttcattttctcctgcggtatggtcgccctcgcctgcctgcgcatgcgcttcaccgagcccgacctgcctcgtccctacgaggtgcccggcggcaagtttggcatcggcctcgctatcgctgcctgcgccatcatcatcggcctgctcgtgattccgttctctcccgcctccctcaacatggtggagtggagcatcgtgatcggctggttggctattggcctggccctcatggctttcaccaattcccgcaaaaagtaacgcctagccggggcggatcgggtgcgtggggccctctctcccgcgcaccgaacccggcaccacttgggtagctttgtgaggccttaacccaacacggcctcgcccactatatggatccataaggaggaaccatgtccactaagtatgcaatcgttggcggcaagctcatcgacggtaccggtgccgagccggtcgagaactccctcgttctcgtcgacgacaacggcaagatcgagtacgccggcactatgcaggaccttcccgagggcgttgaggtcatcgacgccgccggcaagaccgtccttcccggcctgatcgacacccatctgcacttctcgggcaacctgaccgacgatgataccgattgggtcatgcagccgctcctcgagaagcaggccgtcgccgtcaagcaggcctacgactgcctcactcacggcctcaccactgtctgcgagatcggccgctttggtatccagatccgtgactgcatcgacaagggcgtctttaagggcccgcgcgttctggccaccggcctcggcttctgccgcgttgccggccacggtgactcccaccactgcacccaggagctcaacaaggaatcccatccctggggcgaccaggtcgacggtccttgggatctgcgcaaggccgtccgtcgtcgcctgcgcgagaaccccgatgccatcaagatctgggctaccggtggcggcatctggcgctgggactccggtcgcgaccagcactattgctccgaggagatccaggccgtagtcgaagaggcaaagatggtcggcatccccgtgtggagccactgctacaacaaccacgccgctgcctacgattccgttcgctttggctgcgagcagctgattcacggcttcgatatcgatgagcgcaccatggacctcatggccgagcagggcaccttcttcaccccgacgatcgccttcctgcccacctggtacgccacctatccgcccgtctacgtccccgagctgcacgacaagtacgagggcaccctggtcgagaaggagctgcagcgcaactacgactgcctgcgcgaggccaagaagcgcggcgtcgtcatgacgatcggctccgactccttctccttcgtcaccccgtacggcacctgctccatcgaggagatgtacgagttcgtcgacaagatcggcttcaccccggtcgagaccatcacctgcgccaccctcaacggtgccaagatgtgccacatcgaggacgagaccggttccatcgaggccggcaagtgcgccgacctgctggtcgtcaacggtgacgtcgccgccgacatccacgtgctcaacaccgacaacatggacgtcatcatgaaggacggctggatcgtcgaggcgggcacctttggcgaggccaacaaatacagcgcctaaactaccgttcatcgacgactggatgtaaaacacagtatttgattgcataatgcaatggagagggtcgcttgcggccctctttattgctatgggtgcgatagataaaaggggatgacggtggatttaaacaggctgattctgggcaagagctacaactctaccaaggtctttcgtacggcccagcatgtggtccaggccatcctgctcggtgttgtcgttccggcgcttatcctgctgcttatctgggatttaaccgataaccccaatcccgttccgggcgttgtcgttattgccggcatggtcatgctgtgcttctttttctcgtatgtctttgtggtccccgacgacctcacatcgagtgcaaccgaccgtacgctcgccatcgcatcaaaaatattcgcctacacgtcgcgcggccttacgcccgaagcggccttgggcgcctctaaaatcatcctgtccgagaccatcgcctctgccatctgctttaccgatggcaaacaggtgttggcaagctggggcgaggactcggcaaagtgccctgccggcaccccggtcgtgctcaagaccacgctcagtgtgattgagacgggcgagcagagtgtgttttcgcgtgacacctccaatgagacgggcggttattttccccgtctgcgcgccggcattgtcgcgccgcttaccgtgcgcgggcattgcgtgggcacactcgagctgtactatccccgcctgagcagcatcgatatgcgccagacggcgttggcctcgggctttgccgatctcatttccacgcagctcgccagctttgagctcgagcgccaggacgagcttacggcccgcgtggagctgcgtgccttgcaatcacaggtcgatcctcattttctattcaataccattagcacgatcgtgtcgctcgttcgaaccgagcccgacaaggcgcgatcgctgttgatcgacttttccaactactatcgtcagacgctttctgattccgatacgctcaccacgctcgagcacgaggtggaacagggcactcgttatatcaatcttatgcaggcccggtatggcgacggccgtctgcgcgtttcggtcgacatcgactttgaggtgcgcgacagcctggtaccgccgtttatcttgcagccgctgctcgaaaactgcatcaagcatgcgcagcgcgagaccgagccgctttctattcgtgttagggcttttgagaccgatgacggcttggagatcatcgtcgaagatgacggcatcggtatgagcgaagaagtctgcgcgcatctgtttgagcagcatcgccgagaggagcccgagagcattaccgccgacggctccatcaagcgaggttgcggcctggcgctcttcaacgtgcttcagcgcatccatttcttttacggagaagattctggcatgcgcgtgaagtcccaggagggcgtgggaacgcaggtcatcgtcgagctgaacggcgagccgcatgagccagcgccgctaacggtgtagcacgcggttggattgagagaaaaagaggggaagcgcatatgtccgaaggctggaacatcctggtggttgatgacgagcctcccattagggctgagctacgctatctgttggaaaaggatacgcgtgtaggtcagattgccgaggcgggcaatgtcaccgaagccgtggagtcgattctgtcgaacaagcccgacgtgctgtttttagacattaccatgcccggtcgctcgggaattgagcttgccgagacgctgcagaacctaaagacgccgccggtcgtggtgtttgtgacggcatttgccgagtatgcggccgatgcctataacctcgatgcggtcgattacatcgtcaaaccggtcgaggatgcccgcctgtcaaaggcgctcgacaagatcgagactgccctgggcgctcgccgtgtcgtccatgctccgcgccagcctttgcgcctgacggtggatcgcgggggcaaaaaggtgttcattcccgtggcggatgtctgctactttgaggcgcgcgccgatttttgcaacgccgtctgcgccgaggggacgtatctgatcaatgagtcgatttcctcgctcgagcgtcgcctggcctccgagggctttatccgcgtccatcgcagctatctggttaatttggaagacgtacataatgtcgagatcggctccacgggcctgatggagctcaggctcgatcgcgtaacctcgacggtgcccgtgtcccgccgtcgcgctgccgaggtcaaatcgcacttggggcttgcgtaagggtcggtgtgccatcgtttgccgttacaggtttggcatgactgtgcggtgggcataatggattgcatcgaatgaaatcgaaaggattattatgcccgcgctcattacgcatcatctgtttggcgaggaaagcatcgaccgtcttccgcgaggcgttatcacgtccgacgaggagcgcatcgcctttatcctgggaaaccaaggtcccgacccgttcttctttcacatgctcacgccgcgcatttccgactgcatgtcgcttgctcaggtcatgcaccgctcgcgcatgtcgcgccagttctcgtgcctgcgcgacggcgtgtcacacctgcagccgcgcgatgccaatctgggtcgcgcctttgcgctgggcctgctgtcgcactatgtgctcgatcgcaatgcccatccctttgtctacgagcagcagtttggcattgtcgagtccgatcccgagctcgaggcttcgggcagtcaagttcatgccgtgctcgaaagcgacctggacgtgctgatgctgcagctcaagcgcgatggggcaacggtcgaggattatccgccggcgggcgagatcgtcactaccgaccgcatcaatcgcgttgccggcgtgctgatgagctatgttgccggacgcgtgtacggcatcgatatcccggtgggggagtacggcggcgccgtagacgacatgcagctgctctaccgcactatcgagccggccggttcggccaagacgcgcgcgattgccctgctcgagggcttggtgcacgattattcgctgctcgacggccttgcgcaccgcgtgacgaccgagctgcccgagcgtaccggcaacctgggccacttggcatggaaaagcccctttaccgatgaaatctcgaccgagagcttccccgaggtctttgaccgcgcactgctcgattacgagctcaccgtcgcccgctttatcgagaccggcgatatggaagccgtgaccaaccacgtcaattacagcggtcgcgtgctcggcgccgacgaagagttcgaccgcgaggagtagggctcgtgcgtgcccctttgccgaatccttaccggcgcctctgggcaattggggtacgatgaactaactgcatatcgggcgaatacgaaggggccctgtccatgaaatacaccaagctcgagcgtaactgggttatgtacgatgtgggcaactcggccctcgtgctgctcaatacctcggtggtgcccatctactttaacgccatcaataccggtgcttcctcggcagacctggtggtcgcttggggcaacgcgcagacgattgcctcgctggtcattgccatgctcatgcccattctgggcgcgcttgccgattacgccggcaacaagatcaagttcttcttgggcttcttcctcacgggcctggttctttgcctggcgcaggctatccccatgtccgccatggcatttttgaccgtgtacgtgctgtgcaccatcggccttaactcttctatgacgttctacgacgctatgctgcccgacattaccaccgacgagcgcatggatgccgtgtccagctcgggctatgcctggggctacatcggttccaccgtgccgttcatcatctgcctggcgcttatcatgggtggccccgctcttggcgtccccaccatgctggcaacgcgtctgtcgtttgtcatcaccggtgcctggtggctcatctttaccctgccgctcattcgcacctataagcaaaagtacggtcgcgagcgcggtcccgaggacaccatcggccacatcgtgggcggcgtgttctccgaggtcggacacaccatgcgcgagatcgcccacaacaagaccgtgctggtctacatgatcgcgttcttcttctacatcgatggtgtccatacggtcatctccatggcaaccagctacggctcggctttgggcatcgattcgacccagctggtgctggcgctgctcgttacgcagttcgtcgctttcccgtccgccatcatctacggcaagctcgccggtcgcgtgggcacgctcaacatgatcatggtggccgtcgccgcctacatgggcatcgtgctctttgccgcgtttttcctcaagaccgcctttgagttttgggtgctcgctattttggttggcctgttccaaggcggcgtgcaggcgctgagccgcagctattttggccgcatcatccccaaggaaaagtccaacgagtactacggcttctttgatatctttggccgctacgcaagcgtgatgggcaccttcctggtgtcggttgtcacctcgctgaccggcaacccgtcgttgggcgtcctttctattggtgttctgctggttgttggctttgtgctgctggtccgtctgtcccgcatggctcaggcggcggcgtaaggcaaccgggctcagtactgcaattgtgcctatctgcagtactcttttggaagtagccgcataaatcattctgacttccgaacaatgtttagcccaagtgggtatgatggaaacagctaggtcgcggggcgtcgcctgtgtttggcggcgccccgtttttgtgttgcaaggagggcaaaggtatgaacgccacggttgtgatcccaacatattgggcaggcgatgatacccaagcaaacgctcccggcacctacgatcactcgacgtcgctcaatgccgccaacccggaactcgatcgctgcctgacttcgctcgaacaggtgcgcgacattccgcgcatcattctcttggtggtctgtccggtttctgccacgtccgacgtatcccatcgcgtgcacgaaatcgttaatgcgcatccctcacttaaggtcaccatcgttaccaatactcaggcttcgcgtgttgccgaccgcgtggcacagattgcgcccaaaggttcgggcgagtgcgtgagcctgcgcggctacggcgccatccgcaacatgggtcttgcctgcgcggcggtgctggggcacgacgcggttgtgtttttggatgacgacgagaccgtcatcgatgccgactttatgaagcgtgcgacctatgcactgggtcaacagacacgtcagggcctgccgattttagtcaagagcggatacttttacgatcgcgacgggtcgccgctggctcccacggacaaagcgggcatttgccatcgctggtggaccaagcgtatcgagttcaatcgctggatgaaaaaggcgctctcgggcacccgcatctcgcgctccaattacgtatgcggcggcctgatggccctgcacgcccgcgcctttacacgcgtggccttcgacccgtttatcacccgcggcgaggatctggactacctgtttaacatgcgcatgttcggctacgacgtgtggttcgataacgagtggaccgtgcgccacctgccgcccgagtccgagaagcgctcgccgcgctttatgcaggacgtgtaccgttggtactacgagcgggccaagctgacgttcgctgcgcaccaaaaggagctcattccggttacggccgcatcactcatgccctatccgggtccgtggatctcgcgcgagctcgacgaccgcgtgcgcaagaccgccatggttcgcagcatgtttacccgcgagcacgaggggtatctgcgcatctggcgtcatggtattgacgaggccaagacctatgcccgccaaaacgccgcaagctacctgcgttttcagagtttctggcccaagatcatggatgaactttggcgcgacgcacaactgattagcatcctggagggggctgaatgatcgaccgccgcgcccagcgcgataattcaatttcaatctttcgcatcatcgccgttgtctgcgccgtttgcgtgttggtgtactttatctttgccctggcgactggcattgagccgattgccacggtgatcgcctgtgcgctgctgtgtatcttcctgtgcatctttatctatttgacgctcaaccccgattcggtacgctcccagtacaccgaggagacgctctcggttgcctcggccatgctcgaggacattaagggcggcctgacgcaggaatcggcgcttttggtgtgccggcgtattctgcccgagacacgtgccatgaccgttgccatcaccgatgagagcaacgtgctggcctgcgcgggcgagttcgaggaaaagctgctgcccgattcgcccatccatacgctcgccacgcgctacgtcattgagcacggcatcgtgcagtcgttcaaccgcgtggtggacgtggtgggttcggatggctcgcacaaccatgttcccgccggcatcatcgcgcccatcaaggtgggcgaccgcaccgtcggcacgctcaagttctactacaagaccccgcgtgccgtcgaccgtacccagtatgcgctcgcctcgggttttgccgagatcctgtccacgcagctcgccatccacgagctcgaggtgcaaaaggaactgacggcccgtgccgaggtgcgtgccctgcaggcgcagatcaacccgcactttctgttcaacacgctcaacaccatcgcgtcgtttacgcgtaccgacccgctgcgtgcccgcgagctgctgcgcgagttttcctcgttctatcgcgccacgctcgacaactcggggtcgcttatcccggtctcgcgcgaggttgcccagaccaagcgctacctgacgtttgagaaggcgcgctttggcgaggaccgcgtactggcgaccttcgatgtctccgaagatgtcgaggacacgttggtcccggcctttgtaatccagcccattgtcgagaacgccgtgcggcatggcatgggcgatggcgatgccctgcagatcgatgtgaccgtccatcaagacggcgacgacgcaatcctgattgccgtggccgacaacggcgtgggcatggacgagggcaccgccgccaggctgtttgatgagcgctccgcccgccccgatgccagttccccgcaaggcggcggcgccggcgtggccatgcacaatatttctgagcgcatccatcgcttttatggaccgcactcttatacgcgcgtcgaatcggcgccgggcaagggcaccaaagtgctcctgcatcttgatttgtcagagagcatctttgacattcaagagtaaaataaaaggctatgggctcaacgccaagcggcggatgcccagcgtagtttgttgacgaaaggtttaatccctatgctgcgtgcgatgattgtggatgatgaggccccggcccgttcggaacttcgcttcttgctcgagcagacgggcaagatcggcacgatcactgaggcgtcgagcgtccgctccgccattgagatgctgatggaaagccgcgtcgatgtcgtctttctcgatatctcgatgcccggcgcttctggtctgcagcttgccgaggcgctacataagcttaagaatccgccggcgattgtgtttgtgaccgcgtatagcgatcatgccgtcgaggcgttcgacgtagatgccgtcgattacctaatgaagccggttgaggaggcacgtctggatcgcgcgatcgagaaggtcatgcaacacgccaagcccgtcacggacagcaaagccaccatcgagcgcattccggtggaaaagggcggccgtaaggtcctcattcccgtggatgacattcgcttcatcatggccaaggacgattactcctgtatctataccgtcgatgatcgttttctatcgacgacttcgttggcgcagttcgaggccaagctttgcgactttggcttctttcgcgttcatcgccgctatatcgtcaacttggcgtgcgtcacagatgtcgagacggtgccctcgggcgctatccaactgggcattacgggcgtcgacgaacgcgtgccggtctcgcgccgccgcgttgtgccgctcaagaaggccctgagcctctagcacactggccccgcagccctgtagaccaattgtctgcggagccgtggggctttttgtatatacgtcgaatcggttttgcagaagggatcccatgaacagtgcaagcgccaagcgcatcgacatcatctcggacacccacggctatctttcgcccgcgcttctggacgagctcaagggcgcagatctgatcatccatgccggagacctcacctcagagatggattacgagcatctatgcaccatcgcccccgtgcgagcggtcctaggaaacaacgactactaccgcgactacggcccggatgtagaccgtctggccctcttcacctacgaaggactcaaattcgccgtagcccaccaccgcgaagaccttccggtgggatccgtagacgtagccatcaacggtcatacccacgtaaccaaagaggcccaagtaggccgctgcctggtcctcaaccccggcagcgccagctaccccagaggcacccgaggccccaccatggccagaatgctcgtcaaggacggcaagatcctgagcaccaaatttattgacttagactaaccgcaacaaaaacgggggatgcagatcgcatctcccgtttttctttcagcaaaaggccgaagttcaacaagaataatcagaccaacctcgccgaggagaacggggccgccgagccgcggaagcggcgaggaacaacaacggctcgaacaatgtgacggcagggagggtctccggggccggctggcgcgggttaagtttgtcgcgagttccgcacgcaaaggaaagcacttaatgtgctttccgtcttgcgcaggactgtagagcagcaaacttaacccgcgccagccggccccggagaccctcccggagggcccaaaaaatattttcaaaaaagttgttgcgcaccggacagacttctgtgtatactaatccccgcagcgcacgcgagcggaaacaaacgcgaacgactgcctggggagttagctcagtttggttagagcgccggcctgtcacgtcggaggtcgcgggttcgagccccgtacttcccgccaacgcaattaaagccacgtcttcggacgtggctttttgcgtttgataggaccttgatcccatcggcccctttcgcccaaaaccaaatcctcccaatttccggacaagctccgtttgagacatgtgttcaaacaaagcgtttgttgcacaacacctgttcagcgaagcagggggttaggttatactaaattgcactgaatgccgtttttgatgcaagaggcttcaaacacggcattcagtgggcacccgttttgctatttgggcgtccatacggccattggtgtctcgacgcaagctcggtcccggagctcgttcgagctgttcctattccttgaaaggggaaaaatggacatatcgaggaagactgattacgcccttcgcatgctcgcgatgcttgccgaggacccggagcgtctgctttctgttcgcaccgccgccgaagaggtcaatgtcccgtattcgtttgctcgttcgatccagcatggtttggttcaggccggtattgtggagagcctgcgtggcgtccatggcggcatgcgtcttaaggtcagccccgacgatgtcaccatccgccaggtcgtcgaggccgttcagggccccatggtcatgaacgattgcaccgcgcccgatggcgactgtgcacgcatgggtacgtgctgctatcatcccctgtgggccggagctcaagcgctgatgcgcgactacttcgattccgtttcgctgggcgatatcgtcgctcaccgccagtttccggccgtcgattctaagttcgccgaccgcgatgcgtttcccgagtacgccacctgtacgtgcgcttgccgggaggaataacgccgcataaggagcatagccatgattcaggatccctttcgttcgatgattcgttcggaaggggtcctgcgttatcgcgaccttccgtggcgccgcacgcgcgacccgtacattatttggctttctgaggttatgctgcagcaaacgcaggtgccgcgtgtggagacgcgtatgcccgcgtggctcgaccgctttccgaccgtacaggcgctcgctcaggccgctccttccgacgttttggatgcttggcaggggatgggctacaaccggcgtgccctggcgcttcacagagccgctcagtgcgttatggaagactggggtggggagtttccacgtgagacgcgcgacctggttgctctgcccggtattggcccggcgacggcgcagggcattcggtcgtttgcgttcgatctaccgggtgtgtatctggagaccaacgtgcgcacggtctttctgcatcatttctttcccgatgtgccggccgttcccgatcgcgagctggtgccgctgatccaatccgcctgtccggcggcccctggtgcgacggcggatgagattgcgccctttgccgcgcctcgagatgatgccgacacgccgcgcgcatggtattacgcgctgctggattatggcgcgtatcttaagaagacgctgcccaatccgtccaggcgctcggcgagctatagccgtcagtccaagtttgagggctcgcgtcgccaaaagcgcgcccatattgtgcgcatgctgctggctgcgcgcgatgggcggccgtcgggcattacgctcgatgaagccgttgcaggcgttaacgagatggagacggcagccggccgagagccggtcgatcacgatcttgtcgcagacattttggccgacttggagcgcgagggcttttgccgctccgagggtgatcgctggctaagcgtgtagccaacccgaatctgaagaagaggattgtaaggtttaaattctcggcttgagggcatcctaaagacaaggccgctcgaagcctacgggcggcatgttgaagggaagtacacctatggattttgagaactctcaaaccaagaagaacctcgagaccgcttttgccggtgagtcccaggcgcacactaagtatcgctactatgcatccaaggccaagaaggacggctacgttcagatctcgaatatctttgccgagaccgcaggcaacgagtcagagcacgccaagctgtggtttaagtatctgcacgacggcgccgttcccgacaccctggacaacttgcgtgatgccgctgcgggcgagaactacgagtggaccacgatgtacgacgagtttgccaagaccgccgaggaggagggctttaccgagatcgccgcaaagttccgtggcgtcggtgctgtcgagcaggctcacgaggaacgctacaacaagcttgtcgagcgcattgagtcgggcgaggtgtttgagcgcgagggcgtgaaggtgtggaagtgcctgaactgcgggcacctgcatgttggtgccgaggcgcccgaggtgtgcccggtttgcaaccacccgaaggcgtactttgaggagcaggtggtgaactactagcgcgtggcgctggctgctgcggagcgcagggcgggaggccggactaccttccctccccgctcacggctccgcagggtcgcgttgagggaaggtagtccggcctcccgccctgcgctccggcttcgggtcgtcgcgtgctcactacagaaaagctgataagaagtttgtgtgccgccccctttggggcggcactttttgtgtggggtccctgtcttcacaatttccgtcaagcttttggttaggttttggtcggatggcgcaagggcgaaagggcaaaagattgctgacgaaaaaagctcaaagaaagtgctggtaggggagttgttgagctttttgacagttttctgacaaaagaatctttgcggctattgccgcggatttcgttgccgcggccgcgatggtgcgggatgctgggcgcaagcgtcgaatgctcctattgaggaggccaacatggatctgtttcttgagaccccgcagcaacaagccgagcgcatgttgcgccagcagcaacggcttatggagatgcaaatgcaagggacggccgtccagcctcctgcgcaaaacgccgcacctgcgggcggggcggtcccagaggcctattccgtacagcaggattcatatgctcaggagctcgcgttcgataaacgtcgtgcgcgtcgccgtcgctgggcccagcgcctgcgtacgctggcgatgatcgtgctaatcccgttggggctcgcggcaatcttcttggcctcatatgccctcacatgcattctcaacggcgcctcgcccagcgaggtgcttgagcacttggcagctctcggccagcgcctgggcgatgtcgcaacaaccatccgcgccggctgggagacttagcgttttgatgtctgtggtccaaatccatttgcccgattgccgtgaagcgcccggtgcgtgtggcggggtaagattgatcgcggttttgattggtgctcgattgggtttgttgggcggagtttatgtctgctattgatattgtgcttgttgtgatcgccttggtggcggtgggggttgctgtggcttgcgccctccaactcaagagcctgcgtgccgagttgcgggagcgtggcgacagtagcgcggaaacgctggcagcactcgagcaggctaacaaagcgctcgatgccctgaacgtcgcgctggccgaaacccgtcgcacggccaatgccatcgcgcagcagcagacgaccgatgcggccgtagagcagcaacgttacctgaccatcgcgcgcgagttctcgcaagccggtgaccggatggatgatctgcgccgcgagaccgcccaacagctcggcgccaatcgcgagggcatcgagcatcgcctggacaaggtgcgcgagacggtcgatgctcagctgggtgccatccgcgaagacaacaacgtgcagctcgatcagatgcgcgcgacggtggacgagaagctctcccgcacgctcaacgatcgcctgtcggcatcgtttaagcaggtgagcgaccagctcgaggccgtgtacaagggcctgggcgacatgcagtccatcgccaccggcgtgggcgaccttaagcgcgtgctgggcaacgtgaaggcgcgtggtattttgggcgaggtgcagctgggtgcaattctggcggacattcttacacccgaccagtatctggaaaacgtcgccaccaagcccggcgcctcggagcgcgttgagtttgccgtcaagctgccggtggacgagggcgaccccgtgctgctgccgattgactccaagtttccgggcgacgcgtacgggcacttgctcgacgcgcaggagtcgggtgatgcggaggccgtggcggctgcgcgcaagacgctcgacaccatggtcaagcgcgaggcaaaggacatttgcgagaagtacctgagcgtgcccgcgaccaccaactttggcattatgttcgttccgtttgagggactgtacgccgaggtcgtcagccgccccgggcttatcgagaccctgggccgcgactatcacgtcaacgttgccggtcccagcaccatggcggccatcctcaacagtctgcagatgagctatcagacgtttaagttgcaaaaacgtaccgacgacgtgctgcgcgtgctctccgccgtcaaggccgagctgccgcgctatcaaaaggcgctgcgccgcgcccagcagcagatcgagaccgcgggcaaaacggtcgagggcatcatcaccacgcgcaccaacgtcatggagcgcaagctcaaggacatcgacgcactggaagacgtcgaccaagccgatgagatcttgggactcacgtccgcgggccttcccacagaccaagaagacgaggactaattgcaacaagacggcggggcgcctgcgcaagcgcggggcgcgggcgcttttcgcgtcgcacttgcctgaagtgcgctttagtatgcaacaatggcgtttcgcccaatcagatgcgaaaggaagcccatgtctcagagaagcgccagcccgctcagccgctccaccgtgcgtcgcacgctgcagcggttttggggcgtcacgcgcacgcagtcgctgattgtctttctctcggtgttctcgtcggcgggctacatctttttgctgacgtttgccaatacctatgtgatggccctcattgtcgaccgcgttcaagccggtcccgtggcgggtgaccaggtgtttgaggtcttcggcccctatatcctggcgctcgtactcgttaacctggtgggccaaatcctctccaagctgcaggactacaccgtctacaagctcgagatcgcgggcaactatcacctggcgcgcctatgcttcgacacgctctccagccaatccatgacattccataccagccgctttggcggatcgctcgtgagccagacgagtcgttttatgagcggctacacggggctggtggacgtgacggtgtattcgctcatccccaccatcacctcggtcatctgcaccgtggccgcactcgccccggtggtgccgacgtttaccgtgatcctggtgtgcatcatggtcgtctacatcgcgtttgtctggcttatgtacaagcgtatcatgccgctttcggccgcgacgtccgccgcgcagaacaagctctcgggcgtgctctccgacgcggtcacgaacatcttggccgttaagacctgcgggcgcgaggactttgaacgcgatctgttcgacgccgccgatcgtgccgcgcgcgatgccgagacggtctcgatgcacgccatgatgcagcgcaactttacgacctcgggccttatcgtcatcaccatggccgtggtgagtgtgttcgtggcgggcggcaacgcgtggtttggcatctcggccggctcgctcgtcatgatctttacctacacctataacctcaccatgcgtttgaactacataagctccatgatgcagcgcatcaaccgcgctttgggcgatgcggccgagatgacgcgcgtgctggacgagccacgtttggtggcagacgacccggacgcccctgagctcaaagtgaccgagggcgcgattgattttgagcacctgagctttgcgtaccgtgacgctgcggcgggcgagagcgtgttcgatgacctgacgcttcatgtggcggcgggccagcgcgtgggcctggtgggcaaatcgggctcgggtaagacgacgcttaccaagctgctgctgcgcctggacgatgttcagggcggccgcgtgctcgtggacggtcaggatgtctcgcgctgcacgcagcagagcctgcgccgccaggttgcctacgtgccgcaggaggcgctgctgttccatcgctccattcgcgaaaacattgcctacggtcgtcccgacgccactgatgagcagattcgcgaggccgcgcgcctggccaacgccctggagtttatcgaccgcttgcctcgtggctttgacaccatggtgggtgagcgcggcgtcaagctctcgggcggccagcgtcagcgcgtggctatcgctcgcgccatcctaaccgacgcgccgattctagtgctcgacgaggcgacctctgccctcgacagcgagtccgaggcgctggtgcaggaggcgctcgagaacctgatgcgcggccgcacctccattgtggtggcacatcgcctgtccaccgtggcggcgctcgaccgcattgtggtgctggccgatggcgagattgtcgaggacggcacgcatgcgcagcttgtcgaggcgggtggcgagtacgcgagcctgtggagccgtcagaccggcgcattcttggaggtgtaagcgtctcggacgtgggacaattgtgcccataagtttattgtgccgttgagccgaggagtcgttatgccacgcgagaccaatgccgccaaacgcgagcgcgccgttgaggtgtgtgagcgcctcaaccgtcgctatggcccggtcgagtgctttttggaccacgagaatcccttccgcctgctgatcgcggtgttgctctcggcgcaaacgaccgacgcgcaggtcaacaaggtgacgccgaagctgttttcccagtggcccacgcccgagaccatggcacaggcaagcgtggccgatgtggccgataccatcaagtcgcttggcttttataagagcaaggccaagcacgccgtggaggccgcgcagatgatcgttgccgattacggcggcgaggtacctgccgacatgaaggaactcgtcaggctgccgggtgtgggacgcaaaacggcgaacatcgtgctcaacgtggggtttggcattgtcgagggcatcgcggtcgatacacacgtcaaccgcatcgcacaccgcctgatgctgagccccaagacgcatgccaaggagccgctcaagaccgagcaagatctgctcaagattttgccgcacgagtattgggagtcggtcaaccaccagtggattacctttggccgtgagatctgcgacgcccgcaaacctaagtgcgacgagtgcccgctggcggatttgtgccccagcgtgcgcgtggcggggtagggcggaacgcattttcgtctggcgttttttgcggggctgggtttgcccttgaaccggagtcctctccatgcgttaccatgacagacaatgtatttgacgtacgacccgccgagcttgccccggcgggcttttggcgttgcaatgccggaggaacagcatgctcattcaccgtatagccgcgcagctctacactgccgaggccttgcagaccgtcgaggccgggctcgatgctggcgaggacgtgacgctggctgtgtcgcagtcgggccgcacgcttatggcggccgcccagtttgcgcgccgtccgcgcccgacggtctatatcgtgagcggcgaggatgcggccgatcgcgccgcgcgtagccttgccgcctacgtgggcctggcgcacgtgtgtcgttttcccgagcgcaaggactatccgtggcgcgagcaggcgcccgacgacgccgtggtggcgcagcgctgcgaggcattggggcgcatcgtgcgtggggacaactgcatcatggttgcctcagcccgtgcgctgctgcgctgcgtgccgccggtcgagagccactactgggagtccaccacttttgcggcgggcgaggagattccttttgacgaggtgccgcagcgcctggtgggcatgggctacaccaatgccggcgccgccgacgcgcccggcctgttccgtgtgcacggcgacaccgtcgaggtgtttcccgcgcaggagaaggcgcccgtgcgcattgagttctttggcgacgagattgaccgcatccgccgcatggtgagctcaacggggcagaccatcggcaacgaggacagtatcgagatcttcccctgccgtgagctggcgcttaccgacgaagccgtccacaacatgcatgtggcgctctatcgcgccagccaggacgacagcaaactggcggcgctgctcgagatggtggatgcacgcatcgtcacgcccgagctcgaccgctttttgccggtgatgtacggccagaccgtgagcccgctggcacacgtgagcggcaaggcgctcgtggttctgtccgagccgcgctcgctgttcgacgactgcctgcgcgcctacgaggatatcgaggcgcgtgccggcgaggcggggattgaccgactggatggcctgtatgtacgtgcccagcagctcgattttggtgctcagcagcgcctgaactatgtgagcctgattcgcgccggtggtgcggtgacggccgagctgaagattgagcagcctgccatcgcaggatcggacaaccgttttatgacgcgcatccaggaggtcgtgggcaagcgctacgcctgcgtgtttgccattcccgaccgcggggcgcgcgagtcgatggagctcacctttggcgacgagagcattacctttgaggaatcgctgaccgcggcgcccgaaaatgtcggcgctatcggcgaccgcgttcgcgtggcagcggcggattccgccgaccgtgccgcacgccaggaggcccatgcttccattcgcgagcgtaaggccgacgcgctcaacgcccgctcgctcgaggcgggcgccgcgcaggctgccgccggcgctgccgtgcccaccatctcgcgcgggcgcgtgacctttgtggacgctgccctgccgcagggcgtggtggtgcccgacgccaatttggccgtgttctcgatcgccgacctcaatgcccgcatggatgccaaccgcgcgcgcagccgccgcaaggttgacattacgcagatcaccttcccgtttaagccgggcgactacgtggtgcatgctacccacggcatcgcgctctttagcgagatcgcgcgccaggaagtgggcggcaaggagcgcgactactttttgctggaatatgccgacggcgacaagctctacgtgccgctcgagcaggtcgaccgcatcacacgctatgttggccccgacggcgacaagccgcgcctgaccaggctcaacactgccgactggacgcgtgccaccaataaggcgcgcaagaatgccaaaaagctggcgtttgacctggtcgacctgtatacgcgccgctcgtcgatcgcaggcatcgcctgcccgcccgatacgcccgagcagatcgagatggaggagagcttcccctacgacgagacgcgcgaccagctggaggctatcgccgacatcaaggccgacatggaggcgcccaagcccatggaccgcctgctgtgcggcgacgtgggtttcggcaagaccgaggttgccctgcgcgcggcgtttaagtgcgtggactccggccgccaagtcatggtgctctgccccacgaccattctggcccagcagcactacgagacgttttttgagcgctttgccccgtttggcctcgaggtcgaagtgctcagccgcttccgcaccccggcgcagcagaagcgtgcgcttaaggcgtttgccgagggcacgattgatgtgctcatcggcacgcaccgcttgctttcggccgatgtgaaccccaagaacctgggcatggtgatcatcgacgaggagcagcgctttggcgtgcagcacaaggagcagctcaagaacctgcgcgagcagattgacgtgctcacgctttcggcaacgccgattccgcgaaccatgcagatggccacgagcggcgtgcgcgacatgagcctgatcaccacaccgccgaccgggcgtcgtcccgtgatcgtgcacgtgggggagtacgaccccgacgtggtgagtgcggcgattcgcctggaggtgggccgcggcggtcaggtgtattacgtgtccaaccgcgtcaagactatcgacgacgccgtggcgcgcgtgcacgaggccgcgcccgaggcgcgcgtgggtgtggcacacggcaagatgagcccgcgcgaggtcgaggacgtgatgatcgagttcgcgaccaaaaagatcgacgtgctcatcgccacgaccatcgtggagagcggcatcgacaactcgaccgccaacacactgatcatcgaggactcgcagcgcctaggtctggcgcagctctaccagctcaagggccgtgtgggccgctctgccacgcaggcctatgcgtactttatgttcccgggcgagctgccgcttaccgaggaggctacggcacgcctgaccgcactttccgagtttcaggacctgggcagcggcatgcgcatcgccatgcgtgacctggagatccgtggtgccggctcgctcatgggcgccgagcagcacggcaacctgtcgagtgtgggctttgacctgtttacgcagatgctggggcaggccgtggccgaggcgcgcggcgacgacgatgccggcgtggaggcggcgagcgtgggcattaacctgccggccgactacttcttgtccgaggagtacatgccggcggtggaccagcgcgtgctcgtgtaccgcaagctcgctgcggctgaggacctggagagtatcgacgaggtgcaggaggagaccgaggccgcgcatggcgaactgccgttggcgggactcaacctgttcaaccgcgcgcgcatccgtattcgcggcgagcgcctggggctcgagagcgtcacgctcagtggtggacgcattaccttcttgggggttgacgttcccaagaaggtggcctttgagttcaagaatcgctatggcgcggtgaacttccccaagagccgcaagctatcggtgccctacaaggcgggcgccggcgcgggcagcggcctgggtcgcggtctcgacgccaacgacggcaccggccccgtggcggccgcgctcatgctgctgcaacagctgggtgccagcgacgacgactaacgggtcgacgctgcaaacgccccatttgggcaatctggctccatcgaaaggaaagcatgttcggatacatctataagaaagatgtcgccattatcgcggttgtcctgtgtctttgtctgggcgtgggcagcttcttcgattatcagatctcgagcgcgctgttcaatatcggcagcatgtacggtcgctttatcgaggcggccggcgagctgccgtttgagctgacggcgagcatcgcgggcgttatgctcgtgcgcgcggtgcgtcccgactccagggggagcaaatggctcgccgtgctcggcatcctcatcaacgtgggcctgctcggctacgagatcgtttcgtccctgagggttggcggcaaactcatcgcggctcagttggtgctgacgtttgtgctggtcatcgccgccaatcttatcgtctatcgtctcacgcgcacgaccgagcccgacgagctcacgcgctgggcgttgatggtgcttgtcgtgtgggtcgctcaggccatcatcctcaacgtgattgtcaagccgctgtggtcgcgcccacgcatgcgcgtgatcgaggtgacgcagggactcgagtttcagccgtggtgggtgatcggcaaccctgacaagtgggcctatattgccgccggtgtagtcaaggacggctttaagtcgtttgcgagcggacacacggcgcatgcggcgattggccttatgctcgccgggcttcccgcggcagcctttaaggaaaaatcttcgcgtcgccgcgtgatcttttgggcggcggctgtggtcgcggcgctcgtcgcgcttggccgcatcgtgatcggtgcacactttttgagcgacgtgagctgcggttttgccctggtactggcacttgagtgccttgccgcgcgcattgcctatcccaacggcgtacaatagctccgtttgaatcatctggccgatacccggtaagagaggattgccatgctcgcgtttaacaacgattattcccacggcgcacatccggcagtgctgcaggcgctcgtcgacaccaatatggagccgcagcccggctacggtaccgatgcgcacaccgagcgcgccaagcaacttattcgcgaggcctgccaggcccctgatgccgacgtgttttttctggtgggcggcacgcaggccaacgcgacggtgatcgacatgctgcttgcgccctacgagggcgtcgttgctgctgagactggccacgtcgcctgtcacgaggcgggcgctatcgagtttggcggccacaaggtgctcaccatccccggctacgagggcaagatgcacgccgaggacctcgagaactatatccaggtgttctacgaaaacgagagctacgagcacacggtgttcccgggtgccgtgtatgtgagcctatcgaccgagtacggcacgctgtactccaaggccgagctcgcggcgattcacgcggtgtgccagaagcgcgagattccgctgtttgtggacggtgctcgcctggcctatgcgctggcggccgatgagtgcgacattaccctgcccgagctggcgcagctgtgtgacgtgttctacatcggcggcaccaagtgtggtgcgctctgcggcgaggctgtggtgttctgtggcatgcacgccccggcgcaccccattccgcgtattaagcagcatggcgcactgctcgccaagggccgcctgatgggtgtgcagttcgaggctctttttaccgatggcctgtattttgagattggtcgccaggcgattgagaccgctcaggcgcttcgtcgtgtgctgcacgagcgcggctaccagttcttcttggagacgcccacgaaccagcagttcgtgattctgcccaacgaggatatggcccgcattcgcgagcatgcggcgatcgagtactgggaaaagtacgacgatactcatacggtagtgcgcttttgcaccagctgggccacgacgcaggaggacatcgacgcgctggcggctgtcctgtagcctgatgtaatgacgaggggccgccctgcgctgggtttggcgcagggcggcctttgcttttgggggagaagagttgtatgaccgagatgtccgagccggcgattcgcctggcgacgcccgaagacgcgccggcgttgcttgccatctatgagccatatgtgcgccagacggcgattacctgcgaatacgaggtgccgagcgttgaggagttcgccgggcgcatcgagcgtacgctcaagcgctatccgtacctggtgatggagctggacgggcgtccgataggctatgcctatgtgagtccgctcaacagccgcgaggcatacgactggtcggtcgagacgtcgatctacctggcacgcgatgtgcgccatggcgggctgggtcgcaagttgcacgatacgctcaagcaatgcctgattgcgatgggcatcaccaacatgtgcgcgctcatcgccgtgccgcacgataaggacgacgagtacctgacgcacaacagccaggacttccatgcccatatggggtatcgcctggtgggcgccttcgatcgctgcgcccaaaagttcggccgctggtacgacatgtgctggatggagttggtcctagccgagcgcacgcccaaccaacccaaaccgacctggttccccgacctccccaaacctaccttttagggacaggttagccgatgggctcggtgtatttggcgcggtcggtgcgttggatgcgcttggagacatggagcgggcggccgtcggtgtcgtagacgtagtcggtgatcaggatcagcgcctgcccacgctcaacgttgagcaaaaacgcctcgttttgcgaggcatagcacacctcaaaggtcttgtgcccctctgccggcgcgcgatggaattcttggcgcagcgtggcgtagagcgaaccgttgatatcgcgatcgatgagtgcttcaaagctcggtggtagataggtggtctccaggcacagcggcgcatcgtccagataacgcaggcggacaagtttgacgagcttgctgcccacggcgacatcgaagaacttggccgcattgcccgcggccttggcaaagcccgagtccaccgtgcgcgtggtgggcttcataccctgaccctggacctgtgtcgtgtagctcgaaaacaccaggttgttctcgtggagcgccggcgtgtcggccacaaaggcgccacgcccgcgctcggtgcgcaccaggccctcatcaacgagcaccttaagggcgtggcgtacggtgctgcgcgacagccccgattcgtccatgagttccatctcggacggcagcttgtctccgcgcgcgtaggtgccggaggcgatgcggtcgcgcagcatgcccgccaagcgctcgtattgggtcagtctctttttagatgaagcgttcatgcgatcaacctgtatctaacctgtatgcgtatctaatcaagcatgtattcaatacaacaacaaaaccgctggtatcaagttatcgaaaaccgtatcagcaaattttttaagacaaatatagcatacaactagtcgacataaccaaaacatgtatgtaacttgtatgccatcgagagcatcaaacgagaagaaaggctgatgcacgatgactactcaggaacaggttaaggacgtcgtctcccaggttttggccgacaaggcagacaagggcggcatcaagcgcgtcgtgtggattggcgccggcggatccaacggcggcaactatcctgcccagtactttatggagcacgaggccacgcaggtcgtgagctccagctacaccagcaatgagttcgtgcacgccacgcccgcctatgtcaacgagaacaccctggccgtcgtcgtgtccatgcgcggcaccaaggagaccatcgtcgccgcccaggtcgccaaggaccacggcgccagcaccatcgccatctatgtcgatgagtccggcctcaccgaggtctgcgactacaagattcagtatgacagcctggccgtcgacgagtcttgcatgggccgtaccaactccgccgtcgtgaccatgatcgccatggagcttacgcagcagaccgagggctatgccgagtatgagaccgctatggccgccttcgacctggttgaccccatctatcgcaaggccgtcgagtacacccgtccgctcgccgccaagtgggccgagcaaaacgccgacaagccctgcatcaacgtgatggctcagggtccgctctttggtgccgcctacgtctttagcatctgcaacgtgcaggagatgctgcagatcgactcctgcaccatcaacacctgcgacttcttccacggccccttcgagatcctggacaagcgcacctcgctgttccagctcatcagcgtcggccgcagccgctgcaacgacgagcgcggcatccgcttcgtcaaccagtacggtggcgagcgcgtctatcagctcgacgccaaggagctcggcctcaacgacgtcaaggacagcgtgagcgagtacttcaatcacctgatttttgccccgatcctcaacaacgtgtacatgcgtgcgctctctgccgtcacccacaaggactacatgacgcgccgctacatgtggaagctggactactaggggatagagcggcctaacagctcgatgtcctcataagttgcggtggaatagttcctgcttgggggcttgaagcctctatttaggaactatttcaccgcaaccgcccagtaatccgctgggggcggaggaaaacggatcacttatccgctcgccgatttgtgtcttgaaaaatgtatataacgactataacgtagtacgaaacatattggaagcaataccgaggaggctgcgttgaagaagagcaatctgggctatgtgctggtgctgatcgccgcgcttatgtggggcagcatcggaatctttgtaaacggcatctcggccatgggcgtttcgtcccagagcatggctgcctttcgcttgttggtcggagcgcttatcttggcgccggtcctgatgtttatgggctgccgtccgggtgaggggtctaccgtggctcagggtccgctggccctgttcaaggcaagccctaaagagcttgttccttgtgcgcttgttggcatcgtcggtttggccgccgctaacacctgctattacgagtgcatgggcgaggtgggcatgtccacggcctcggtgctgctctacacctcgccggtgtttggcgtcatgctcggccgcgtgctttatcgcgaggacgtgacccccaacaagctcgttgccattgtctttaacatcgtaggctgcgtgcttgcagtgaccaatggcgacctttccggttttcatttttcggtttggggcgtcacgtcgggcgtgattgcaggcctttgtggtgcgtcgctcgcggtgtttagccgaatagcaaccaagacggtccacccgctggctgtcacgttttggggctttgtttttggcggtgcggttatggcagctatcgcggctccgtggccggatgtcgccgcggcaatgtcgccacagctgctgctgctgttccttggctttggactcatccccacagccgttgcttacatcttatatatgcagggtctgtccatggggctcgagacatcgaaagttcccgtcgtaatgtctttcgagacggtcgtcaccgtactggtgggcattggtgtctacgccgagcccgccggcgcgattaaagtcctgggcatcgtgttggtgctcgcgtccatcctgattatgaacaccgacttctccaagctgcgcaacagtgtgtttgtcggtcatgtcattgagagcatgacctttaagcccaacgcgtggtggaccgaaaaatctcaggacatggatctgtttaaagaacgcaccggcattgcgctggaacccaccgtacaggaaagcccctggtacttcgtgcgataggggattgcgcgcagggtctgacctggggttatccagctagcgccggcctacccagcccaacgtttcgagtacgttaaacccgtcaacggtcgattttcacccgcgaacggtctttatactaattagcaatataagcaacgtataagacgttataatgaccataacgaaaaggaggaggcaagatgaatcagatcattctcgcatctcatggcggcctggccgcaggcgccaaagacacgctcgagatggttctcggcgacgtgtcgaacgtccacgtcgtgtcgcttgctcgtgacgacaaggagcccatcaccaataaggttgaggctatgatcgccacgttcaacgcggacgacaccgtctatgtgctgaccgatatgctcggcagctcggtcaacaacaacatggtcgagctttccaagaacggcacgaagttcacggttgtcagcggtttcaacatcccgttggcgctcacgcttgctatgagccccgcccccgtcaagggcgccgagctcgcggccctcatcaacgaggcccgcaccggtctgaccaaccccaacgcaccggtcgaggccgccgcggctcccgccaagaaggccaaggcgtcccgtcacagctccggtcccgccaagatcgtcctcgcacgtcttgactaccgtctgctgcacggccaggtcgtctttacttggaccaccaaggttcaggccgagcgcatcatcgtcgtcgacaacgctgccgccaacgatgacatcaagaagggcgctcttaagctggccaagccccagggcgtgcgcctgaacgtcttcaccgtcgagcgtgccctcgccaagatggataagctcaacaccctcggcgagcgcgtcatgttcgtctttggcaacactgccgagatgctgcagttctgtcagggctacaagctcgacgccatcaacctgggcgccaccgccaaccacgacggtgccgatcaggtcggcggcaaggacagctccgtcttcctcgacgccacccagaaggccgacgtcaaccagctgctcgacatgggcatcaagctctatgtccagcagacccctacgtatcagagcgtcgacatcgacgccaagctgtaatcaaccaggcttttgcctgactgaaaggagaagggtatgaatacgttcatcagtgcggtgctcgtcggcctcgtcggcgtgttctgcatgtgggactcccgcctgctcggtcgtcttaacttcgagcagcccctcgttggcgctacgctcgtcggtctgctgctgggcgatgtgcccaccggccttgccgtcggtgccgccgtcgagctcgtgtccatgggcctggtgcaggtcggcgccgccgttccgcccgatatggtcctgggcggcatcgtggccgctgcctttgcgtgcctgaccgatgcttccgccgagaccgccatgacgatcgccatcccggtcgccgtcctgggtcagctcctcggcatcgtgttccgttccatcatcgccgccctcacccatgtggcagatagcgcgatcgataacggaaagttcaagaccgcctaccgtatgcacatctgcgccggctccggtctgtacgccatcatgtacttcctgccgatcttcctcgccgtctttgttggcaccgacctggttcaggccatcgtcaacatggttcccgagtggctgtccactggtcttaacgtttcgaccaagatcatgaccgcctacggcttggccctgctgctcaccatgatgatcaagaagggtatgactccgttcctgttcatcggtttcctgctcgccgcttacctcaacctgtccgtcatcgcggtcgctctgatcggtgtgtgcctggctgtcgtcttcatgggcttcaagttcaacggttcccatgcagccgccggtgtcgattccgactacgatccgctcgaagacgacgaagactaaggaggaacacactatggcaaccgcaaccaaggacgtgtccctgaacaagaaggtcagccagttcttctggcgctcctgggccatccaggcctcttggaactacgagcgtcagatgaacatgggcttcctctacggcatggttcccacgctcgaccgcctctatccggacgagtccgaccccaagcagctcgctgctaagaaagaggcttaccaccgtcacatggcgttctacaactgcaccccgcagacgagcgcctttatcctgggcctcaccgcctccatggaggaggagtacgccaaggatcccgagaacttcgatcccgattcgatcaacgcggtcaagacctccctcatgggtccgctttccggcatcggtgactccttcttccagggtaccatccgcgttatcgcttttggcctgggcgttcagctggctcagcagggctccatcatgggcccgatcctggccatgctcatctccatcgtcccctctgtgctgatcacttggttcgcagccaagatgggctatcagggcggccacgagtacctgagcaagcttcagggcggcgacctcatggagaagctcatgtatgtctgcggcatcgtgggccttatgtccgtgggcggcatgatcgctacgctgatcggcgccaccaccccgctgcagttcgctgagggcaccgttgttatccaggacatcctggacggcatgatgccccagatgatctccctcggcctcaccggccttatgtactggctcatcaagaagaacgtcaacaccggttggcttctcgcgatcgccatcgtgggcggcatcgccctctccgcggccggcattctggcctagtcgcgaccaagcgcctaaccgctttcccccgggggcctgcctggcatcccataccccaggcaggcttccatccccaaaatgcgacaatgggacagtccctttgtcgcatcctcaacgggccggcgactcggtccaaatcacggtaaccctgcgagcgcccggcaatgtggcgccgcaaaaatcgaaaggaatgtgtcagatgtacgagatcgaccttaacctccctaagcagatcgtcgctgacgtcctgtccaaccacgagatccacagtgtcgccttcgtcggctgcggtgcttccatgtccgacctgtaccccgccaagtacttcctggccaacaacacggacaagctgaacgttcagatcttcaccgctaacgagttcaactatgacacgccttcctgggtcaacgagcacaccttcgtgatcacctgctccctcggtggctccacgcccgagaccgtcgaggccaacaagaccgccaagaagcacaactgcccggtcgtctccctcaccaacaaggctggctccgctctgaccgtcgacgccgactacgtcatcgttcacggcttccacgccaacttcgctgccaagtgcgagaagcccggctatgccatcgctcttgctctcgagatccttcagcagaccgagggctatgacaagtacgacgacatgatcaccggcctcaccaacgtcttcgatctctgcgagaacgctgctcagtcctgcaagaagctcgccaagaagttcgctgaggacttcaaggacgacaagatgatttacttcatggcctctggtgcctccgagaagatggcttactctcacgccgccttcctgttcaccgagatgcagtggatcgacgccgccgcctacaacaccggcgagtacttccacggcccgttcgaggtttccaccgagggtaagccctacgtcttcttcatgtccgatggcgctacccgtccgatggacgcccgcgccctcaccttccttgagcgcatgggcgccaaggtcgctctgatcgactccaaggactacggcctggctgacgccgtgcccgcgagcgtcgtcacctacttcaacccgctgctgcacctcgccgttatgcgcgagtacggcaaccagatcgccgaggcccgtcagcacccgctgaccatgcgtcgctacatgtggaagctttcctactaatcacaagtaagtagaccttacgggttgattgagaggggatggggtttgcgccccgtccccttttttgctcttgggagggcacgcctgtcgcgtcgcaaaacccaggataaaacctaccaaaataaacctgtctctatttggcaggtgggaggagatgcgtatgatcaaagcagtgctgtttgacatggacggcgtgctggtcgataccgagtggttctacaaccgtcgtcgcgtggcgtttatggaggagaaggggttccactttgacgagatccccgatctttcggggtctaacgagccggccatttgggaggcgctggtgcccgacgatgttgagctgcgcgagcgccttcgcgtggagtacaagcaggtctacagcccggaccaccccgttccgtatgccgagctgctcaacgagcagacggagccggtgatgcgcgcactgcacgagcgcggcgtgaagtgtgccatcgcgagctcgtcttatcgtgagctcattgacgagctggtagagattgccggtatcgccgatgtgctggactacaccatcagcggtcacgagtgcagtgcgtttaagcccgaccccgagatctacctgcgtgccatggaggcgctgggggtggagcctgccgagtgcctggttatcgaggattcgcctttggggatcgaggctggcaaacgttccggcgcccgcgtcctggcactgcgtccgcacgagggcgtcaacctcgatcaatcgcgagccgatgccgttattgataatctgaccgacattttggccgctttgtagtgtcaatccgccgcgagaagcacgggttcaaacgttttttgcggtggactggctcaatttggtttcgattttgatccgtttggcttcgattcggactaagtgagtagactttttggcgcaggccgagcacaatgcatatcttcctttgtaaaaccgcaggtcacaggggtggcggttttgggtgtgctcggcagatcgtaaaaagtctactcacttggaattttgccctttggtcgtgggggttgctggtcccgttttggttgtcgagggaggttgaattgaagcgcccccgcacgctccatgctacaatcgcgggcatgccccacaaccacatctgccttcgaaaggagcctacgtggcgaacgccatcgatcagctcacggaccgagtgctcgtgctcggccgcctcaccatcgtccgccgcgccattactgctgtggcggtcaccatttccgccgttctccagacatttctgatccaggcgttcattcagcccgccgacctgcttccgagcggtcttaccggcgtcgcggtcctgctcgatcgcgttacctcgctgggtggcgttcatatcgacatctcgctcggcatgctcgcgctcaacatccccgtggcgctcttatgctggagcggcattagcaagcgcttcgtcatcttctcgatgatgcaggtcgtgctctcatcgctgttcctcaacgtctttcacttcgcgccgtttttgggcgacaagatcatgctcatcatttttggcggcgtggtctcgggtctgggcgctgccatcgcgcttaaatccggcgcatccaccggcggcaccgactttatcgcgctgtgggtttccaaccacacgggcaagaccatctggggcgtcatctttggtttcaactgctttatcctggcgatctttggctttatgtttggctgggacaaggcggcgtattccatcgtgttccagtttatttcgaccaagaccatcgacagtttctatcgtcgctacgatcgcgtgacgctgcagatcacgacgcgtagggcagacgaggtcatgactgcctacgtaaaccattttcagcacggcattagctgcgccgaggtcgtcggcggatatagccgcgaaaagatgtacctgctgaacaccgttgtctcgacctacgagagtcaggacattatcaagctggtgtgcgacgttgattccggcgccgtgatcaatgtgttccacacgctcaactttgtgggcggctggtggggcggtcatgtcgacgagcccatgcccacggccgttcccgatcccgacaagcccgcacgcatggccagcaggcaggcgcgcctcagcgaacaggacagcctgcagcaggacgacggcaagtagggtattggcattttgccggtcctgcgcaacccatccgaacgagccccccgaaagccccgttgctttcgagaggctctcgtttgcccagataaaacctaccaaaatgaagctgtcgctttttggtagggagggtgtatcgttttatcattatgaggtaatatgaaactagacgttatatacgtattagttatttcgatatttcgataagagtgattagatatgcctgcgcccaaaaatgcaccgctttaccagcagatttacgacgaaatcaaggatgcgatcgagaaaggtgtttatgcacccaaggagcgtattccgtccgagcttgagctagccgagcagtacgacgtgagccgcattacggtgcgccgcgccgtcgaggagctgtgctccgatggctacctggttaagcagcagggccgtggcacctttgtctccacgccgcacatcaaccgccagtttcacgcctcgacgctgcagacgtttaccgcgctgtgtgccggcaacggcatgaaggccggtgcgcacgtgatcgatcgccagatcgttccggcgcgccaaaacgagatggagttctttggcctgcagaaggatgcgctgctgctgcatatcaagcgcgtgcgtacggccgacggcgagcccatctttgaggagaacatctttgtgccgtttgacgcctaccgtgagctgttgacggccgatcttgaggacaagtcgatttttgccgaggtcgagcgtgttggcggaacgccgattgtctcggttggctaccgcacggtcgaggccgttcgtgccaataccgagcaggcggccgagctgggcattgctccgcacgatccgctgctcaacctgcgtgccggcttcacgggccccaatggcgagccggtcctgatgggtaagcagtactacgtgggatcgcgctacgttatggtcatgtagggttggttccgccgttcttacgaacggcggaccgatcgacgctgcaagcccgccagagcggcaatctgcctttcaacttcggcggcatgatcaaaagatcaatgccgccttgtttcaaggcaccttgctcgctctggtgggctttcgctgacattgccaaaacattgacgttgccgggccggcacttggggacgttccttttgtgccggcacctggggacactccttagtcgttggggacgttcttaaacgactagtcattcaagaacgtctccaatgattacccgcagaatgagcgtggctgacagccgggcgacgccggtccgcgtggcggcgtataatcggcggcagatgacttggacgttaggaaaccatgaccgatagcatgcagcagatggcgctcgacacgctcggcgcctattttggctacacctcgtttcgcccgggccaggaccgcatggtcgatgcgatccttgccggtcgcgatgcgctcggcgttatgcccacgggtgccggcaagtctatctgctaccaggtgcccgcgctcatgatgcccggcatcacctttgtggtgagtccgctgctgtcgcttatggaggaccagacccgcgcgctgctcgcggcgggcgcgcgacccagctatctcaactccagccttactccggcccagcaaaacaccgtgctcaagcgggcgcgcgagggccgctaccagcttatgtacgtggcacccgagcgcctgctcgagccgcgctttctggcctttgcgcaggaagctgcggccgaaggcggcattggcgtgccgctcgtggccattgacgaggcccactgcgtgagccagtggggccaggattttcgtcccgcctacctgcagattcgtgagttcatcgattcgctgccgcagcgccccatcgtggcggcctttaccgctacggcgactgagcgcgtgcgtgcggacattcagcagatgctcggcctgcaaaaccccgcgacggtggtgacgggcttcgatcgcaagaacctctactttggctgcgaggagatgggcgacaaggccaaggccgcgtgggtgcgtgactatgtgatcgcgcattcgagcgagagcggcatcgtgtattgctcgacccgcaagacggtcgatgcgctggcaggcgagcttgccgaggcgctgggacctagcggcattcgcgtgggccgctaccatgccggcatgggcaacgacgcccgccgtcaaagccagcgcgcctttatcgacgacgatattcaggtgatggttgccaccaacgcctttggcatgggcatcgacaagcctaacgtgcgctacgtgattcacaacaacgtgcccgagagcatcgaggcctactaccaggaggcgggccgcgccggccgcgatggcgatccggccagctgccacttgctgtggaacggtaacgattttcgcatgcgccgctttttgatcgaccgcggcgatgctgccgacgaggcgctcgacgacgagcagcgcgcgtgggcgctccagaatcgatatcgactgctcagccagatggagggctactgcaataccaccggctgcctgcgcgaatacatgctgcgctactttggcgacgaggccgcggccgagcatgcgtcagcgactggtgcgggcggcgccgccacggacgacgccgagggctgtggcaactgcagcaactgcctcacgcagtttgatgtcgaggacgtcaccgatatggcccgcgctgccgtgcgctatgtggccacgcgtcccatgcgctttggcaagtcgctgatcgtcgacgtgctccacggcggcaacaccgagcgcattcgccagatgcatctggacgaggaccgcggctacggtgagctgtcaagcgaatcggtcgggcgcatcaaggacatcatcggccagctgtgcggccgcggttatttggccacctcgcaggggcagtacccggtcgttgggctgggcccgcgtgccgtcgaggtcgaggatgaggcgttcgcctttaccgttaagcgtcgcgcgtccaagcgcaaggcctcggcccgcgcccgccgtgcggtggatctgctgcgcgaggaggccgagctggatcagcgcccgcgcgtgggcgacgacgccgagctgttcgaacgcctgcgcgccttgcgcaaggagatctcgaccgagctggagatggcgccgtacatggtcttctccgacaaggccctgcgcggcctgtgccgcctacgcccgcagacgcgcgatgagcttatccaggtcaacggcatcggcgagaaaaaggccgatgcctttggcgagcagtttatggcggcgattgaagagtttgagtccgagcatgcacggaatggagcataacgatggcatccgacgataaaaccgagcgcactgaggtgtccgctgtgccgctgtaccagcaggttatggatgacctaaagggcgagatcgcgcgtggcgtgtatccgaccggctcgcgcattccatccgagatggagctcgcgaagtcctacggcgtggggcgcatcaccgtgcgccgcgccatcgaggagctgtcgcgcgcggggtatcttagccgccagcaggggaggggtacctttgtgtgcgctcccaagctcaagcgcaagattgtccagaaaggcgatgttcagagctttaccgagggctgtgccgccaacgatatggtggcgggcgcgcgcctggtgtcgcgcacggtggtcgcggcgacgcacgaggatgcggcattctttggcgtggagcccggctgcgagcttatcgtggtcgagcgcgtgcgtacggccgacggcgtccccgtcatgctcgagaacaacgcctttgtgcttgccgaccatccgtatctgcagacgcttgccgacaaggacctcacggacaattccatctttgcgcttgttgccgagcattcgggtcgttcgccgctcaaatccgatccctgcacggtggagattgcgcttgccgatgctcaggcggccccgctgctcgaggttccgatcggcgagccactcttctacatggagacgtactttaccgattttgatgagcaacctctgctgctcggtcgccaaaagatcgtgggctcgcgctacgtgttcgacatctaacgttcatagatagaacaacatagaacaaatttgccgaaatgactttccgagcgattgcttgcgtggtataaataggacaacatagaacgaccgcaggtacgagctgtcgtctaaagttgccacacaaggaggaacatcagtatgaacgcacatgatctggttcaggaaatcatcgagcgcaagggtaagatcgagaacgtcttttggatcgcctgcggcggttcgatgatcgacctgatgccggccaacgagctgctcaagcgcgaggccaccacgtttacctccacggtctatactgcgcgcgagttctgcctgatggcccctaagagcctcggcgagaagtcgctcgtcatcgcctgcagccacagcggcaacacacaggaggtcgtcgacggctgcgagatggcgctggctgccggtgccgaggtcgttgccatgaccgactgcgagggctccaagatcgatagcggcaagtggaccacctgggtttacccgtggggtgagggcgtgtcgcaggccgaggtgccgcagggcatcggtgctctgattgccgccgagctgctcgaccagcaggagggctacgaggcgctcgccgacatgtacgagggtcttaagcagatggacgcgctgctgcctgccgcccgcgagaaggtcaacgccgagctgggcgcccgctttgccgagctctgccaacagcacaagttcttctacatcctgggttccggccccaactttagccagacctacgccatggccatctgctcgctcatggagatgcagtggcagcactgctgctacatccactccggtgagtacttccacggccccttcgaggccaccgagcccggcgtgttctactttgtgcagctcggcgcaggcgagtgccgccccatggaggagcgcgcgcttgcgttcctcaacacgcataccgacacgctcatggtgctcgatgcgctcgagtacggcgtgggcgaggtgcccgctagcgtgcgctcgttcctagagccgatcttcttctacgcaatgagctgcgagctgcgcgccgcccgcggcaaggtcttcgaccacagccccgagtaccgccgctacatgggcatcgagcagtactaagtaacgggaattatcttttttggcggggtctgcgctgagcgcgggccccgttttgcgttgtggcggccgaatttgttcggtcggaaaagtattagacctaaatttgcaagcgtgccgcatgagtcaaaaaagcgggccgcgccgggggtttccggcgcggcccgcttgggatcgtgcttagattcgcaaggttgcggcagtcggtgccctactttgcgtcgtaggcttcggtatcccaccagtcgagctgggcgatgttgtcgcggatgtgctggcaactcttgtggaagccctcgagctcgtgctcggacaggtcgagtgtgtagacctcctcgacgccctcggcaccgatcacgcacggcagggaggtgaagatgccctcctcgccatactggccggtcatgagcgtggaggcggaaagcacggcgtgctcgttgtgcagcacggcggcgcagacgcgcgcggcggagttggcgacggcgtactcggtgcactgcttgccctggtaggtcacatagccgcccttgcgcgcgagctcctcgacctccatgtggtcgaaggcgtacttgtcggggttctcggcctgaagctcagtcaggctcttgccggcgatggtcgcggccttaaaggcggccagctggctaaagccgtgctcgccgatcatgtaggcgtcgatggacttggggctcacgccgaccttcttggagatctcggtgcgcaggcgtgcggaatccagaccgcagcccgagccgatgatcttcttgggatcgtagccggtcaggtgccacagctcggtgcacacgacgtcgcaggggttggagatgctcacgaagatgccgtcgaagccggcgtcgacgatgcgcttggcaaaggtgcgggcggcgtcggtggtaaagaacagctcaccgtcgcggttaccggcggccagtgcgaccttaccggcggcgttgacgatgacgtcgcagcaggccagctcctcgtagtggtcgtagcagttgacgatcttggtgttatacgggacaaacgaaagggagtcgcgcaggtcctggacctcggacgtcaccttggcctcgttgatatcgcacaggtacagctcatcggcaatgccctgcataagcaggctgttggcgacatgtgctcctacgtggccctggccgaccacaccgatcttacgcgtctggtacatatgagtatcctttcggccgagtttttcgcgttgaaacattgtagcgtcctgccgttactttgctaggctaaagtgcagcagattttagagacatgccttaatttctacttttggggcgttttgggccgttggcggcatcgctgggcgatgtgctcgcgcgaatggggccgctcgttgtaccatagctgcaactgactcgtaaggagcatccatgcccattcgcattccagacgccctccctgccgccgcgcagctcgagagcgagaacatctttgtcatgaccgagtaccgcgcgctgcaccaggacatccgtccgctgcgcgtgctcatcctcaacctcatgcccaccaagattgccaccgagacgcagatcatgcgcaagctctccaacacgccgctgcaggtggaggtggacctgctgcgcaccaaaacgcacgaggccacgcacgtgagcgccggccatctggagacgttttaccgcacgttcgacgacatctgcgacatccactacgacggcctgatcatcacgggcgcgccggtggaacagatgccgttcgaggaggtcgactactggcccgagctctgccagatcatggattggtccaccacgcacgtgcactctacgctgcacatttgttggggcgcgcaggccggcctgtaccatcattacggtatccagaagtacgatctgccggcaaaggcgagcggcgtgttcgagcattatctagtgaagccgaaaagcccgctggtccgcggctttgacgaccgcttctatgccgtacattcgcgcaacaccgacgtgcgccgcgaggacgtggaggccgagccgcagcttgaggtcgtggccgtgtccgacgaggtgggcctgtacatcgtcaagtcgaccgacagccgtcgcttctttgtctttggccatcccgagtacgacaccgatacgctgcgcctggagtacgagcgcgatgtgaagcgcgggctcaacccggaggtgccggcgcactactttccgggtgacgacccctccgccgagccgcgcaacgtctggcgcagccaagctcagctgttctacaccaactggctcaactactacgtctaccagaccacgccctacgacctggcccgcgccggcgaggagcactaggctgcgatggtactgctgtagccgtggctgatatggcggcgattaggcgctgatgatgtggggtagcggcaggtcgtgagcgtcggtgggaacgcggtcgacacgctgctcgtcaaaggcgatgccgatgatttggcatgcgggcgagagcatgggcaggtagcggtcgtagcaaccgccgccgtagcccaggcgcgctccggtttggtcgaaggccacgagcggcacgacgatcatgtcgagagcttcggcaggcacgatagggaagtggttgctgtcgatgtccgtggccgcaaaggcccgcgtagggtgggcgataaacggagccgcggacgcatcgtcggcggcaactgcccgcatacacatgcgctggccacaagctgcggcatcaattgccgagagcatgcacggataggctacgcgccagccgcgtttggcggcagctgcggcaaacgcggctgggtcgacttcggaacccatcgcggcatagacggcaacggtgtgcggcgccgcggcatccaagcggcccagcagctcaaccagccgcgcatagatatcagcagacttcgccgcccgtacatccaaatcgagatcgtcgcgccgagcaatcattgcccgccgcaactcagccttgtccatcccagcctcctctagcaaacctgccaaaaagggacaggtttattttggcgggttttatctgggcaaacgtcgaagccgccacaaaggcgccctgtgtggcggcttcgactcgacgttggcttcacagcgccgcagcgatcgcttcagtcacaaacttattgagtgactcacccttctttgctgctgccagcgctgcttgcttgtggagctcagagcccgttcttacgttgaacgagcccttaaaagcccgctcgggttccttgcccttctcggcgcaaaactcaaggtaatcgtcgacggcgtcgtggaagcattgctccacttcttcagccgtggagccttcaaatacgattgcgtccctaatgccggcgaccatacctgttagcacatgctgttcggcattgaactcgaccggggcgaaataacctttgtatgccaaaacgttactcatgactacctccgacatcttgcagaaagcgaacgatgtttcgaatggtccccgctgtcaattcgtcagatggatgaggcgcgtgcattacgaacatcctgccatctgatggcctgtagaagcgaacgcgcgatccggacgtcttgcctttgctgtccatttcaaagccatatgaagccataactttaagaaagtcagcaaatctatacgttgaaggacagctaagcagctgggcgatgagtttatcggatcgagtcatcccgcctcacattctgcaactatattctagttgcaatttcagttcgatgcaagcacctctactatagaacatgtgtgcgtatagaacaaatgttcgaactaccacgaagggcgcctgtgaactgcgcccttcgtggtagttttgcttgccgtgccttagcccagcaggtcgatgacgttgaagccggcgttgctcttggcgatgacgtcgcggccgccaaagacgcaggtgggtgactcggctgcgatgcgcgttacgtcggcgccgagcgagcgaagctcaccgggcgtggcggcgagcatctgggcgcggcgctcctcgcgcgcatgcggatcgagcccggccaggtaggtcgtgttgcggcgcttggtgagcgcgtacggcttcaccggcgcgtccatgccgctcacgcagctcacgataaagccctcaaaggcggcctcgtcgggatcaaagctgccgagccattcgcccgcgcgcgccacgcgctcaatcgaggggtcgattgccgggtcgcggtaggtgtagaacgccgcctgacgctcgccggccgcgcggaatccgcagccgtacgcgccgcccttaacgcggatctcgttccacagatagtcgtaggagagcgcgttggcggcaaccgcccaggcgcccgtcacgtcgatgcccaagcgacgcgggtcgcacgcgcttgccgcaaaacagatgtcgctggggatgacaaaggcctcgtggcggtcgcacggcgtcggcaccacgagcgcgttgcggccggcatcggcgccgtcgccagcgcccagctccaggtcgcccgcggcggcccagtatgcgttaaagtcctcgtcgctgccggtaaagctcgccaggcagccatcggccacaaagatgcggcctgccagctcggcaagcttggtacgcaacccgttcacgcgctcgtcaaagtggtcgagcaggtcgcgcaggaacagatagaagtccacgcccgaaagctgctcgcgcaccacggccgaaggcgagctgtagctcatcgcgcgaccgagcgccgccgagtggccgttgttgataaagccctgctcaagcccaatgcgaatctgtgtgagcacgtcgcgcacgcggtcggcgtcggcatctgccaaaagcgtgctcgaccatacctcgcgcggcagactcgccagcgcatcgatcttctcggacagggcgccggcgctcaccagcaggtaggggcgcacgccgtccacttcgggctgcgtcatgacctcggtcgtaaagctcaaaaagccgagcttgccagcgagcaagttgtcgagttcctcggccgagtgctcgcgcgtgggcagctgcttaagcaggcggcagagcagtgtcacatagggcaggtcctcaaacgcgacgcagttcaggtcgaaatactgcatggcgtaggccagacggttggtggggatgccgtggcgcaggcaggggatgggcacggtcgtgtccacgatcagtggcggctcggggcgcgcctcgccaatgtcggacacgcgcaggcgcggcagcgtggccttggcctcgggtgtgtcttccgcctcctgcgcggcacgcagcgcggccgtgcgctcgaccacgtcggtcagctcggcatcggtcatggcatcgcgcttggctgccagctcggcggcctcggcaccctccgaaccctcggcggcgtccaccggcaccagctcgaccagtgccatgtggtcgttttccagcaccagctcgcgcagcaggtcctcaaaatagctgccgtccagctcgctacgcagctcctcgtacaccgggccgtacttgagcgccagcgtcgcggcgtcgtcatcgtagagccaggtgctcagcgcgtcgcacgcaatggccacgccgtcggcgatgccatagtcacgctggcgcaggtcgtactcgttgctgctgatgatggcttccagacgctcgcgcggaactccgtgctcgcacaggtcgcggcaggcgtcctggaacacgcgacgcagctcgcgcgccacaccgggctgtgcgttttgcagcatgatgagctcgtagggctgcaggctctcggccgcggtgtagctcaccacgttgccgcccaggccggcggccagaatggccttcttaaccggcgcttcgttggagcccagcagcgcctcgaacaggatatccgccgcgatcgtgcgcttgcggtcgagcgcgctgcccagcacaaggcccaggcccaccagggcgttctcgggtgtggtggccatctcgatgcgcttgtactcgcaggtcacgggcgcctgcgcgtccaacggattgggcgccagcgtggacgggtcctcgccggcggcaacggcagcgtccatgcggcggctcgcggcactcggctgcgacagatagcgctcgtccaaaaaggccagtgcgcggtccacgtccaggtcgccgtagagcgtgatgtaggagttggagggattgtagtgtcgcgcgtgcgtgtccaggaactgctcgtaggtgagcgcgggaatcgcgcgcgggtcgccgccgctctcgtgcgcataggcggtgtcgggatagagcgcggcgttgacggcatcgtccagcacgctcatgggatcggacagcgcgcccttcatctcgttgaacaccacgccgttataacgcagcgtgccctcgtgcaggctcgcggcgctgctgtcgccgtcgccctccggcaggtccagttcgtagtgccagccctcctgctcaaaaatggtgggcttggtatagatggccgggttgaacaccgcgtccaggtacacgtccatcaggttgtacagatcctgctcgttggtggtggcaacggggtagatggtcttgtcggggtaggtcatggcgttgaggaacgtctgcatggagctcttgatcaggtcgacaaacggctccttgacgggaaacttggccgatccgcacagcaccgagtgctcaagaatatggaacacgccggtggaatcggccggcggcgtcttaaagccaatggcaaaggccttgttttcgtcgtcgcacgccaggtacagcagacgagcgcccgaggcagtgtgtcgcagcacgtaagcgtccgagtcgagctcgggcacggtctcgcggcgctcgacggcaaagccgtggcaggtagtgccgggcaccagcagtgcagcggctgcggcgcgcgggtcggttgaggtggtgggcatatgcagtctcctttgacgccccagcgggggcgaatcgagtcgaatcctcgagagtatacccatatggggccgcgaccctgcggcgaactggagacgatgccagcggattgggcgaagggctcgcgtgcccgccgcacgagcgtggaaaattggacactcgccaaacgagagtggatattcggacggacgagcgaggatttccggatacctatcgaacgagagtggatatttggacggaatttgccgcaaaagccccaaaaaccgtccaaatatccactctcgatatccgaccgtccgaaaatcctcgctcgtccatcactcgcgtatctctcgtccctcattcgtctctaatatgagagatgacaggaagatgagagaaaaatatgagagataactgagcagcaaagagacaggcaatcatggtattgtctcaataccaattgttctaccagcaaaaatatgtataaatgaagcaaatggtagacattccatctctcatctatctctctatctctaagccgagagatagagagatagatgagagataatttcgagagataactgagagacgagggaaatctatccgcggcattctccgcaggaccgagcgaaaggacgtgcagatgaacgaaaacgagctgaccggtctgcttgagtctttaaggcgtatgggctcggatgatcttaacgtcgaagtgaaggagagcgccacgacgctttcccgcgatgtgtgggaaacggtgagcgcattcgcgaacactgccggcggaatcatcgtgctcggagtgagtgagcgcgcaggttttgtcccggttgagaacttcgagaccgagaaagtgctcaaccaatttgtgtcaggcatgggtgatgcgggcggtcgaggaaagctggccaatccgcctaaatacacgatcgagcgagtggagcttcaggacgtcatcgttctcgtcattacgattgaggagctcgatccgtcgagcaagccctgctatgtcatagagcggggcgcccagggcggcagctacaagcgcatcgatgacaaagatgtgccgctttcatcgaccgaggtgctcgcattggcgtcatacggtcgagcgactccgagcgatcgggacgcggtggcgggtgcgggcgcggacaatctcgacgagacgctggtcgaccgtacgatagatcgggctttctcgttgacgccccgggcaatgcgcggcgcgccggacaaacaaacgaagctggagcgcctaaatatccttgattcccagggcaatgtcaccaaggctggactcctagttgtgggcacctaccctcagcagttctatcccaagctcttcattgacgtggctgtccatgcgggaactcagaagggcatggcggggtcgctgaggttcatggaccgcacaatctgtgagggaacgttgggcgagatgatctcggatgccgtcgcagccgtcgccaagaatttgcggcgaacctcgaccgtccaaggcgtctcgcgtgtcgactcgcttgagattcccgaggaggttctgcgcgaggcaatcgccaacgccgtaatccatcgagaatacggggatcggttctgtggacaatcgattgccgtcgacgtctttgatgatcgtgtcgaggtgacaaatcctggcggcctttacgggggaaagactcgcgagaacttgtttgacggcagctcccgatgccgtaacgcgacgcttgtgaagctcatgtcgattgtcccgctgccggatggcgcaggttcgccggctgagggcaatggctcgggcatcccgatgatgatcgatgccatgcgcgcgcatggtctggccgggcccctgttctgcccgggattcgatcggttcaaggtcgtactttaccgttcaaagatcgagccggtcgatcatggcgggggcttaattgtgacggcactcaaacactacggcgagctggggacgcgcgagctggcagagcacacagggctcacaatttcccaggttaggtcgcgcgtcaacgcgctcattgctcaaggcgagcttgagcccacggcgccggcgacgagccgcaaccgcaagtatcgactgtcggagcgcgtgggatagatgcgttagtggacgaggcgacccaataatcgaccctcgattggcgtccattaaggtaaagcggttgttgcccagtcgacggtgatgctaaagactcggcttacgccggcatggccccgaacccgtctatcaggaacagcctaagaaccagcttgatgacatttcccggtttgacttctgccgcgtcaaagacgtggcgctcggcgagctcgctgcagtatgcatagatgtcgcggataaggtccgcgcccgagagcgtaaacatgtagcctgcgtccgaaagcgcattgggcgcggcaggcaacttggccatgtggcagaacgtttgcaggtcgggcgccataacgttctggtagtcgaggtggccgttggcatcctgcgcggcaacctccaattggcgcacaaaatccagcgccgccgctaacacaaagctcggcgtaggcgcattgacgtcctgagtggtcgccacaagcctgcccgccgcctgcgtgacaagccaagcgacctcgcgctggcaacgcacagccttgcgcgtaaccggcttgatggacgaagaagaaacgcttcccttaggcggattcgaaacagccacaagaacctcccatgaacgacccggcccaacaagcccggatgaaacacgtgctacatcagtatacagggaagtggggtagcggggtacaagcgcgccagcggcaaaccgagagcatcaacgatgtgccgatcgcggaatgagatctcgtaataattgactctcggccatattattgaggggcatgactcgcgttcgtatggttgtaggtgctggcgatgaacgacattgaccttgctgttccgttgatggatggaccaagctatgaccgcgcctgcagtctcgtgccttccgaatacgttgaggcatgggagtggtttctgggtgaggaacagcgcggcggcgtttggaccagccttccgcaccacaccaaggaagatagtcctcagtatcagtaccgtttgagaattggctcggacttctttcccgtaacgcgggattcagggatcttctggccgggccaggatcgggtgaagcaagatcccaataagatctttgcgctttcggtccataactctaaaaagagcttctacaccgatgtgcctccgctctatttggatgacggtacgtgggtcattaagtattcggtccaagcgccaggagccgttggttctcgagaccagaattacaaccgtaaaatgctcaactgcatggaatgtggcgtcccagtcggagtcatatttgcaaccgaggtgggctataaggtgctcggccttgcgtttgttgagcggttcgagcccgaaaatggatggtttgttctgcacggtcctgttcataaaggcggaccggaccctcgttttgcgcccgacatgagttatctgaagcacatacccgtcgatattgagtttgccggacagggtgcgaccgacgacgaaaaggtccgctatgcgttaaggcgcgagcgattggggcagcaatggttccgcaagcagctcgttgccgcctatgatggccgttgcgcggtgtcggactgcggcgtcagtgaagctctggaggctgcacatatcgagaattactcgggacccaaatcgcaggttgccagcaacggtattctgcttcggcgcgatcttcattccctatttgatgctcacctgatttcgtttgagcctgtttgcggcgaatatcggctgtgcggatcgtacctgctggataagaccgactacgcttcctttgcgggtgcgacgctaaggcagccggatgagcgtcagtggcgacccgatacggtgtttcttgaggcccatcgcattgagttcgatcgctcggaaaagaagcgtgaaaaggcggggcttctgccgtattagcgtatttggctttggcattctttgacgatcgtgttgtttgatcggatcgcgtggcgatgcaatctcgcgcacgcccgccggtgcatgctcttcctgatttgtatagcgagaggggagcgtatatgagctggcgaggcgatattgcgatggggaagtacggaaaactgccgtgtgcccttatagacaacaatatgtttccgagcgtagaggttgattgcgcgtcgtttgtcgtcacctgcccttgctgcggctcgcaaataccgtgtctcgacattcggtttatcgatgcgcgcgacagactcagcgacgaagtgagaaaacggacaggcgttcatatgccggtgtatccggagaaatgccctgtttgtggcctcgatatcgtgtacgacgccggcgacgagggataggtgatgcggaggagttggctgtgagtgtcttttgcctctacaaataaatcccctcaccgagttgcttgtggaactcggcgtgatggtcgcgtgcccaggtaaagagcgcctggtcaaagtcggtacgcgtgaccgggacgccaaagacgccggcaacttcgacgcgtataaactccagtgccggcagcttgttgatggcagtgagggcaaacggggacgagggctcctcgaacagatagcggctgccttgcagcgcgtcgcaactggtgcacgtgttgccgagcgacggggctttggaggctcgcgcgcctacgggcttgtagccgcagcgcttatgaaggtagtcgcggatctcgcccggtacgcagccaagagcgggcacgatggcgagtgcgttggcgttggccgtgtcgatggcaatgtgcccggcttcgttgggcgcgtgcgcgatggcgatgctctcgtcgttatcggctcgatagggaatgccgaaggccgcgaccgaggtttctttgtgacacttccagcactcgtgcttgcccagtactagatatatatacggtgctgaggggtcggatcggtcaacaccgggcagccactcggcaaagggttcggggttgacgccactgggcacataccagatcttcttggtccggtcccatttggcgcccagcgccttggcttcttctttgtgtgaaaaggggacatcgagctcggtgcgcatggtggctccttggtgctgcaggtgtaagtggctcaaggataccgcagggcgcagacatcgcggcgttttgctgaggagttgcggcttggatgggttcgagacgcgttggcctcggcctcggtggctattgacgcggttttgtgcatgggcagggtggttgcttgggcggttggagcagccagcggatttggcgacataaaacaaaacagcccagaggacatagcctctgagctgcgaacatttggtgggcgttagaagatttgaacttctgacctcttccgtgtcagggaagcgctctccccctgagctaaacgcccgatcaaggatgcgcaagcgcgcaagggataatataacggagcctgaactcggtggcaagaacatttttaaaaatcgcttacattgtggaattcgggggctttgtcgtatccatttcaaaagagcctgctgccgcgatttggctgtcgcataatgcaaggccattgcggtatcgagctatggaaagacgcctgcggaattgtcctaccgataagcggacaagcctccagctggcgacttcgccgtggtaaggtaagccgaattgtttccagactgtttcgggggagtggaatgagcaaagagtgtgtcgagcaggtcgaaggcgcaggggcttcggtgccgatgaccgatatatcgaacattgatgtgcccgagggcaccgacgagctcagccgtagcacccgccgcgcctggcgcgggcgtctgaacagcgcttcgacgcgcaagatgatcacgggcgtcttggctacgctggtgggcggttcgttttggggcttctcgggcaccagcgcgagttttctgttcgatacctaccacgtcgataccttgtggcttatgagcgtgcgtcagattctcgccggtctactctttatggccgtggttgttacgcgcgaccgcgagcgcctgattaagctctggaccacacccgccgattgcaagcagctgctgctctttaccgcctttggcctgctgttcaaccagttttgctatctttcggccgtgcgcctgaccaatgccggaaccgcgacggtgctccagtgcctgcagctgatcatcatcatgggctacacctgcgtggtcgatcgccgcaggccgcgcgttcgcgaggcgatcggcattggtctggccctcggcggtacttttttaatcaccaccggcggcgaccccaccagcctgaatatctcgccgcttggcctggcagcaggtcttatgtgtgcggtcagcgccgcgtgtatggcggtgattcccgccaagatcctgcccgaatacggcagccccatcgtcacgggctcggcaatgctcacggcgggcgtggtctcgtgcgtcttcgtgcagccttgggcgcatatgccggcgctcgacgccgccggcgtcgaggcgcttgcggtgttcgtggttatcggctcgttttttgcttacatgctctatatgcagggcgttaaggacatcggctcggtgcgtgcgagcctcatcggaactgtggagccggtttcggcgaccatcaccagcgccgttatgctgggcacggtgtttttgccgaccgaccttatcggctttgccatgatcatcgtgatgatgttcctcacggtgtagctggcgccgacgccaagacggaaaaggtgttgtgccgcattttcgccaattgatgtccgtgtctggagtttagctgtcgatgctcaaaatgccataaactagtaacgttatggacattttcattgcgactcaattgcgaggatttctttatggctggtaatcactttaagggcagcgatagcggccgtcctgcagttccgccgcgtccgaacggggctggtaaggccggcacgccgggcggcgctggacagggcagttccggtaagcgcgtgtccccgggcgagacggcgatgtttaccgctctgtacgagcagtctcaaaaggcaaaaaagaccggccgtgcaaaagggaatgtctttgcgggcggtgcaacctccgcgtcgcagccgagcggggctccttcggtgcctgcgaacaacgcaggtgctgccaacgccgcgaatgctgccggcaacgttaatgccggcaaggccgccaacaatactccccctgccggtggcgcggggcttacgggtaaccttggcacgatttacaccggcgcctccgagactggcacgttcgcccgcctggatgatagcggtgccgagtttgcgggctcgggttccaaggaagattattacgattttggcttgaactacggtagcgatgcttcgtcgagttcgatctctgacggtctggtccgtcatcgccatcgcaagggcgagcgcaaaaagcgtcacaccggcgccattattgccgctgtagtcgcagtgcttctcgttgtgcttggcacaggcggctttatgctgcttaactcggcaaagaccgtaaagagcgaagcgaaggaggctgtcgagatcgtcggtggccttaagggcaaggtcacgtcgggcgatttttcgacgctgcctgacgacgcgaagaagatcgatgagctctgtaacagcatgaaggcggagacctcgagcccgctgtgggcggcggcttcgtttatcccggtgtatggcagcgatatcaatgcggcccgcaccatgattgacgccctgtccgatgtctcgagcaatgcgctggttcccatggccgataacctttcgcaggctacgcccggcaagctgttccaggacggcatgattaacgtgtccgcgctgcaggcggtcgccgattcgctttccagcagctcgaaggtgttcaagagcgccaacgagaaggtccagggcattggcgatactcatatttcccaggtgaccgagctggtcgataaggccaaggacggctttgccaccctcaacggtgcggttgacgcggcggagaaggtcgcccccgtccttccccagatgctcggcgccaacggccagacgcgcaactaccttatgtacgccatgaacaacgtcgagattcgtgcttgcggcggctttggcggttcgcagggcctgatttcggtcactgacggccagatgtcgattggcgagtttgttccccgcattggactcagcgaggaagaggcagtcgagagcgtcgacgaagaggatgaggcgctgttcggcaaccacagtaacctgtacaactcgggcaatacctattcgcctgattggccccgcaactcgcagcgtgtcgccgcgctgtggaagtcccagtatggacaggacgttgatggcgtcatcggtatcgacccggtgttcctgcagtatctgctgggcctggtcggtaatgtctcgctgcccgacggaacggttgtcgacggcaccaacgccgcaaaggttctcatgcacgatgtgtactggaactatccggtcgaggagtctgacggcatctttgcatccgtcgccagcgctgccttcgacaagatccttggcggtatcggcgatgtcgatgttacgaagcttgtcagcgccgttgagcgcggtgccgaagagggccgcctgatcgcgtggatgagaaacgatgatgagcagaatgccatcaaagagacgggcattgacgcttcgctgcccgatccggatgacccgagtgccgatcccgttgccggcgtttactttaacaacctgagcttctccaagctcgactggtacctgaacgccgatacgcagattggccagggcatcaagaacggtgacggcacgtgctcctatcgcatcaccgttaccctgacgaacatcatgacgcaggaggaggctggcaagctgcccgactacgttgcggcgagcgcacccgatgccgcgcgtgacgacgagcgtctgaatgtctcgttgtttgccccgacgggcggcaacattactgatctgaccgtcgagggcacccagtttggtcttggcgccgctacgtggcatggaatccccttctattcgggcaccgttgacctgcatgctggcgagacgacgacgatcacgtatacgctgaccacgtcggccgaggcgggggacaagccgcttacgctgcgtcagactcctacatgccaggcggctcgcgacagcgcgtcggcgtagggtttttctggtagcgcagataatcgagtaccattttggggcggacaggcaatctgttcgcccctattttgtaaggagagcgcatgaagtactttggcaccgacggctttcgcggtgaggccaacgttgggctgacggtagagcacgcttataagattggccgttttgtgggctggtattacggcgtcaaccgcagtgctaaggcgcgcgtgatcgtgggcaaggacacgcgtcgctcgagttacatgttcgaggcggcgctggtgagcggcctggtcgcgagcggtgcggacgcctatatgctgcacgtgatccccacgccgggcgtagcgcaccagaccgtggaaggctgcttcgattgcggcatcatgatcagcgcgagccacaacccgttttgcgataacggcattaagctcgtcaacagcgacggctttaagatggacgaggacgtactggagctcatcgaggactacatcgatggcaagagcgaggtgccgctggccacgggcaaccacatcggtgccacggtggactacatgcagggccgcaaccgctacattgcttcgctcattgcaagtgcgaacttttcgctgcagggcgtcaagatcggtatcgactgcgccaacggctcggcttcctcggtggccaagccggtgttcggcgcgctgggcgccgacgtgcgcgtgatcaacgccgcgcccgatggctttaacatcaacgtcgactgcggctccacgcatatggagcgtctgcagcgccatgtggtggagcagggcctggacgtgggttttgcctacgatggcgatgccgaccgctgcctggccgtggatgagcgcggtcgcgtggtagacggcgaccagatcctgtacgtgtgcggcgtgtatctgaacaagcacggtcgcctttcgggcggtaccgtggtgccgacgattgccagcaactttggcctgatcaagtcgttggagcttgccggcctgagcgccgtgaccagcggcgtgggcgaccgtcacgtgtatgccaagatgcgcgaggggggctacagcctgggcggcgagcagacgggccatacgatctttggcgatatcgagcgcacgggcgacggcattatgacctcgctgcgcgtgatggaagtgattcgtgccgagcgcgagacgctctcgcagctcacggctccgtgcaagctgctgccgcaggcgcaggtggccgtgcgcgtggcggacaaggacgccgcgctcgagaacatgggcgtgcagaacgccatcgccgaggccgaggttgcgctggcaggcgagggccgcgtgctcgtgcgcaagagcggaaccgagtcggttatccgcgtgctggccgaggcgcccgaccaagcatccgccgatgccgccatgaagcgcatcgccgccgcgctggaagctctgtaaggtagtcattggggacgttcttaaacaactaggtggaaaggggacgccgcggattggttccgcggcgtcccctttgcgttgacgtgtcggttatgccttacagctcgtagagcgtggtgaacttgtcctgcaggtagctgcagtagtagcgggcatcgaacgccatgccgcacgcgcccttgatgagctccggcgcgtccttggcgcggccccactgccaaatgtgctcgcccagccaggcgcggacgggtgtcaggtcgccgctcgcacaggcgccgttgaggtcgacaccgtcgcggcacatggccggcacaaacatggcgtcgtaggcgctgcccagcgcataggtggggaagtagccaaacgagccgccgctccagtgcgtatcctgtaggcagccgtgcgtgtcgtcgggaacgggaatgcccaggtactcatccatgaagcggttccaaagcgcagggatatccttggccgtggcctcgccggcaaacagcatgcgctcgatctcgtagcgcaccataacgtgcagcggataggtgagctcgtcggcctcggtgcggatcagcgaaggctgcgcgatgttcacggcgtggtagagcgtgtcctcgtcgacgtcgccgtagacctcgggtgcgtggcggcgcagcacctcgagcagcggtcccataaaggcgcggctgcgacctacggtgttctcgaaaaagcggctctggctctcgtggatgcccatggaggtgccgccctcaagacaggtgcgcgcataggcgggattgacgcccagctcgtacatggcgtgtcccgcttcgtggatgatgctgtagacgttggagatgcaatcgtcctcgtagatgtgtgtcgcgatgcgcgcgtcacccacggcaaagccctcgctaaacgggtgctcggtaaaggcaagcgtggtgtcgttcaggttcaggccgacgagcttcataaggtcgaagctcatggcgcgctgggcggcctcgggcacgcgggcgtgcaaaaagtcggcagcgggctgctggccgcgctcgccgatggcgtgcacgagtggcacgaccgttgccttgacctcgtcacaaaacgcatcgaagctcttggcggaaagaccgcgctcgtactggttgagccaaacgtcgtatgggtcgcgcttggggtccataagctcggcctgatgcttgagctggcccacaatcttgtccacatagggctcaaagcttgcccagtcattggccgtcttggccttgtgccacacggcgtcggccttgcaggtgagcctggtccaggcctcggcctcctcggtgggaatgacgctcgcttcgcgctggtcgcggccgagcacgcgaatctcgtcgagcagctgcgggtcgtcgatcttttcgcccgcgaccgtctcgcgcgcgagagagcgcacgagctcaacggactttttgctggtcaggagcttgtgatgttcgccggcaagggtgcccatagcatcggcgcgggccgcggcgccgttggcgggggcaatcgtcgcgccatcgaactcggcaatcttgagcaggtactcgcgggtccacagtttgccttcgagcttgcggagcttcttgatgcccttgcccgccttggcgctcttagaggccttggccacggcggccttggccttcttatcgagtttctttcccatacctatatccttgatctcgcagaccggacgccacgggtaggcgtgcggccagtttgcacagctacccgtcttgtacccagtgcgaacaaaacggaacgcggcgatatgctcgcagaatgtgttatcctatagcccaatgcgttgacggagagggtttgcccgccgcgtcgccggcaagagagggaaggtcatgggctgcaagccttcctgcggtggcaagggccaagcgttcactcccgagcagcgacctcaacgggcgcgcggccagcggcggcgaagccccagtagggaagccgtgagcctcgcgacaaggggcgcagagtgggcgcggcgggccagacatccgccgggtcaaacaaggtggtaccgcggaattcaaccgtccttgggcaatgcacatgcccgagggcggttttttgttaccgaaccgggccgcgttttcgcagcgccaagcggcatcggtcgtcccggcaggcgaatgcgcgagagacgaaagggaagacatgagtctgattgatgatctggtcaaactcgaggaagaggccaaggagctcgtcgcaggcgccgacgacgccgccaagctcgaggctgcgcgcgttgagctgctcggccgcaagggtcgtattaccggcctgatgcgtatgatgggcaagctcgcccccgaggatcgtcccgtgatgggcaagcgcgccaacgagatgcgccagctgatcgagggcatgctcgacgagcgcaccaccgagatgaaggccgccgccctcaagcacgcacttgagcgcgaggccgtcgatatcacgctgccgggcatccgtccgcagatcggtcaccagcacctgatcaagcagatcatcgaggaggccgaggacatcttctgcggcatcggctacaccgtcgagtccggtcccatggtcgaaacctcctactacaacttcaccgcgctcaacgcccccatggatcacccgagccgctcggcccgcgacaccttctacgtggtcgacaacaaccccggcagcgtcgcacaccccgaggctcacgcccacggcgagtccgacgtgctgctgcgcacccagacctcgggcgtgcagatccacaccatggagtcgcagaagccgcccatctacatgatctgcccgggcaccgtctatcgtcccgacacggccgacgcctgccacctgccgcagttcaaccagatcgagggcctggtcgtcgacgagggtatcacctttggcgatcttaagggcacgctcgactactttgttaagtgcatgtttggcgaggatcgcaagacgcgctatcgcccgcacttcttccccttcaccgagccttcctgcgaggtggacgtgagctgccacgtgtgcggcggcaagggctgcaacttctgcaagcacagcggctggatcgagatcctgggctgcggcatggtcgaccccaacgtcctgatcaactgcggcatcgaccccgagaagtacaccggcttcgcctttggtattggcgccgagcgcgtcgcggcactgcgctacgacctgcccgacctgcgcacgttgatgactggtgacatgaggttcttgaaccagttctagaacgctttcttcttagttgcagtttccggctcaaagccgcatttatgaaaggagaccagttagatgcgcgtttcttacgactggctcaagaccatgatcgatattccggaggatcccaagaccctttcggacgaatatatccgtaccggcaccgaggtcgaggcgatcgacaccgtgggcgagtccttcgaccacgtggtgaccgccaaggtgctcaccaagaccccgcaccccgatagcgaccacatgtatgtgtgctcggtcgacgtgggtgacaagaacctcgacgccgacggcaaccccgctccgctgcagatcgtctgcggcgcgcagaacttcgaggccggcgaccacatcgtcgcggccatgattggcgccgtgcttcccggcgacgtcaagatcaagaagagcaagcttcgcggcgtcgtgtccatgggcatgaactgctccgcgcgcgagctcggcttgggcggcgaccactccggcatcatgatcctgcccgaggatacgccctgcggcatgccgtttgccgagtacgtgggctcgagtgataccgtgctcgactgcgagattacgcccaaccgccccgactgcctgtccatgatcggcatggcccgcgagaccggcgccatcttcgaccgcgatttccacgttgagctgcccgccattaaggccgaggccggccgcgcgaccgacgacgagctttccgtcgagatcgctgacgagggcctgtgcgaccgctacgttgcccgcatcgtgcgcaacgtcaaggtcggcccgtcgcccgactggatggtcaagcgcctcaacgccctgggcgtgcgtccgcacaacaacatcgtcgacatcaccaactatgtgatgatgctcaccggtcagccgctgcacgcctttgacctggacacctttgccgagcgcgacggtcatcgccgcgtggtggttcgcgccgcccagcaggacgagaagttcacgacgctcgacggcgaggagcgcacgctcgacgccggcatgggccttatcaccgacggcgagcgccccgtggcgttggccggcgttatgggcggcatggattccgagatcgaggacgacaccgtcgacgtgatggtcgagagtgcttgcttcaacgccggtcgcacctcgcacaccagccgcgatctgtcgctgatctccgatgcctccatccgttttgagcgccaggtcgatgagaccggctgcgtggatgtcgccaacgttacctgcgcgctgatcgaggagatcgccggcggcgaggtcgctcccggctacgtcgacgtgttccccgcgcccaagaccatcgacagcatcaagctgcgcctggcccgcgtgcacgccatttgcggtgccgacatcgagcccgagtttatcgagcgttcgctcactcgcctgggctgcaccgtcgagcgcgacggcgaggactttatggttaccccgccgagcttccgtcccgacctgccgcgcgagatcgatctgatcgaggaggtcctgcgcctatggggcatgggccgtgtgacggcgaccatcccggctgccaagaaccatattggcggcctgacccgcgagcagaaactcacccgtaaggtcggcgagatcctgcgcgcctgcggcctcaacgagaccacgactttcggctttgccgccccgggcgaccttgagaagatcggtatgtccaccgagggccgtggctgccccgtggtgctcatgaacccgctggtggccgagcagaccgagatgcgccgctcgctgctgccgggtctgctgcagtctgtggcctacaacgaggcccacggcacgcccaacgtgcacctgtacgaggtcggcagcctgttccacggccgcgagaacgctagcctgcccaaggagaccaagtccgtggcgggtgtgctctcgggccagtggagtgagcagtcctggaacatgaagtatcgcaagctgcgcttcttctttggtaagggcattgtcgaggagttgctcgctcagctgcgcatcgagaaggtgcgcttccgtcccgccgagggcgagagctatgccttcctgcaaccgggtcgtgctgccgaggtactctcgggcggtaccgtgctgggctgggtcggcgagattcaccccgaggcgcgcgaggcctgcggcatagatgaggtcgtcgttgcctttgagctcgatctggacaagctgatcaagggtgcccgcaaccaggagaactaccgtgagttctcgcagtacccggctgttgagcacgaccttgcaatcgtggtcgacaactccgtgacctgcgaggacctcgagcgccgtattaccagtgccggcggcaagctgctcgagggcgtgcgcctgttcgatgtctaccgcgatccggtccgcattggcaagggcaagaagtccatggcctttgcgcttacgtatcgctccgacgatcacacgctcaccagcgaagaggtcgagaaggcgcaccagaagatcgtcaccaaggtgtgcaagggcgtaaacggcgaggtccgcggctaagatcgcttgcgtctgtgacgaatgtattgcaaaacggcgcactgctttgttggcagtgcgccgtttgctatgatagccggcggcgtgttacgaatctatcaatacgtaacactatcaaggtgattcaaacggtgctgcgattgcgtgccgacaatcgggaggcatacatgcacattccagataattatctgtccccgcagaccgatgccgtcatggcggtggcgatggtgcccgtttgggttcactgcatcaagaaggtgcgcgccacgctcgatcgcgagcacatggcttttctgggcatctgcgccgcgttctcctttttgctcatgatgttcaacgtgccgctgcccggcggcaccacgggtcacgccgtcggcggtgcgctcatcgcactgctgctgggtcccgaggccgctgccatcgcggtttcggtcgcgctggcgctgcaagcgctgctgtttggcgacggcggcatcctgtcctttggcgctaactgctttaacatggccttcgtgttgccgtttgccgcagccatcgtgttccgcgcgcttaacagccgtttgcacgacaagagctggggcacctcggtttcggccatcgtaagcggctgggtcggcctgtgcctggcggccctgtgcgcagcaatcgagtttggtattcagccgatgcttttcacgaatgcttcgggcgctccgctgtactgccccttcccgctgtccattgccattccggccatgatgatcccgcatatgttggtagccggcgtggtcgagggcgtggcgactgccgcgatctacggctttatcaagaagacggcgccgagcgttatcgtcggccccgaagccgccgatggacagcttgctgccgagggcgctgctgcaaagaagacctcgctggtccccacgctcatcttggttgccgtgcttgtcgtggccacgccgctgggcctgctggccacgggtgacgcctggggtgagtgggacgccgagggcgccgcgaccgccgttcaggaggctggcgacgacagcctgcaggcttcggtcggtctcgacaccccgacctttgccgacgctctgcctacgggtgattacctgcaggcctattccgaggagcagggtctcggctttgccggtcaggctgccatgtatatcttgtccggcgtgattggcgtggcggtgctcaccatcgcattccgtctgatctcgctgacggtcaaggaaagcggagcccatggcgatggtcgagctgcctagctggcttgcggccgaggagcgatacgagcccacgggcgctcgtcatcgcgtgatgcaaaagaacgtcctgcacctggcgagcctgcttgagcgggttcgcctgggtggaggcgcgcacgagggcgggtcgatggtcgaccgcgccctttcttgcgtttcggctccggtgcgcctggtggggatattcgtttgcgtcctgtgcgtgtgcctgacacaaagcccgctgtacctcatgttgatggcggccattgcgctggtgctcgttgccgtgcgtcccatacgcgggctgcgcgcgacctttgtgccggcgcttggcgccgcggggctcgcagtggttttggcgctgcctgccctgctgctgggtgcttccgctacgggcgccatgctcaagattgcgctcaagaccttcattaatgtgtcgctggtgctgggcgcttcgtggaccctcacgtggagccgcatgtcggcggcgctcaagatgctgcatctacccgacgaagttatctttacgtttgatatggcgctcaagcacatcgaggtgctgggtcgtacggcgcacgatctgtgcgaatcggtcatgctgcgcagcgttggccgtgcgcccgagggattttcgcgtaccgattcgatcgcgggtatcatgggcatgacctttatcaaggcgatgaaatgcagccgcgcgatggacgaggctatgctttgccgcggctttgccggtgcgtatccggctcccgcgcgcgccaggtttggctggcgcgatgcggcctatgcggccggcgtggcgctgctgacagtgttgtgcgccgtgctgtaggcgctgctggttccgactggggatgcaaatggggaagggcgacgttttgacgatcgatatgaatagtgcggcgggcacgaacggtgtgggcggcgccgaggtcgttccgctcatcgagctgcgcgacgtggtgttctcctatgcggggcatacggttgtcgatggcgtgtcgctgcaggtcgatcgtggtgaactcgttgccctgctcggtcccaacggctgcggcaagacgacgattatgcgtcttattaacggccttgaactcgcggacgcaggggcatacctgtttgacgggcacgtggtcgatgcggcgtatctgaaggattctgctgctgctcagaagttccaccagcgcgtgggcttcgtgttccaaaacgccgatgcccagctgttctgcgccacggtggacgaggaagttgcttttggtcccgcgcagatggggctgccggcagacgagctcgagcgccgcgtgcgcgatgccatggggctgttccaggttgccgaccttgccgacgcctctccctatcagctctcgggcgggcaaaagaagcgtgtggcgctggcggcagttgtatcgatgaaccccgatatcctagtgctcgatgagcccaccaatgggctcgacgaggattcatgcgacatcgtggtcaacttcttgctggcctacgtcgcggcgggtaagacggtcttgatgagcacgcatcaccaggatttggtgcgacgcctgggtgcccgtgcaatctatatcgatcgatatcaccatgtggtcgaggcgccttcgccgtcgtatggaaccgaaagcggtactacggactagttgctgcgtagagcgtgcgtagccgcccgcgcggctttgccgtgatggtatagttatccaggttttttatgggggtggctatgccaagttggaacattcatatcgctcagacggagcgtttgctggagcgcaccggtgcacttgccaatagcgtgcgcgaccgcaatgcctttttgtttggctgcgtggttccggatatcttcgtgggctatatggtccctggcatcgccgatcccatcccgtaccgcattacgcactttgcaaagcccgagcctatccctaagcctcgtgagcatgagttctgggatacctatgtggcaccgttgcttaaaagttcgcccaccggtgcgccagccgcggctacctcgattgtcgaggagcgcgagcgactgaatcgcgtgcattatccccaacgttacaaggacgccgagccggtcgccggtcccggtgctagcgagctttcgctcgcgcccgatgacgtggcgcagtcgctgctcgatctgacgctgggcgtttggtcgcatctggtggccgataccgtatggaatacgcgtgtgaatcagtacctggaggcgcacggcggcaagccgtgcgaggaattccgcattaaaaagcaaggcgactttgactggtttggcaagacactcggcatcgtttcgataccgcgcgcgaccgatcgcctgtatactgcggcgacccgttttggtcagtatcccatccataaggagtatgtgctcaagaccatcggcgttatgcacgagattgtacgcgaaaaccccggcgagtccgatcatccgccgtatcgcctgctaaccgaggagtttttcgatacaacgtttaccgaggtcatcgagctaaccgaggcgggatttgcggctcgcgtcgaatcgcccgatatgcctgcgcttcccctgattgctagctgctagctggccggcttggcggtgaatagctcaacccaattgacaagtagctcttgccgcagggtgacttcggcggcgcgctcctgtttggtctttggggtgtaggaaagtccagcctttttatggatgagctcggctatgtggtcgaagctcttcttatccttaatctggccaaaggtaatttggatgacgtcgtagcccatgcttgtgagcgcggtggcgcgctcggcatcggagaggctcgcggcttcgctgtcgtgggcggagcggccttggcattcaaggatgacacccatgctgtcggtggcgctttcgatgaggatatcggcgtagcagcaggttttgtcatacagcgagcgcgcggcgtcgctgagtgggatgcgcacgttgtttgcgatgttgatgcccatgccgccctcgtcgcgggggagcgagataagcatggaggtctgtacttcgaagggcgaggcggtctgtcctgtcatgcgttcggcggcccagcggagctgcttaacaccgcgcaggcctgcggcctgcttggcgaacgcggcgatatccgctgcggaaagaagcggcgtgcgcttccacaggttggtatccttgccgttgacgtcgataacccgctcccagccgcagttgggtggaatgagcttaagcgaaatagcttcatcaagttgccgttgcgctcgtttgcagggtgtatacacagcaaacgagctgcacatctcataacacgccataagcagctggttgcgtgagacctgcgtagcaaggttgagcagtgtgaactcgggcgatgtgacatcaaacccatgctcggtttgcctaaacgacccgggaggcggctcttgggtcaggaggtgcgatttaaacaggcttcgcgacccggattgtgcccgagtgaatacaatcctgtgaagcggtgcgtgaagcaggtcttttacaactgcatgacttccgaggccgcaacatctgcgatccatattgccaaggctaatggcagggtaaaggcctaatatctgtggcgggatacggtgatagtaaaaagcggattgaccgcatagcgtcaggtccatgatgtcctcctggtcgaaatatgcttttggaccgtgcgatgccagtgtcaattcggaagtatgcggcaaaatctaaaccttgtgagcagacctggcttttgaggctagtttatcaggcattttgttgcgaaaaaacggggtgtgctcggaggtatcagaatttgccgcatacttccgaaaagcaggtcaatccggctcttgctaaaacgatttagcagcgtcggttaaggtgtgggtttgccaccgggcgaacacttttagcgcttgggactttattcattgggtctcgaagggtggatttcgcgcttttggtaaagaaatgagtgtgtgttttgccgtgcgccggcattggcacagaaaaagggcccggaaggcttcgccttccgggccctttgcgatgcaagtgtgcttgcaagtacgacttagcgcacctgagcgacgtaagcgacgttggtcgaggagaccttgtcctcgagctggacgctcatgcggggatcgccagcggtggcgacggtcaggtcgccggcctcgacgtagccgagctccttagcggtctcgatcgccttgacgatcgtgccgttgacggtgccctgggtaatctcggcctggtgcgggataacgccccagtacatgatcatctgctggacggcccactcgtggcgggagaacgcgcagatcggcatgttgggacggaagtgcgagatcaggcgagcagtacggccggtggtcgtcggcacggtgatgcacttggcgccaacggtggtggccatgttcacagcggacatacccacaacgttgttgacaacgcgggtgccgtgagcgtcagccggaacctcgagcggagcgtgagccgggaggtacttctcggtctcgagagcaatgctggcctgcatcttgacggcctcgaccgggtacttaccggcagcggactcgccggacagcataacggcgtcggtgccgtcgtaaatggcgttagcaacgtcggcaacctcggcgcgcgtcgggcgcgggttctgctgcatggagtcgagcatctgcgtagcggtgataacgggcttgtaggccgcgttgcacttggcgatgatctccttctggatgtgcggaacgagctcgggcttgatctcgatgcccaggtcgccacgggcgaccatgatgccgtcggaagcctcgaggatctcgtcgaagttctcgacgcccagggcgcactcgatcttcgggaagatcgtcacgtgctcgccgccgttctcgcggcaaagctcgcggatgccgcggacggactcgccgtcgcggatgaaggaagcggcgatgtagtcgatgttctcggtcaggccaaagaggatgtcctgacgatcgcgctcggtgatggcgggcagcgagatgttgacgttgggcatgttgacgcccttgcgctcgccgatcaggccgtcgttcttaacgacgcaggtcatgtcctggccgtcgacggactcgacctcgagggcaaccaggccgtcatcgatcaggatgagggagcccttctcgacctcggagggcagagccaggtagtcgagggagatgtgctcagaggtgccgtggaaatcctcggtcgtgggctgagcggtgacgacgatcttgtcgccggtcttgacggcaaccttcttgccgtcgaccagaaggccggtgcggacctcggggcccttggtgtcgagcaggatgccgacgggcataccgagctccttggaaatacgacggacgcgctcgatgcgaccgtggtgctcgtcgtaggagccgtgcgagaagttaaaacgggcgacgttcatgcccgccttgatcatctcgcggatggtctcgtcgctatcgcaggcgggacccatggtgcatacaatcttggtgcgcttgtacattcagacctccatctgacatcgtcttgcgctgatagataaaccataagaaataaaaccgagttgattataacgaaatggcgtccgaataccccaaaaaatcgaccgtatgccgaattagaagttcattttttgcggaaaaacggtatatgcaaaaactttaccaaccgttctaaccgctgctatctgggcgatatttcaatttgatgatgcgccgaagaaaaaacgttttatcagtattgagcatcacacggtctgcaccgttgcttatggaccatatttccaaatggattgttttggctagacgcgttgctttggggtaccatagctccactatcaactgccgctcagcacggcagccttgatgagcccttgcccttctcctgggaattatgatcgggcatcaatctgctgagtggcccgaatcccaggaggggactctatatgcaaaaggaatacctgtccgccgcggcggaggtgctcagcgaccaaggtgtcgatgagaacctcggcctgagcgacgacgaggcgtcgtcgcgcctcgctaagacaggccctaacaagctcgaggaagccgagaagacgccgctgtggaagcgcttctttgagcagatggccgaccccatggtcatcatgctgatcgttgccgccgtcatcagcgcgctcacgggcatggtcaagggcgaggcggactttgccgatgtcgccatcatcatgttcgtcgttatcgtcaactcggtgctgggcgtggtccaggaggctaaaagcgaggaggctctcgaggccctgcaggagatgagcgcggcgcagtccaaggtgctgcgcgacggcaagctcgtgcacctgccgagcgccgagctcgtgcccggtgacgtgatcatgctcgaggcgggcgactccgtcccggccgactgccgcgtgctcgagagcgccacgatgaagatcgaggaggccgcccttaccggcgagtccgtgcccgtcgagaagcatgccaacgtgatcgagctcgccgccggcaccgacgacgtgccgctcggcgaccgcaagaacatgtgctacatgggctccaccgtggtgtacggccgtggccgcgccgtcgtagtcggtaccggtatgaacaccgagatgggtaagatcgccggcgccctggccgaggccaaggaagagctcacgccgctgcaggtgaagcttgccgagctcagccgcatcctcactatcatggttatcgtcatctgcgtcgttatctttggcgtcgacatcatccgccacggcgtgggcaacgttctcaccgacccgaccgcgctgctcgatacctttatggtcgctgtctcgcttgccgtcgccgccatccctgagggtctggttgccgtcgtgactatcgtgctttcgctcggcgtgaccaaaatggccaagcgccaggcgattatccgcaagctctctgccgtcgagacccttggctgcacgcagaccatctgctccgacaagaccggtacccttacccaaaacaagatgaccgtcgtcaagcacgagctcgctgcgcctaaggagaagttcctggccggtatggcgctgtgctccgatgcccagtgggacgaggacctgggcgaggccgttggtgagccgactgagtgcgcgctcgtcaacgatgccggcaaggctggtcttactggcctgactgccgagcacccgcgcgtgggcgaggccccgttcgactcgggccgtaagatgatgtccgtggtcgtcgagaccctggacggcgagtatgagcagtacaccaagggcgcgcccgacgtggtgatcggcctgtgcacccatatctacgacggcgacagggtcgttccgctgaccgaggagcgtcgcgccgagctcgtggccgccaacaaggccatggccgacgaggccctgcgcgtgctggcgctggcaagccgcacctacaccgaggtcccgagcgactgcagccccgctgcgctcgagcacgacctggtcttctacggcctgtccggcatgattgaccctgtccgccccgaggtctccgacgccatccgcgaggcccacgacgccggtattcgcaccgtcatgatcacgggcgaccatatcgacaccgccgtggccattgccaagcagctgggaatcgtcaccgatcgcagccatgccattaccggtgccgacctcgaccgcatgagcgacgaggagctcgacgcgcacatcgaggactacggcgtgtacgcccgcgtccagcccgagcacaagacgcgcatcgtcgaggcctggaagtcgcgcgaccagatcgtcgccatgaccggcgacggcgtcaacgacgccccgtccatcaagcgcgccgacatcggcgtcggtatgggcatcaccggcaccgacgtcaccaagaacgttgccgacatggtgcttgccgacgacaacttcgccaccatcatcggtgcctgcgaagagggccgtcgcatctacgacaacatccgcaaggtcatccagttcctgctttcggccaaccttgccgaggtgttctcggtgtttatcgccacgctcatcggctttaccatcttccagccggtgcagctgctgtgggtgaacctggtcaccgactgcttccccgcgctcgcgctgggcatggaggacgccgagggcgacatcatgaagcgcaagccgcgcaacgccaaggacggtgtctttgccggtcacatgggcctggactgcgtggtccagggtctgattatcaccgtgctggtgctggcgagcttctttgtgggcgtgtactttgacatgggctacatccacatcgtcgatatgatcgccggcaatgccgacgaggaaggcgtgatgatggcgttcatcacgctcaacatggtcgagattttccactgcttcaatatgcgcagccgtcgtgcgtcactgttcaccatgaagaagcagaacaagtggctgtgggcttctgccgcgctggcactggtgctgacggtgatcgtgaccgtgcagccgacgcttgccgagatgttctttggccccgtgacgcttgagctcaagggcgttcttgccgcgctgggcctggccttcctgatcatcccgctgatggagatctacaaggcgatcatgcgcgcggtcgagaaggagtaggtcgaaaggccatccttcccaccggcccgaccgcctgcggggtttcttcttcgctggtcctcgcgcttcgcgctgcgggatcgctcagaagaaacccctcccggcgggcgggccttcggatgacctctcgggaccgtaagctgaggaaaagtttgtgagctggtcgggctttgcccggccagctctttttgatttaaaatacctgctcagttgtgatttatggtgctgggaggcgcttgtgggcaaggcgaaggctaaggcgaagaaaaagacgacgggggcgcgggctaagcgcgatcgtcgtcggaagctcgcgaccgaagcccccgcgtctgccgaggagctgctggcaaacgtgccgggacttgacgcgctgcaggatgttccggcgttcgatgacctgccggtcgatgaagctcagcaggcggcatttgacgacttttgcgcacataccgaggagcccgagcagatgcagcttggcgccgtggtgcgcttggatcgcgggtttccgctggtggcgactgccgacgacaccttccgcgccgagcatgccgtggggtttgccaagtcgcgcggcgaggacgaggtcctgctgcctgccgtgggcgaccgtgtggcggtgcgccgcgctcccgggcacgatatgggcgtgattgagtgcgtgctgccgcgccgtacgagctttgagcgttggcgcggccgtgcccgcggagagcgtcaggtgctctgctccaacgtggattgcgtgctaatcgtgcaggcgctcggtgccggtgaggtgctgctcgaccgcgtggcgcgctcgctggtgttggcgctcgactgcgatgccgaaccggtggtggtgctcaccaaagctgatcgctgcgatgccgaggagctcgagcgcgatctggaccgcgtgcgccgcctggtgggtccggacgtgcgcgtgatcgtgacgtcctctgccgaggggcgcggcctggacgaggttcgttcctgcgtgcctgccgggagctgcgccatgattctgggcgagtcgggtgccggcaagtcgacgctgctcaatgcgctgctgggccacgatacgttggcgactggcggtgtgcgcgaacgcgacgaccagggccgtcacactaccgtcgcgcgcgtgatggtggcactgccgggcgacgccggcgtgatcgccgatgccccgggcctgcgcagcttaccgctcgtgggtcacgagcggggtctggcgcgcgccttccccgagattgtcgaggcatcgcgcgcgtgccggtttggcgattgcacgcatacccatgagccgggttgtgccgttcgcgaggccgaggacgccgggcagatcgacagcctgcgtttggaaacgttccaaaacctggcgtcatccatgcgcgtgagtgctcaaatgctcgatcccgatgtccacctgtaattgatttttcctatgacagccgtcttccaactgttcgggagacggcttttttgctgcgaaaaagcctcgaaacatgcagtttgctgacgtgctgaccaaaaccttgccacgagcttgacgggctggttagtttttggtcagcgattggtttgacatcgaaaaccgagatcgcgattgcgccgctttgcactctgaccacccagacaatggtggtacgggcattcgcccggcactgccatgagaggagcggccgtgaacaagagcaagcgcatcgccatcagtctggtcgcgggcgtgctcgctgcgctgctctgcatggtttacggctcgtcgattcgctcgcaagccgaacaggtccaggctgagaccttggccaagtacggtggcgatcgcgccgaggtatgcgtcgcggcgcgcgatatcgatgtgggcgagaccctcgatgagaccaatgtcataacccaggaatggctgacgagtctgctgccgcgtgacgcggcgaccgagctgcgccaggtgcgcggcgacgtgacgacttcgcgtattcccaaaaacgccgtgatctgcaatgtctacaccaaggccgagagccacaagctcgaggtgcctaagggcaaggtcgccgtttcggtggcggtcgatgccgagcactcggtcggcggtgctacgggcgtgggcagctacgtggatgtgtatgtgcaaaaagacggcgtaaccgatcgactgtgcggcgcgtacgtgatcgataccagtgaggattccggtgccacgcgcgagggcaagatcgaatgggtgacgctggcggctgaccccgaagacgtcaaggaactgctgggagcctcgggcaagggaacggtcagcttgacgattcccgccacggcgcgcggcaaaaagagcggaggcgacgagtgatgaaggcgatctggcttgcgtgctgcgcgtgcggcgattacgggctgttgcagcgggaagtcgagggccgtgatacgggtgcacaggtgcttcgcgtgggtgacctggacgggctggtttccatggcgcgggcgtttccgtcgcgccgcggagctgccatcatcgcggcgtctctgtttgataccgaagatgtgcgcaagactgttgcgcgcctgacggccgaaggccgcgtgagtcgcgtggtcgtgttgatagaagcactcgatccgtcggatatcgaggggctgtttcgcgcaggggcgaccgaggtcatcgctgcgcacagtatatgcggcaacgggcgagcgggcgagggagcggttgattccgatcggcgcatgacgattgagcccgatgcttttgttgatagggaacccggggcgcctcgcgctacaagaggcccgcgtgttgatgattatggaaaagcggaagccgagcatggtcggcgcccccggaacccccttgtatacgatgacgctggaggaccggcgcagcatgctggcgactccccggctgtagatatgggatacgtgcgcggcgtgaatctggcggatgaactcgacgaagttgagggctttgccgggtgcggcgagttgtcgctgatgcagcatgagcagattgcgcagaacgagcctgcctcgcagaccgaacaagccgccatgccggcttggacgcagcgtgtagttgcggcgggggagacggggacgctgtcaccgacgcccgccccgccgcctccgatgccgccggcagacgctgccgcttcgccgcatcgagctccggtcatctgcgccatttcgggttcgggcggttgcggcaagtcgacgatcgttgccaccatggcacacacatcgtcgctgttgggcttgcgtgccgccgtgctcgacctggacctgatgtttggaaacctttacgacttgttaggcgtcgatgctccgcacgatatggcggcacttatcgagccgtcggcggcgggcacgctcaccgagccggatatcgtggccgcatcgatgcgcgtcgccccgggcgttacgctctggggtcccgtcgcggcgcccgagcaagctgagctcatggcacgtccggtggagctgctgctcgatgtcctgcgtcgcgaatccgacgtggtctttatcgatacctcggtcttttggggcgatgccgtggcggctgcggtggcggcgagcgaccgttgcctggtcgttggcgatgcggcggtgtcgtccgcgacatcggcgtcgcgcgtcattgaactggcaagtcgagtaggtgtgccgcgcacgcgcatgagcgccgtgttcaaccggttcggtgcgcgcggggcagacgaggacgtcgccatgcgctttgagattgcctgtgcgttgagctccaagattcatatcgccgatggcgggcaggatctcgccgcgctcatggcgtttggacgcgctgacgaggcagtggggcagaccagcgcttttgcgaccagcgtgcgcgaggctacgcgcgagatgctcgtggaactggggtgcgccgtcggcccttggagcgatatggtcgccgaccgtgcaacgcgtaccgagcgcccgcgtatccgccttccctggtcgcgcgagggtgatcagcgatgagtctgcaaacgaggattaaggctgccggcgctgcagcggcggcagcgcctgtagatgcggggcgtcgccgcgcggtgaaacgacgcaccaagcgcgccgtgatggaccgcatgggttacgacgaagtggcgcgtatcagcgcctatatcgacccggcacttgcccgctcggaattgcgtcccgcggtggaggcggcgctcaatgttgaggaaccgaccgatctcgcgacgcccgagcgcgagaccatcatcgacgagattttggatgacgtggtgggcttggggccgttgcagccgctcatcgaggacgacaccgttaccgagatcatgatcaacggctgccgctcggctttctttgaacgtggtggcgtcttgtaccccatcgagcatgcgtttgaggatgatgagcagatccgtgtgcttatcgaccgcatcatctcgccacttggccgccgtatcgacgaacgcagccccatcgtcaacgcccgcctcaaaacgggctatcgcgtcaacgcggtgattccgcctgtggcgattgacggaccgattctcaccatccgaaagttctcggaccgcatctgctcactggacgagcttgtggggctggggtcgctgccgctttggtatgcgcagctgctgtcgtgcgcggtgtcgctgcgacaggacctggcggttgcgggaggcacgggatctggtaagaccaccctgctcaacgcgttgtcatgcgagatttccaccggcgagcgcatcgtgacgatcgaggactctgccgagctcaagtttgcgcatcatccgcacgtggtgcgcctagaggcgcgcgaggcttcaattgagggtgagggtgcggtgacgattcgcgacctagtaactaatgccctgcgcatgcgccccgaccgcatcgtggtgggcgaggtgcgtggtgccgagtgctgcgacatgttgcaggccatgaacacgggccacgacgggtcgctcaccacacttcatgcgggttcagaacaggagaccgtggtgcgtctgacattgcttgcacgttatggcatcgatctgccgagcgagctcatcgaggagcagattgccatggcgctcgacggcatcgtgatgtccgagcgccacgccgatggcaggcgtttcgtctcctcgtattcgggggtgcgtcgcgccgcgtcgggcggcgtagagctcgagcgctatgtgactttcgatgccgccgagcgcacttggacgcttgaccgcgagccgccgtttatcgcagaaggcctgcggtcggggacgctcacacaagaggaggtggacgaatggaggtcgctgtgcccctcgtcgtagggggtttggcagggttttctgttgcgacggcgtgcggggcggaacctcgtgtgccgcaggtgccgccggcggagctggcgcgtcaggcgctcgagacggtggcagagaggctgccgcgtgagctggtggaaaacgatctgctgaaaaagatcgcccgttcgtggacatcgctggctccggcgcatcgccttggcctcgtgatcgaagatgcttcggggcgtttggcgtttctactgctatcgagcggtgtctgctgcgttttactaacgatggtgtcgttatcgcccctcgggtttgccttgggacttgttgctccgattgccgctggcgccgctcgggatggctttgagagccggcgcgagcaacacgatgcagaagaggcaatgcccgaggcgtttaccgcactttccatgtcgcttgcctcgggacattcgctggcccagggcatgcgctttgtgggcgctcatgcgcaagaaccggtgcataccgagtttttgcgggtggcggcggcgatcgattgcggtatctcggcgaccgacgcgctcgatgacttgctcgtgcgcatcgacgctcccggcctttcgcttgtgaccttggcgcttaaggtgtctcagcgcaccggtgctccgcttgccgacttactgtccgaggcgtcgagcatggtgggggagcgcattgagctcaagcgccgcctggatgtcaagacgtcgcaggctcgcatgtctgcgcatatggtcgcggcgatgccggcgggcatgtgcgcggtgttggcgctgctttcggcagattttcgtcgcggtcttgcgacgcctgccggcgtgggcgctgtggtgctgggtcttgccctcaatgccgttgccctggtggttatccgacgcattatgcgggtggagctatgagcgccccggttgcagttgcggcttgcctgtgcgccctgagtgtatttgtcgcgacgggtttggatcgggcggatgcacgcaagatcgcaggggcctgcaagcgcgaggcggtgctggtcgctgccgcgggtcgctcagtggtcgatgccctgaccgcgcgagtgaagggcgcggttggagtgggcggcccggcgcgagtgtcgctcggcgaagtgtccgagatgatcgatgttgtgcgcttgggtctttcggccggtctttcgtttgatgcggcgcttgagattttctgcgccaaccgccggtcagtgctggctcttcgccttgagcgggcctgcatggcgtggcaggtgggcgtgggcacgcgtgaggacgagttgttggccgccgcgcgcgacctggacgtgcgagcgctcgagacctttgccatcacggtggggcaggcgctcgccctgggtgccccacttgccgagacgctggccgctcaaagtcgcgagatccgtgcggctcatcgcgctgcggtcgagcgcgagatcgagcgtgcgcccgtcaagctgctgattcccaccggcacgctcatcttgccggcgttgcttctgtccatattgggcccgctgctgggagcaggcgggatgatgtagggaggaatacatgaacacgatgactgacgctgctggcaaggtccagggctgggcgttttgccgggcggcacatgttcgtcaacgcgccaaggagctactgcaggaggagagtgcacagggtaccaccgagtatgccatcttggtcggcgtgctcgtggtgatcgcgattatcgccatcgtcgcatttaagggcaaggttaaagagctatgggatgcgatcagcgagggcatcaacagcctgtagagggcgagcgccccatcggggtgctgctggtgtttgcttgcctgaccgtggcgatagcggcggtgctttgggggcttaacgccgcgcggcagcagcgtcctggggccgccttcgattcgggctcagattcggcggtggcgtctcaaaaagatgagatgcgagatgcggacgattcggatgtcgctgtcacggcgcaaacctttctgcggacgctcgacaagcggtctggcactgcgacggatttgcctgaggacaacgcgattgcggtccggcttgcatggtccgaggaccgaccgatgaccgaggcagcggcggatatgttacgcgcctaccgcgaggtgccaacgtcccagctcgccctgagcggctatctcgatattaagggcaacgtatggggcgccatcgtgcgcgatgggcgcggctgggtcgatatggtgacggttgccgcggatactggcgatgcttcgtgtcgtctgcgcgccgtgcgcttggtcccgcaaacaataagctcaaaggagggatcgtgaaatgcatggcgttctgcgtgaagaggttgcccaagcgactgtggaatacgccatcgtcacggtggcgctgttatcgatcgtgctggcgatcgcggggctttggcgtgctggcaccgatgggcgcttggcggcgctggttgagcgggcggcatcccatggcgttgcctcgacgtcggttatcgacgccgctgcgggtgctaaggacatcgcgttgtattgatatcgcgcgtgaggaccgggcgcagtctacggtcgaggccgcttttttgctgccgacgtttctgacgctcatccttctcgcactgcaaccggtgtgcctgctttatacgcgcgcggtcatggagtctgccgccgccgagaccgcgcggctcatgaccacgacgacggcggaggacgacgatcttaaggagttcacccgccgccggcttgccgcagtgcccaacgtttcgatctttcatgccggcgggccgttgtcgtgggatatcgagcttggccgggccggtgcgggtggcgtctcggccgtgtccgtttccggcaaggtcaagccgttgcctgtgatcggtgcgtttgcgcgggctatgggtggtaccgccgagggcggctacgttgagctcaaggtcgatgtctcgtatcaatcgcgtcccgaatggctggagggagattatgattcgtggattgctgcatgggattaagcgtttctggtctagatgcgttttgacgcgccgtccgagctgccatcgcaagcgaggcggctttatgggccgtgccggtgtcgacctgtttatcgaagacggtgcctacaccacgctttcttctgccgtggtcatcctagtggtgctcacgttgttgttttcgtcgaccgcggcgatatggagcatgtcgcgtgccggggatacccaggtggcggccgatagcggcgcgctggcgggtgccaacgtagtgtcgtcctatcacacggctgccacggtggttgatgcgagcatcttgagtctggggctggcggggtttgccacaatcgggacgggcctggtcgccatcctcatcccgggtgccgaaccagttgccggcaatatggtcgacaccgggattgagatcattaaaacgcgcaacaagtttgccaaaagcgcatcggaaggcttacagaaaatcgagacggctctgccgtatctgatcgccgcgcgtgccacgcaggcggtgtcggcgcaggataccgatagcgtgacctataccggtacggcgcttgccgtgcccaggacatccgagtcggacttcgctgcgctcaaagggtcagagatctcgaccgataccattaaagacacatcagatgatttagagcgtgcggccgaggagctgcggaaggcttctgaggacacggcgaaggctaaagagcgcgcttggctggcggattgtggcgggtcggacgagagttcgattggcaagtactcgtgtatgtgggagcgtgcgaaaagcctaacggatctctctggtgctcaaaatccacattacgcttcgagcgttacgtgggaaccgcaagtggcgctcgatcgcgcgaaggcctactatcgccagcgcctggcaaatgagaaaccgcttggcgagggtccggaaaaacaggcagattctgctgcacgaaaggtgttcttcgcttatgcgagcgaagaagtcgagcgggcatatataactgaaaaggacggcaaagtttccgcccacacccctttccttccgcgaaatccagatgaggcgcgggcgactgaactctataccgatgcgtgttggcccacgagtgaagtagataaagttacctatttgcattatgggactgactgtccaaattacaaaaaaggaaagccgggtgggctggcatccgtcgcagattttgacggtcacgaaacgtgtagcgaatgccatttcggtgtgtcgtctttagggtacgttgcgattgcaacgacttctgtcgaaaggggcttcgagtaccacttcgataagttcaaagaggccctggaagactacgtcgaatgccgcaacaaggagttcgagctcgagcgtcagaccgaggacgaggccgaccgtgcaggcaatgcgtttgaccaggccattaaagcgctttccggcgagcgcccgcgtatcgccccacctggacgcaacggcgtggtcgcatttgcagtttcgggtgatattaccagccccgatcaacttaactcctcgtttaacacggcagtcaggcttggcgatcgcggtgctatctctgccgcggtgctggcgcccgatgacgcgacggcgcaaaacaacgtgctttcgcgatttttctcgacattgaaggaacgctcgggcggcgttgccggcgtgctcgacggcgtcatggatgtttggggacggctgctcgtaggatacggtgatattcaaggttcggccgacgaacttatggacgagatgattaaaggcctaggagggggcagcggcgcgttgggctccatcgcatcgtggctcggcgataccgtttcggcgtccgtggcggcgctgggtttggaaccgtgcgacttgcgcctgcgaaagccggtgctgaccgattctgccaacgtcattaagagtccggggtctgacattgcgggtctctctcaagcgcaagacaaactgcgaagtattccgttgggcgtgaccgatcccaaggcgctttgcgaggcgttggaatatcaagtcgaacgcaccattagcggtacggtgttcacacttgcggagattcctctgcccggcggcggttccatcccgctcaccgtcgatgtcgccacgctggttggcgctctgggcggtgggtcgtaatgagtatccgcatgcgtctgcgcgaggagcgcgcccaagcgacggtggagatggcagtggttacgcccgttttgctggtgctggcactcatcgtgtacaacgtcatgatctttgccggcgctgtcgcgcgcttcgaccgcgtggtgcccgacatcgtgctagcgcatgccgtggcgtcggagggggagggcgacgaaagctctgccgatgcctcggcgacggtccagactcaaattctgaatgccatggaaggctatgacttgcagatcgaagtgtcgagcgagcaaggcgcgaaggcatcagatggtggcctgctctccctatccggtacgtttaggacctacacctgcaccatgcactatgagccgtggccgacttctctcagcatcgctggcgttccgctgggggcgccgacaacgttgtcgcacgagcgcgcggtgacggtcgatccatggcatccgggggtggtcatgtgaccgcggtctcgtcctacatcgcctacgcgcgggcactcaataggctgggttggacgccggccgagtttgtggtggcggagtcgtttgtcgtgcgcctgcgcggcatgctgggacggcgtccggttgccgccaacggcctgtcgctcgtcatggcgtttccacgctgctcttcggtccatacgtgttttatggcctatcccatcgacatcgccttcatcgatcgcgacggcaatatcctcgcgcgctacgaaaacgttcgtccttggcgcatgtgctcctgcctcggcgcctgggccgtactagagcgtccttcaatcattgtttcgactcctgctctccaacgcgtgccggcttaagaattggcgacagtggactttcgtcatacgaaattgggtaagatggaggagaagatgcatggatgttgagatccatcccaacgctaaaaagcacctgacggaaaagcaggtgcttagcgcttggcttgcggttactgagtgcattcgtcgcgagccgaaggacgagccgccgagatggcttgcaattggatggctctcagacggacgaagcgtggagcttgtcgcggtcgagcttgtccgtgggtggcttatcattcatgccttgtctccagtccagaagaatttttggcaggagattgaacaggctcggcaaaggggtcgatgatgggcaagacgtatacggccgctaatggtcaggttgtaacggatgaaatgattgacgcgtggtgcgagtcgtacgagcgcggagagtttccggatggcgaacacaccgttggtgggatcgtgcatggacggcccccgctctcaggtgaggggacggcaacgctgtcggtcaagattcctctgggaatgaaggaggccattcgtcgacgggcggctgccgaggggatgacgccaagtgagtttgcccgtgcggctctgagtgaaaaacttcttgctgccggctgatgcctctgacgtgccgatttatagaaccgaggctgtgcccaaaaacttttttaaaattctcggttgaccggaacgcgtccttggttatactaatcaagccttgaaacaaggcacacctcaaatggctgggtagctcagttggtagagcagaggactgaaaatcctcgtgtcaggggttcgattcccttccccgccaccttgaattgactaggacctctgcaaaggggtccttttcttttattgagggctctgcggaaattgcgtcccggaatttggcttcagagtgggatgcgttttccgctttgaggccgcttgggaaagcgcgacccggaatccggcgtcagaatgggatgtgctttccttttgcggtctttggcggaaactgcgtcccagatcccgcgctcagaacgggatgcgcttttcggccgcctacttccggcgcatatgtacatctcggcgcgccatctcgggcccgcccagatattcctcccgcttttgcgccactttacagaccgttcggtcgtctgtccgcacgcgcgggtatactcaaaacgatacttttcctatgcaatacgatgcaggctcggcctgcacgatccgaagggggcagtgatggagaggatactcggcgttaatctctctggctggtttattcccgagccttgggtgaccccgtcgctatacgcggcgaccggtgcatccaacgcggccgagctgcaggaggccatgggcaccgccgcctataacgagcgcatgcgccgtcattacgagacgtttgtgagcgaggacgatttccgtcgcatggcgcagatcggtctcaatgccgtgcgtctgccggtgccctggtatgcctttggctcgcaggagtccgatgcgtcctacatctcggttgtcgactacattgaccgtgcgattgagtgggctgccaagtacgacatccgcgtgctgcttgatctagcaactgtgcccggtggccagggcgattccaatgattcgcccgccacgccagaggctgttgccgagtggcattcgtccaccaacggccgtcatgttgcgctcgacgtgctcgagcgcctggccgatcgctacggcgaggccgagagcctgctgggcattgagctgctggatacgccgcagatgagtgtccgcaagagcctcttcaccatgacggatggcattccggcgcactacctgcgcaacttctatcgcgatgcctatgagctcgtccgttcatatatgcccgaggataagatcgtcgtcttctcgtcgtcggggcatcccagcgagtggaagcattttatgcgcgacgccaagtataagaacgtctacatggaccttcacctgtaccattaccgtgacgagcatgcgctcgatatcacgagcccccgcgggctgacgacggcgatttcgcgcaacaagcgcgagctcaaagaagcgatttcgactgggttccccgtgctggtgggcgaatggtcgggcgcggcgatctttgccaactcgtcggttacgcccgagggccgcaatgcctacgagcgcgtgtttatcgccaatcagctggcttcgtttgcgccggctgccggttggttcttccaaacgtggaagaccgagaagcgcattgcagcatgggacgcccgcgcggcgctcggtacgctcgagcgcggcatgattgaataggttgatatgacgcaaaacagcgcccatacgggcaaactctatgtggtcggcacgcccatcggcaacctgggcgacctgtccccgcgcgttggcgaggcgtttgccgccgccgatgccatctgctgcgaagacacgcgtgtgacgtcaaagctgctgatgcacctgggcatttccaagccgcttgtccgttgcgacgagaatgtgatcgccagccgcgccgccggcctagtcgaccgtctgctggcgggggagaccctcgcctttgcctcggacgccggcatgccgagcgtgtccgatcccggccaggcgctagttgaggcggcgcgtgaggccgatgtgcccgtcgaagttattcccgggccctctgcttgcgtcacggcgcttgtttcgtccggcattccctgcgagcatttcttcttcgaaggctttttgggtcgcaagcacggcgaccgcgtgcgccgactgcagcgccttgccgtggtgcccggcgcgctcatcttctacgagtctccacatcgcatcgtggcgacgctcgaggccgtggcggaggtctttccccagcgtgaggttgccgtctgccgcgaactcaccaagctgcacgaggaggtcttgcgcgggcccgctgctcagcttgccgaggagctgcgtgctcgcggcgaggtaaagggcgagattgcgctggtcatcgcgccgccgagcgaggatgaggaggccggtatcgtgccggttggcgccgcggcagcggatcccgacgaggccctgcgcgaggatatccgcgccgcgctcgaggagggggagcccgcctctgcggtggccaagcgcctgtctcagaagtattcgcgccgcaagcgcgatgtctatgccatggtgctcgatatgcaatagatggaggatatccagcccttgcgctagaatcatcccctgtatgcaacgtttttctggaggacaaaccccatggatcaaagcaagccttcgttctttatcacgacgcccatctactacgtcaacgccgatccgcacctgggcacggcttattccaccatcatcgccgacgttcaggctcgctatcgtcgctccgccggctataacgtcaagttcctgaccggcatggacgagcacggcgagaaggtcgccgaggccgcagccaagcacaacatgacgccgcaggagtggaccgatagccaggctccgcacttcaaggagctttggagcaagctcgagatttccaatgatgacttcatccgcaccaccgagccgcgccagcaccatgccgtgcagtacctgtgggagcgcatgaaggagtccggctacctgtataagggcagctacgacggctggtattgcgtgcctgacgagacctactttaccgatacgcaggtccagaagggcgacgaggagtacggcagcgtcggccagcacctgtgccccgactgccaccgtccgcttgagcgcgtgcaggaggagtcctacttctttaagctttccgctttccaggataagctgctcaagctttacgacgagcaccccgactttgtcgagcctgcgttccgcatgaacgaggtacgtagctttgtcgagggcggccttaatgacctttccgtgagccgtacgagctttgactggggcattcaggtcccgtttgacgagggtcacgtgacctacgtgtggttcgatgcgctgctcaactatatgacggccgtcggctacggtgtcgacaccgacgaggcgcgtgccgagctggcctatcgctggcccgcgcagttccacatcgtgggtaaggacatcatccgcttccactgcgtcatttggcccgccatgctcatggccatcggcgaggccctgcccgagcacgtctttgcccacggcttcctgaccgtgcgcaatgccgagaccggcaaggccgagaagatgtccaagagccgcggcaacgccatcgctccgcaggacgttatcgacatgctgggcgtcgagggctatcgctactacttcatgaccgacgtcgtccccggcaccgacggtgccatcagcttcgatcgcatggagcaggtctacaacgccgacctggccaacagctggggcaaccttatctcgcgttcgctcaacatgagcggcaagtactttgacggttgcgcgcccgccaagcccgcgtcgttcgatgcgttcgacaacccgctggcaaagatcgccgatggcctggtcgagcgctacatggccaagatggacgtgctcgattacggcggagccaaggatgaggtcatggagctcatccatgccgccaaccactacatcgaggactccgagccctgggcgcttgccaaggacgaggccaaggctgacgagctggcatttgtgatctacaacctgctcgaggccatccgcattgccgctcacctgctgatgccgctcatgccccagacttctgtcgaggccctgcgccgcctgtcctgtgagggcgaggccgcgagcgacgacctcaagggcatttgtacttggggcctgcttgccggcggtcagcccgtcgagaagggcgatccgctgttcccgcgtctggcgtagagaccgcgcgagcgccatatcggcaatttgctgtttagctgtaagggcatggccgccacggtccatgcccttttgtttcaagacgccgccatcatgctaaggaggcaaccatgacaacttcgcctttggcaaaccccacggccaccagggagctgctggaggagtttggccttgcgaccaagcatcgcctgggccagaactttctaatcgacaatcatgtgatcgagcgtatctgcgagctttccgagctcacgggcgatgagcgcgtgctcgaggttggcccgggcgttggtacgctcacgcttgcgctgctgcaggaggcggcgtgtgtcacgtcgatcgaggccgaccccgagctcgagccggtgctcgatgcccacgccgccgactacgccaacttccgctttatcatgggcgacgcgctcaaggtgggtccggagcagattgagcaggctgcgggcggtgagccgacggtgtttgtcgcgaacctgccctataacgtggcggcgacgatcatcctgcagttcttccagacgatgcctgcactcaagcgcgccgtcgtcatggttcaaaaggaggttgccgatcgtattgccgcagtgccgggtaacaagacctatggtggctacacggcaaagctgggcctgtatgcgcaggttacgggtcgctttgaggttccgccgcgttgctttatgccggcgccgcacgttgactcggctgtcgtgcgtatcgaccgtgttgacggcgtggtgcccgaaggactcgatcgcgaatttgtggcccgcgtgattgatgctgcatttgcccagcgtcgcaagaccatccgcaattccatgagcgccaacggctttgccaaggacgtgctcgatgccgcctttgaggcttgcggtatcgcacccaccacgcgcgccgagacgcttgatgttgccgactttgtccgtctggcccgggagctaatccatgatgcctaatgccgcatgcgtgacgtttaccaagaaaaagaagacggtcgcctgccccgtgcccttggcaccgcttgccgacacgcatgcgcatctgctttcgttttggggcaaagaagtgcccgagacgctcgtgcgcgccaaagccgcgggcgtcgacctgttggtgacgatgttcgaccccatcgctgacaaacgcagcgtgacggactatagcgactggctcgtgcgcgaaattctgccgatgcaggatatcccgcagatcaagtatcttgccggcgtgcatccgtatggcgcgccggactataccgacgacgttcacgcacaggtcgttgccgcactcgatgaccctttgtgcgccggtatcggcgagatcggtctggactaccacatggattacgacgacgatatcgcgccggcgccccacgacgtgcagatcgactgtatggcgcgccaactcgaggtcgccgtacgccgcaatgtgccggtagagctgcatctgcgtcatgaggatacggacgaggagcgcacctcgcatgtggacgcctacaacgtgttgcgcgaggtcgacgtgccccaggccggttgcgtactgcactgctttggcgaggaccgcgccacgatggagcgctttgtggagctgggctgctatatcgcctatggtggcgcggccacctttaagcgcaacgacgacgtgcgcgaggcatttgcggcaaccccactcgatcgaattttgttcgagacggattgcccgtatatggctccggagcccatccgcggtcttgaatgcgagcccgcaatgatctccattacggcaaacgcgctggttaacgaccgtgtcgatcgcacaggtgaggacgccgaaacaatcgcgcaagccgcttgggaaaatgcctgcaaactttttcaaaaatagttcttgcgttcgcggtggcgctccgttattctaattcctgcacgcgggcgtggcggaattggcagacgcgtacggttcaggtccgtatgggggcaaccccatgaaggttcaagtcctttcgcccgcaccattaaatgaaagagctcccagcgatgggagcttttttgttatgagcccatcgcagggacttgaacctgcgaaggagcgagcgtaaagaaaacgcggagcgttttagcgagctggcgagtccgccggcaggcgggcgaagccggtgcggatccgcgcagcggatacgcggacgtcctttcgcccgcaccattaaatgaaagagctcccagcaatgggggcttttttgttatgcacaatctccttggacgggtatcctaatgccaacgtgtgcctatcagaggagagaccatgctgttgtccggtatcattgccgcccttacgagccttttgattcccatcatcattttgttgctgctgcttcccaacgcctgctatgtcgttgaacaacagcatgccgtgatcatcgagcgtctgggcaagtttaaccgcatcgtcaacgcgggcttccacatgaaggtgcccgtgatcgaccgcaaagccgccacggtgagtctgcgcaccatgaaaaacggttttggtatcgacgttaagacccaggataatgtgaccatcggcctcgaggtctctgctcagtaccacgtgagctatgacatgggtgctggcccggcagattcgggtatctacaagagctactacatgctgcaggagcccgtcgaccagatgcgtgacttcatcaccgacgccctgcgctcttcgattcccgtctacacactcgatgaggtctttgccaagaaggatgacatcgccaaggacgtcaacgctaccgtttccgagcagatggccgcctacggcttcaccctcgtgtcgacgctcatcaccaaaatcgcactgccgaccgaggtcgagaactccatgaacgacatcaacgccgcccagcgcaagcgcgctgcggcacaggagctcgccgaggccgaccgcatcaagcgcgtcaccgaggcgaccgccgaggccgaggctatggaaaaggcgggcgagggcatcgccaaccagcgcaaggccattgcactgggtatcaaagattcgctcgagatcatccaggagacgggtgtcggcaatgacgaggccaaccaactgttcatgtttacgcagtggtccgagatgatgacggagttcgctcgcacgggtaaaacctcgacggtcgtgctgccgagcgacttttcgcagtcggcctctatgttcgagcagatgctggctgccggtaaggttcagaacgagtcaaaggagtaggcacgcgtgaaatacaccgtcgtttgtgttggcaagctcaaagagcgcttttggaaggacgcgtgcgctgagtacaccaagcgcctaggcgcctatgccaaggtggatatccgcgaggtggccgatatcgacccggctaaggcgggcggcgtggatgccgcgcgcgacaaggagggggcggcaattcttgctgcattgccgtctcgagctcatgtgatcctgctggctatcgagggcaaggagcgttcgagtgaggagctctcggcgaggctcgacgatcttatgctgcgaggcagcagcgacatcgcctttgtgattggcggttcggacggcgtgagcgatgaggtgcgcgcccgcgccgacgagatgctcagctttggacgcattaccttgccgcataacttggcgcgcgtggtgctgctggagcaaatctaccgcgcctgcaagatcagccgtggcgagccgtatcacaaataggtcggcaatacgaaacaatggcgtgggacaatagctttcgttttgaagagcgtgtctgagaggactatgagatatgaagattggatttgtcggttttggcaatatggcgagcgctatggccgatggctggatcgctgccggtgtagctgcgagcgacatgtgcgcctgcgcgggtcgctacgacgcactggttgagcgctgcgaggcgcgcggcatggtcgcctgccacgatgccgccgaggttgtcgccgcatccgatatcgtggtcgctgcggtcaaaccgtacatgatcgagaaggtattcgccccgctcaaggatgctcttgccaaaaaggtcgttctgtcggttgcctggacctgggacagtgccaagtgggagcaggtcctgccgggcgtcgcgcatatctcgacggtgcccaacacaccggtttcggtgggcgagggcgtcatcgcttgcgagaaggcttccacgcttagtgatgagcagagcgccgtggtgcttgatctgcttggcaagctcggtgcggtggtcgagcttgatacgagcctgctgttcgtgggcggcacggtgggtggttgcgctccggcatttgtcgctatggcaatcgaggccctgggcgatgcggcggtcaagcacggtatcccgcgtgccgatgcctatcgcattgtgagccagatggtgctaggtacggcaaagttgcagctttcaactggtcagcatcctgcggcgatgaaggatgccgtatgctcgcccggtggcgccaccatcaagggcgtcgttgcgctcgaggatgccggcatgcgcagtgccctggtcaaggcaatcgacgcaactctccagtaaaacctgccatttagggacaggtttattttggcaggtttttcctgcggttttgtcgtatgtgcgaaaagcgccccgcaactggctcaattccagttgcggggcgcttgcgtttgcccagataaaaccgaccaaaataaacctggccctttttggcaggttagtcccagaagctgtcttcctcatcctcggacttgggtccgcggtcgacgtacatcttatgggtacgcttctccattacaaaggcaagaatcgcaaataacaggatgccgccggcgaaaaggatggcaaaaccggtgcgggtgccaaacaaaaaggaaaaaactgcgtccattgggtgccttcttgcgtagttgagttgggtcgtaaacgctcataagtatatacttgcccatacatgtacaaggttgcaacctaaatggaatgtatatcgccggaggatctaatgcttgatatcaagtttgttcgcgagaaccccgatgccatcgatgtcgccatggctaaccgccagacgtcttgggatcgcgagaagttctttgagctcgacgacgagcgccgtgccgtcatcaccgaggtcgaggagctccaggctacgcgtaatgccgagtccaagaagatcggcgccctgatgaaggagggcaagaaggacgaggccgaggctgccaaggaggccgtgcgcgccgtcaacgagaagattgacggtctggccgagcgtcgtaccgccctcgagcaggagcagtacgacttcatggctcacctgcccaacattccttgcgaggccacgccgtacggtaaggacgaggacgagaacatcgagcgtcgccgctggggcaccccgcgcgagttcgacttcgactttaagccgcactgggatctgggcaccgatctggacatcctcgacttcgagcgtggcaacaagctctccggcagccgctttaccgttctcggtggcgccggcgcccgcctggagcgtgcccttatcaacttcttcctcgatacgcacaccagccgtggcttcaaggagtggtggccgcctatcgtcgtcaagcgtcagactatgttcggcacgggccagctgcccaagttcgaggacgacgcctatcatgtctcgggcgacaacttcctgatccccaccgccgaggtcgtgctcaccaatctgcacgccggcgaggtcctcgatgccgacaccctgccgcgccgctacaccgccttcaccccctgcttccgcgaggaggccggttccgccggtcgcgacacccgcggcatcatccgtcagcacgagttcgacaaggtcgagatggtcaagttcgctaagccggaggagtccgacgaggagctcgagaccatgaccgccgaggccgagtacctgctgcagcagctgggccttccgtatcgcgtgattagcctgtgcaccggcgacttgggcttctctgcccgtcagacctacgacgtcgaggtttggctgccgagctacaacgcctacaaggagatcagctcctgctccaactgcggtgacttccaggctcgccgcgccaacatcaagtatcgcgaccccgagaacttcaagggttcgcgctacctgcacactctcaacggttccggcttgccggccggccgcaccatggccgctattctggagaactaccagaacgccgacggcaccatcacgatccccgaggtcttgcgtccttacatgggcggtctcgagaagatcgagccggtcgcgtaaattggctgcataggggatatgcaagggcgctccttcgggggcgccctatttcgtgcgcaggtccataccatgccgtgcggacagctcaatagaaaacacacgaacaactgttctgtatacagccatctacctgctatgcttttgctaaataagagcgagagaaaggggacgcgatggagctgtttgatgatcgggtggttttgtttgagagcgacgagggcggggagtacctgattgtaacgtgtgagccgtctggcatgggtggcctggtggttcgacagacgagcgagggtccgttgacacaatggtgctttgaggagtcgccgcatgtggtcgagacctttgtgacgcacgagggacttgtggcgctggagcacttctatggagttgggacttccaaccaggtcgcgcgcatgctgagcatctcgtttgccgattatgattgtgcccagcgggtgagatcgctcctgagggaacttgacgctaagttcgacgtgatcgaaaagccaatcgatcgtacggggaacggcggtatatgcggagcagcatgacaaaactgcgttccacaaaaaagtttgagattgtgcttgactccaataagctaaagtggttttatatgtcttgcgctgcggcgttacctcagctggatagagggtctgactacgaatcagaacgtcataggttcgaatcctatacgccgcaccatttgagattaaagctcccggcaacgggggcttttcttttacgtaagcactgcatggattcgaacctcggtcgaggcgcgggcgtaaagaaaacgcggagcgtttttagcccgcgggcgagcacgccggaaggcgggcgaagccggtgcggatccgcgcagcggatgcgcggaatcctatacgccgcaccaatcgaacttaaagcctccggcaacgggggcttttcttttaggcggacgccgcatgggttcgagcctcggtcaaaggggactatttctcatcgactcgtgtaagatttcgagtatgcgcctcggtgagcccgtggcgcgctctttctttagacgaccgattagggtgatatttcgtggcagagcgtccgacatacaagctcaggtttcttgatcccaaaaagcgctttccggccatgcccgagcagcctgcgggacgctcgtatggcgtggtttggaagctctttggcgaggacccgcatgaatcatgctatgtcgtcgaattcgtcggcaaaagccatgtgtcgcttttgggctacgtgagcgtttcgggtgaggtctataaggtggaccgtcccgttaacgaagtatcgctgcccgacgatcccgacatgcagctgattcttgacgagtccgattccaacatcggtgagattgcagtcaggggtaccgatgggacgatgcgctcccgggcgcgagtcatcggctctcccgaaggcaccatgcgcgaacaatccgatcgcgagacgtggaattcgacgcgcagccttcgctacggcgagttcatggcctcgatgttcttgcgttacgtgatattcgccgattctgaaaacgctgtctcagacacggcaggcggcgacggcctcgacgagggtatgaaaaatgccgtcgacaaaatcaaacttgtaaaactccccgagccggttgaggtactgctgggttttgattccacgccgctgcccgatgcaatcgaaacgttgctctaccgcattgaccatacggataatccaagtggcattgagcgctatgccgccgcccttatgagcgaaattgacttgccccgcctgcgcaccatcgccgccaagtccgagatgagcctggctcgcatcgatcgctcaaagctgttctatctcaattttgatcgtagtctgctagaccaggacgagattgacacgctgctcgccatcgagtgtcgtctcaaccgcctctccggcatctttgagcgcatcggggccggattggcccctgcggcatcctcgccgagccttgagggctgcgcgctctttgatgcgtggcatatcgccaagacgaccaacgatgttccccgactgctcgatacggcctcgagcgataacccgtggggcaaaccgggtacggtggcttgccagccgggcggcgagtgggacgtgcgcacccgttttgcgcgaatcgttgaggcgctcaacgtggtcacgcggctcgactatacctatcgggcaaacgttgccgaggggattatgctcgttcggtttgggcagtctgtcgttgatgccatgccgcaacgtgaatacgacgctcaagatgacgcctggcgcgagctggacgaggacacgcgcgcgatctgggccgcggagcacgatgcgcgcgtggcactcacgcttgcggcagcgtgttttgccgcgggcacctgcatcacgcgctgctacgtgcagattgctgctcccgacggtgagcagggcgagcgtgttgtcgcaacgtatttctttgagcgcgcggcctatctggccgattgcgtgcctgtcgccaaggatcttgagagcatggacatggacgatatgccgtgcaagcgtgtgcttgaggcgtatgagtcaaccgctccggagacgattgagcctgcggaggttcatgctcgtccgcgtgatgaccatcgcacgctgccgccggcgctgcgcgatctgctgcttgccgatacggctgacgagttggaggtcatggaagaggacgacgacccatacgtggcccgtgttgttgaattgcgcgagcaggcaaaagtcgaccgtacaggtgcttttgaaggcttttcccgtcttgtcgaggagttggaggctaagtgcgctgtcgccgagcttttggcgacaggtccggttcaaacgcagttttgcgataaccagctggtacgcatggtgctaccggtgttggaagaagaccgctctgtgcgaatccttcgtgcgcccgatgcgctgtactttgcccagcacgagatctgcagcttttacgccgagcaagaggactttgaacgagcgctgcccgaggtgcgccatctttacgatctggcgcgctcgtccatgcaatcgcactttgcgctcatcaacgtgcttgcgcgtctggagcgctttgacgagattatcgaggtggcgcgccacggcctacgtattgccagcgatcgttctgcaattggctacctgttctatcgcttggcgtttgcctattggaattgcgatcagctcgacctggcgctggcttgttaccgtctggtgccgcgcggcgaggagtcgggcagcagcgcgctggaagaaatgcagggccttatgaatgagatgggcgtcagcgagcctccgacgttcgaggaggcggtcgagaccatccgcaaggctggactcgagctgccgccagtgtccgccgtgacgaatcagctggcagatgccgctgtgcaactggtcgacaacggcttctttttcctggcacgcggttgcatcttccaaatgtggcgcaccatgggcaacgacgagctcggctcccttaaccgttcgctggggtaggcgaagcttccaaggaggaaaggatgctaggcaattagaaaatttcctcttgcccatccttggctgtttggttactatagaacggctgttacggagagctgaccgagaggccgaaggtgctcgcctgctaagcgagtatgccccaaaagggcatctggggttcgaatccccagctctccgccagtacgaatttgaagaagggtcccatttggggcccttttttgtgcggagaaaggaggctggggattcggcttataggacaaaatgtgtgtccacgttgggggcatcggcgcaggtcgatgccaccgcaggaagcttggatacgcctaggcgcggtccaagaaatcgtccgcacccccgatgggctgctagaacccaaaaacaggaactatttcaccgcaactgatgaggggatgggttagcgaagcaggccggctacttcgccggctagggtgatggtgccggctgctacgaaggactcgcccgcggcatcgaaggcagcgagggcctcggacacgctcgggtatacgcccacgagcttatcggcatcaacgagggcggcgagctcctctgccggcagggcgcgatcggaatcggtctgggtcacgaccacgcgggggaacgccgggatcaacacgccgacgatacccgccacgtccttatcggccagcgcggcacacagcagcgtggggcgattctctacgcacggatcgatctcgtccagcgcgctcacaaagttctcgcagctctgagggttatggcaggcgtcgatcagcttgagcggatcggtgcccaacacatcaaatcgacccggcgtgggacagcccataagcgacacatcgagcttgtcatggtcgagctcgcggcccagatagccctcgcacagcataatcgcgcacgcggcattctgcggctgataggccggcttgaccatgctcgacgtatagatcgcacgcggcgtagtgcagctaaactcaaccgtatcgcccacatgagccggcactttagtcgtggtgtggctcaccacgaacggcacgacgccgcactcacggcaacgggcatccatcacgcgctgaacgctcgcctcgtgcgtaccctcacccaaaacaaccaagcgcccgggtttgataaccgcagccttctcacccgcaatggcctcgagcgtgtcgcccaaaatgcgtgtgtgatcgagcccaatgcccgtaatggcgacagccacgggatcggtcgcgctcgtggcatcccaacgcccgcccatgccaacctcgagcacggcaacatccaccgcggcctcggcaaacactacaagcgcggcagccgtcagcaggtcaaacggcgtgatggtataggcgcgctcccccgccgccacacgacgggcattcacgcgacgccccgcctcgacagctgccgaaacgccacgggcaaaggcctcgtcgctcactacgcgtccgtcaacctccatgcgctcgggatagcgaacaagctgcggcgacgtatacagcgcggtcttgagcccctcgccgcgaaggatagcagccgaaaaacgcgtagtcgaagtcttgccattggtgccggctacctgaatgcaatcaaaatactcatccggacgccccagctcatcgagcatatcgacaaccgtctcaagcagaggaccagcatccccagaaatccgccccgtatcggcagccagcccaacagcctcaccaaacgaaagcaactcaaacgagaacggcacagaatacgaccccgaacgcttaggcataaaccaaagtcccctcaacataaaaagaggcccgaatcaacaacgagcccctcccatacaaaatatcagccaaacaccgctttgcagcagaatcaaggccacaacccagtggcccttaccggcaggcagcaaacgccccgtaaccgctatgggagcggattggggctttgctcgatacaagttccgcacgagccgaaggccacttaatgtggccttcgtgcgagcaggactgtccgcagtagcgagcaaagccccaaaccgcgtcccccagtaacgcttacgagaagtcagcaacctgggcagtcagcgccgccaggatctccttgagctcagctgcacggtccctcttcttctggaccacggcaggcgcggccttagccacaaagccctcgttggccagcgtcttctcgcagccggcgagctccttctgggccgcggcgatctccttctccaggcgtgccttctcggccgaaaggtcgaccttgccctcgagcaccacaaagacctcgacgccgctgtcaacaacagcgatgctcgcagccggcttctcaacgtcggtacccataaccagcgaagcggtgttggccagcggctcaatcgtggagcgtaggctctcgagcttctcgatgtcctcggcaccagcgcgcacgacaacgtcaagctcggccttggggctcaagcgataacgcgaacgggtagcgcgggcggcagacacgacggtacggcacagctcaaacgcgcgctcggcgtcctcgtcaacatacttggcgtagtcggcgggctcgggccacttggcgatcatgagcgcctcggcgcggtccacgttgcccacggcgtccagatcgagcacgctcgccggcatgttgtcccagatctcctcggtgacaaacggcatgagcgggtgcatcaggcgaatggaggtgtcaagcacaaaaatcaggttgcgctgagcctgcagacggccctcgcccttcaagcgggccttggtgacctcgacgtaccagtcgcagacctcgttccagaagaactgctgcacgccgcgggccatatcgccaaaggtgtagttctcaataccctcggtgaccatcttgacggccttggccaggcggctgaacatccaggcgtcggccggcgtctcaacgacgggctcgccgggcgtgtagccctccatgttcatgagcaggaagcggctggcgttccagatcttggtcacaaacgacttggcctgctcggtgcgcgagctgtcgataagcttcttggtcttcttatcgatgttcgcgtcgaacttaacgtcctggttgttggtgcacagcgtaagcaggttgtagcgcatggcgtcggcgccgtacatgccaatgaggtccatggggtcaacgccgttgcccttggacttggacatgcggctgccgtccttggcaaggatcgtcgggtagatgacgacgtccttaaacggcacctcgtccaggaagtacagcgagctcatgaccatgcgagcaacccacagcgcgatgatgtcgcgcgcggtgacgagcgctgtcgtggggtgatgtccctcgagcagctccggcttttgcggccagccctgcgtggcgaaagtccacagctgagagctgaaccaggtgtccaacacgttctcgtcctgatgcacgtgatgaccgccgcacttggggcacacgtcggtgtcctcggtaagggcgtcctcccagccgcagtcctcgcagtagaacacggggatgcggtggccccaccacagctggcggctgatgcaccagtccttgaggttctccatccaggtggtgtaggtctgcgtccagcgcgcagggtggaaggtgaccttgccggagttgacggcgtcgagcgccggccccttgagcttgtcgacggccacaaaccactgctcggaaagccacggctccagagcggagtcgcaacggtagcagtgcatgacggagtggtcgagctcctcgacatggtcgagcaggtcgtgctcctcgaaccacttgatgacggcttcgcggcactcgtcgcggttcatgccggtgaactcgtcgtagccctcgacgaccactgcgtgctcgtcgaagatgttgatctgcggcaggtcgtgggcctgacccatagcgtagtcgttggggtcgtgggccggggtgaccttgacaaagccggagccaaagttggcgtcgacatgccaatcctcaaagatggggatctcgcggtcgacgatggggagcttgacggtcttacccacaaaggcggccttctcggggtccttcggggagacggcaacgcccgtgtcgccgagcatggtctcggggcgcgtggtggcgacgacgatgtagtcctggccgttgaccggctcggtcagcgggtagcgcaggtgccacaggtggcccttctcgtccttatactcggcctcgtcgtccgagatggcggtggtgcagttggggcaccagttgacgatgcgcttgccgcggtagatcaggccgtcgtggtaccagtcgcagaacaccttgcgcacggcctgggcgtagtcctcgtccatggtgaagcgctcgttatcaaaatcaacggagcagcccatgcgcttgatctgctcgacgatgatgccgccgtactcgtgggtccaatcccagcaggcgtcgacaaacttatcgcgaccgatctccaggcggctgatgccctcgctcttgagcttcttgtcgaccttagtctgcgtggcgataccggcgtggtcggtaccgagcacccagcgcgtggacttgccgcgcatgcgggccatgcggatgatggcgtcctggatggagtcgtcggtggcgtgacccatgtggagcttgccggtcacgttgggaggcggaatggtgacggtgcagtcgcccacgccctcacggcgcttgtagtagccgccgtcgagccacttctgcaggatcgccggctcgttggtcgacggatcgtaattcttgggcatttcttccatatatctctcccttgcccgtcggcgtgtccgcctgcttggttttcgctcggtcaggtcctgggctcgcacgaagagcacatttagtgctcttcggctcgtgcggaatctacgaaaaccaagcaggcggacacgccttaggtatcgattacttcagtctgaaggtactaacttgacaatctcacagaatagcacaggcatacctgccgaaaagggacaggtttattttggtaggttttatcaggggaaacgacatttgcccatataaaaccgaccaaaataaacctgcccctaaatggcaggtcccgcggaggttgccgcgggacctggattcaagctatttacccgtagatgcgctggggctgctcttcgccctttacggaggcttcggtcacaacgaccttggaaacgccctcctcgctgggaaggtcgaacatcgtctgctgcagcacgtcctcgcagatggaacgcaggccgcgcgcgccggtcttgcgagcgagcgccatacgggcgatctcgtgcagggcggcgtcctcaaactcaagctcaacgtcctcgagctggaacatcttgcggtactgacgcaccacggcgttcttgggctcggtcaggatcgacaccaggtcgtcctcgtcgagcgcctgcgtctgggtgacgacgggcgtgcggcccacgaactcggggatcatgccaaaggcgttgaggtcctgcgggagcacctgacgcagcaggtcgttctcgtcgaccgaggtggggccggcgatctcagagttgaagcccacgcccttgttgcccacgcgatcggcaatgatcttgtccagacccacaaaggcaccaccgcagatgaacaggatgttggtcgtatcgatctgcagcagctcctgctggggatgcttgcggccgccggtgggcggaacgcttgccaccgtgccctcaagaattttaagcagtgcctgctgaacgccctcgcccgaaacatcgcgggtaatggagaggttctcggccttgcgggcgatcttgtcgatctcgtccacgtagatgatgcccacctgcgcgcgttcaatgtcaccatcggcggcgttgataagcttgagcaggatgttctccacgtcctcgcccacgtaaccggcctcggtgagcgcggtggcgtcggcgatggcaaacggcacctcgaggatgcgcgcgagcgtctgggcaagcagcgtcttaccggtaccggtgggaccgagcagcaaaatgttggacttggcgagctccacctcgtccatatcatcgtcgagctgcgagtccaaaccgtcgtcaaaggccgaaagcgcagcgccgccctcgatcacgcggcggtaatggttgtacacggcaaccgacatggcgcgcttggcgtcctcctggcccatgacataggccgaaagctcgtcatagatctcatgcggcgtcggcacatgcgtaatgacttggcgggcgtcgtcctcgagctcaaagccctcggcctcgggatccacggcgggctgggatgcagcctgactgtggtcgttgaggaagcccggcagcttgccgttgcgggcagcgtccataaagtccgaagccagcgactcctccagaatctcggaacaggcggcgacgcactcgtcacagataaagatgttggtcgggccctttacgaggcgacggacctggccctgctcttttccgcagaaggagcagcggatggggttgccgttctcgtcaaagttgtcctgcatgttaccggtcatcctaggcgtccttcgcggcgaggtcgcgcgaggtgacaatgcggtcgatcagaccgtagtcgagggcctcggcagccgtgaggtagttatcgcgctcggtatcggcctggaccttctcgatgggctgacccgatgcgtcggacagaatctgattgagctcgcgacgggtcttcttgatctcctcggccacaatctcgatctcggtctgctggccctgcgcaccgccgctgggctggtgaatcatgaccttggagtgcggcaggcagaagcgcttgcccttggcgccggccgaaagcagcacggctgccatggacgcggccataccgacgcaaatggtggagacctgcggcttaatgaagttcatggtgtccagaatcgccaggccggagtaaacctcgccgccgggcgaattgatgtagagcgagatatccttctcggcatcctggctctcaagatgcagcagctgggcaacgaccaggttggcgctgacggagttgatttcctcgcccaagaagatgatgcggtcgttgagcaggcgcgaatagatatcgtagctgcgctcgccgcgcggcgtctgctcgataacgtatggcacgagggcggaatcgaacttggcgatcatacgcatctccatttctcttacggaccaaattggttctagataaacgtacggtgcccgcatgctatgcattggctggcaccgtacgaagcaaccggataaccggtgtataactttaccccatcacgggcgcacgcatgcgctcgcgagcaaggtggcgagaattactcggcgtccttggcggtctcgtcgacctcggtcaccttggcgttctcgaccaggtggtcgacggccttggagcgacggatggactcgcggacggcaggcatacggccatcggcgataaactcggccttggaagcctcgacgtccttgacgccagccttctcgaactcggcgttgacgtcgtcctcggtgacctcgatcttgagctcacgggcgagggcgtcgagcgccagggactcgcgggcaacgtcgttggcctgcttgtgcaggtcgccgacgaactgctccatggtcaggccggaagccggcagccaggtgtcgagcgtcatgccgcgggcagcgaggttggacaggaagttctggccaagctcctcaaagacggactgctcgtagtcggcatccatctcgtcgagctgcagacgctcggcgagagcggagacgcaacggttctccttctcggccgggaggcgggaagccttgtcctgctcgatctcaatcttgatggcgtcgcgcatagcgtcaatgctgtcgaagccaaagtcggacttgacgagttcgtcggtgagctcgggggtgttgcggaccttgatgcccttgacggtgacctcgacggtgtgggtctcggcctcctcgccctcctcgacctcgtcggtccaggtgacggacttgacgtcgtcaacgttggcgccgatcagggcctcgttgaactccttggggttgctatcgctaccggcgatgagcatgcggccctcggcggcaaagttgtcggcgttctcgacggccttgaggtcgacggtcacatagtcgtcagcctcgacggcgcgaccctcgacatcctcgaaggtggcacggtagttgaggagcatctcaacctggttgttgatctcggactcggtgacctccgcgggaggcatctcgatctcgacggcgtcgaaggaggagagctcggcagcaggacgcagggagaactcgacggtgtaggtgtagtcctcgtgatccttggcgaggtcgagctccttgtagtcaccgttcttggtggggacgatgtccagctcgttgaggacggcgggctcgttggcggcgatcaggtcgttggtggcctgagcgagggtagcctcggcgccaagagcggagtcgatgaccggacggggggccttaccggcgcggaagcccgggaagcggtacttcttggcggtgtccttgtaggccttcttgatcgcggcgtcgacgtcggcggccgggatggtgaccgtagcggtgagcttggcgtccttgacgtcagaagcggtgatgttcaacacgttcctcctcatactgcccagcttatctgaggtgctggtacctttatgcaacaagcgtcgcgagggcataagccgacgcgggtgcgttggtgcgggcgaaaggactcgaaccttcacgggaatcccaccagaacctaaatctggcgcgtctaccaattccgccacgcccgcatgagcgcacagattaggaatgatagcagatacgaacgacaagcgcacgcacaccttttacaagctcacgacctcaccacgagtacgcatcggatcccccgccgccccaccgaagttgcggtggaatagggactgtttggggctccagtcctccaaaacagtccctattccaccgcaacttcggtaggactcggcagtctggcggtgctggccatgtgccggaaagcgtgtcccggtttggggcctcggaatgggacacgatttccgctatagccatcaaccggaaactgcaacccgttttgagcccctattccgggatgcactttccgccgagggcctcaaacggaaactgcagcccacaattcggtcgaaaagtgggctgcagtttcccagggctaggcaaagagcggcggatgcgtcgcctcgcctactcccccagcagcgctttctcgggcgtgatcggcagcgatcgaacctgatgtccggtggcgtgtgccacggccgaggccacggcggcgagcggcgtgttgatgacgacctcgccgatcgacttggcgccaaacgggcccgtcggctcgtagctcggctcaaaggccacgcgaatgctgccgatatccaggcgcgtgggtagcttgtagctcataaagttgccggtgcgcaggcgaccgcggtcgtcgtgctcgacgatctcgtagagcgcatggcctataccctgggcaatgccgccctcggcctggacgcgcgcgagcgcctcgttaataacggtgccgcagtccacagccgccgcgtagtccaccacggtcaccttgccggtggccttatcgacctcgacctcggcaatgccggccataaacggcggaggcgaaacgggcaggcaggcagaggcatgcgaggtgagcgcgtcgccgcccgcgatgttcttgacgcacaggttggcaaagtcgcgcagcgtgaggtagcggttctgctcacgcgcggcacgctcgtcggacaggcgcacatactgaccatcaaagaccacatcggcggcgtccacgtcccacatctgggcggccttggcgcagatcttctcgcgcagctcggtcgcggcgttcttggctgccagacccgtcacgtacgtgcccgagctcgcgtacgagccggcgtcgaacggcgaaacgtcggtgtccacgccgcgcaccacaatgagcgagctttcaacgcccagctcctcggcggcaatctgcgccaggatcgtgtcgacgcccataccgttatcggtggcgccggtgccgatggtaataaagccgtcctcttccaggcgcatgtcgatgccggcgatatccacgttggaaatgcccgagccctgcatggtgagcgcgcagcccagagcacgcacgcggtcgcccaggtcgacggctagcggcttgtcgcgccaaccgatcatgtccatcgcgcgcagcaggcagcggtcgagcgcgcaggcgttgagcttctcgttgtagtactgcggcatgatctcgccctcgtgcaccatattcttaaggcgcaggtcggcgggatccatgtgcagcatgtcggcgagctcgttgacggcactctccacggcaaactggccctgggtggcaccgtagccgcgatacgcgccgccacggttggtattggtgtagacggcgtcccagctaaagcggctcgccttcacgtggttgtagatgggcaggctcttgtggcccgagaggccgatcgtcgtggtggcatgctcgccataggccccggcgttggacagcgtatgcagatcgatggccgtgatggtgccgtcgttcatggcgcccagcttaacggtcatctgcatctggtggcgcgagttgcccgcggtgatggtctcctcgcgggtgtagcagcaatagctcggacagccggtctgctgggtgacgaacgccacgaagatctcgcagcagcccgtctgcttggagccaaagccgccgccgatgcgcggcttaatgacctgcacctgcgactgcgggatgtcgagcgactgcgcgaccatgcggcgcacgtggaagggcacctgcgtggaggtggtcaccgagatgcggccgaacgcgtcggtcgtcgcgaaggcgcggaaggtctccatgggcgcggtctgcgtggcctggctggtgtaggtgcgctcaaagacgatgtcgctctgggcgaacgcctcgtccaagtcgccatagtcgctcatgccgctgcataccaagttgcgcggaacgtcgccgccctgcgggaacataaaggtcacgtcgccctcggggtggaccacgatgtcgttatcgagcgccttggtaaagtcgagcaggggctcgagcacctcatagtcgaccttgatgagcttgagcgccttgtcggcggcctcctcggtttcggcggcgacgatagccacctcttcgttttggtaacggacgagattctcgagaatcaggcggtcgtagggactcggctgcggatagctctggccggcgatggtaaagcggcgcttgggcacgtcctcgtaggtgtagacgcccaccacgccgggaaccttcagagcgcgcgacgtatcgattgagcggatattggcgcgggcataggggctgcgcttgagtttgacgatgagcgcaccggcgggcaccatatcaccggtgtagacgggacgaccctcgagcagggccttcgagtccttcttgggctgcttcttggtgatctgcttgtacgcgacaccgtcggagctcgtctcgttgacgggcagctcgggcatctcaaagcccacctgcacgccggactcgttgaggaagcgaacgatggcgcgcagctggctctcgtagccgctgcagcggcagaggttgccggcgagctggcgcgacagctcctcgcgcgtggcgacgaggctcgggtcctccttggcagcgcgggcaagcgccagcacgttcatgatgaggccgggggcgcaaaaaccgcactgctcagcgccttcggcagccatcgcacgggccagcgcctcagactcggctttgaggccctcgagcgtggtgatggtgtggccctcgacgcgagcggcgggaaccgagcagctcagcaccgggtcgccgtcgagccacaccgtgcacaggccgcagttggtggtttcgcaggcgcagcgcaccgacgcacaaccctgctcgcgcaacagtgcaaagagcatggtgtcgggggcaatctgaaccttgaccttacggccgttgagcgtaaaggaaagatcgatgagtttggcagccattagcgcacctcgctagaatcgacgccgggcacgcggcggcaggaatactcgtccgtggcaaacttggggatctgcacggtctcgagctcgcgggcaagcgcggccgaaagctcgatgccggcggcgcggcgcacggcctgcacggcaagcggggccgagatgcggcggcggtaggcggccgagccccacaggttggtgccgtagctcagggcgcgcacagaagcggccagagcgcgaagctcgtcctcggaaggctgctcggcagtaaggccgcatgcctcgccctgcagcagggtcgcgcgcagcgggcgggcgcccacggtgacatgccagctgttgttccaccaggcggcagtgacgtttaaggaggggaagtcggtcgcggccttgcgcacgacctcgtagctcgcacggtagtcgtgcttaacgactacgatgtgctcgatcacgtcgcgcacgtaacccatgtccacgaactcggcgagcggcacgcggccggcgcccgtcagctcaacataggaatcgagcgcgaggaaggcagtgagcacgtccgagaagccaaagcggccgtaaatgctgccgcccaccgtggcggtattgcgcaactgcacgcccacgatatcgtggacggcaaactcaaagacatggttgacaagcgcgttgagctcggcatgacgctcgagctggcgcagggtacacatggcaccgatgcgaaactcggtctcggtctcctcgatctgatcgagtccgcaggccgaaaggtcaatcgccgtcgcgacgcgacgcgagcccaggcgcatccaaatgccaccgcccacaatcttgttgttgcggttcttctgtaagagctcataggcttcggccgcatttccaacacggacgtaggtaccgaacttgagcacgttctcccccatctcttcacttgtccagtacttttaagtgtaccaaacgaggggccgcacaccgttttaggacaaaatccacccacccatccataacttgcggtgatatacggactgattagccgttctggggcgctaaacagtccgtatttcaccgcaagatatgaggagtcctccgggatagaaaaggctcccagccggatagctgggagcctcatcacatgctatgtcgcgcgaagatttagcagacgccctgggcgagcatagcgtcggcgaccttcaggaagccggcaatgttggcacccatgacgaagttgccctcctcgccgtactccttggcggtgtcgtccacgttgtggaacatgccgcgcatgagctgctcgagcttgccgtcgacctcctcgaaggtccaggacaggtgctcagcattctggctcatctccaggccggacacgagcacgccgccggcgttggcagccttaccaggcataaaggcgacgccgttctcctggaagtaggtcgtggcctcgatggtcgtgggcatgttcgctccctcgccgaccaccttgcagccgttggcgacgagcgcctgggcgtcctcgagcagcagcgtgttctcgcgagcgcaaggcagtgcgatatcgcagggcagctgccacacgccgcggccgtcgccctcgtgccacacggcgttaggcttctcgtcaacgtacatggcgagcgtaacgcccttgtcgtggccggagcgcttcttgttgtagacgtgctcgagcacggtgtagtcgatgccgtcgggatcctcgacccagccgtgggtgtcggagcaggccagcaccttgccgccgagctgggaaaccttctggacggcgtagatagcgacgttgccggagccgtgcacgacgacgttcttgccctcgaaggagtcgccgcggctcttgaggtactcgtccacaaagtaggccagaccgtagccggtggcctcggtacgggcgagcgagccgccaaaggagaggcccttgccggtgaggacgccggtccactcgttggtcaggcgcttgtactgaccaaacaggtaggcaacctcgcggccgccaacgcccaggtcgccggcaggaacgtcggtgttggggccgatgtggcgatagagctcggtcatgaaggactggcagaagtgcatgatctcgttgttggacttgcccttggggtcaaagtcggagccgcccttgccgccgcccatgggaagggtggtcaggctgttcttaaggatctgctccagacccaggaacttgagcatgcccagggtgaccgtcgggttaaaacgcaggccgcccttgtagggtccaatggcagagttgaactcgacacgataaccgcggttgacctgaaccttgccctggtcgtcgacccagggaacacggaacatgacgatgcgctcgggctcgacgaggcgctccagcagagcggcctcctcgtactcggggtgggcgtcgagcgccggctggatggtgccgaggatctcggtcgcggcctggatgaactcaggctgctcgggatagcgggccttgagctcttcgagaactttctgcgtgtagctcatgcttcctccaattgatggaaaagaaaagtgtcgttcgaggcgccccatgcgccgcgagctttatcgagtatggataatatcgcactgttgcggcaaagttacgcataagccgacgagcggatgtttcgttttgattacgatgcaggtagaagcgtttttgagtgcctgacgtgcaaaacccgtgtttcaaacctgtttcgtccacgtgttccaaaccaccacattggggacaggcacctttgtggtggtgttggtggttagaggacgagctggtggtagtcggcgggggttacgcggccctcggtggcggcgcggaaggcggcgagggcatcgcccgagaacggcatggcccagcacagtccgcagccggcggtgatggagccgggcagcggcatgatgcgcccaggaacaccggcggcaaggcacagctgttcgcattccatcacatcgaaggtgctgtcgaacgacacgatgattttgcgttcatggtcgagagcatcaccggacgggccttcgcggtgtgcatcgcgatacgccgcggcggccgcttcctcttccgcagtatgtccacagccaccgcaaccgcaggtacagggttcggacccgtcgcaagtgcaaggttctcccgtgtcgggacaaatatcgtgagacatggcaactccaatcgtctaggcgagtaactcggccgccgcaaactcctcgggcgtattgacgttctcgaagcagagcgtcgagcccgcggccttaacgatctgcggctcatccatataaccagcttgaacgcgattgatcaggcagcgaatgcgctggcggtcgcaggcgagcagctcttgggcggccggcgcacaagcgtcacggcgccagacggcgcaaagcggctcaatcccccgctcctcgcgcggcacgcacacgtcgagcgcctcggcctcaacacgatcggcaagcgcgccgataagttccggcgagacaaacggcatatcgcaggcgacgatcgccacgagcggcaatcgggccgcggccaacgagctcgcgatgccgcgcatggcaccggcgggaccgtcgacgtccatcaccacgcgggggcgcaggccatcaaacataagctcctcaagataggcaagctcactgggacgcgaagtcgtcacgaccaactcgccggcaacctgagccaggcggcacagcacgcgctcgatcaagggctcgccgcaaaacaacattcgtgccttgtcacagcccatgcgcgaggacatcccgcccgcttgaacgacgcaagaaagatcggcccgtcttacggtagtcatacggcaaaccacccccatcggcatgctcaaaacccggcacgcgaagccaaataccgtcgccgaaaaagcgggcggtacggcaaacctgtgcaaaaacaaaacagcgcctttgcggcacgcagcaagaccgcgagcacaaaagcgctggtagcgtatggcgggaacgtatgtgaatcgaacacatccaagacgttttgcacgcctcgcaacggttttgaggaccgcggagcccaccggagcccatccgttcccaagtgcggcggtattttaccaaaccgaaacggctccatcccaaaaagacgaacaagaagttgcggtggaatagttcctgtatttgctgccaaagcctccaaataggaactatttcaccgcaactgaggaggtgggagcgagtgaccggcctagcgcagggacctcaggccgccggcgtccttgtcgagcaccgtaaagcgcacggcatccaggtgctccaagatgctgatggcacgtttgcgcgacacacccagcgcctcgcgcagcacgctcgtggtggcagcaccgccggcttcggcgatgacggcggcgacgagctcgcgcgcgtgagcctcagcggcagcggacagggcaacgtcgcgctcgaccttaacgatcgagcggttgagcgaaagctcgcgcagggcacgcgtcatggcgtcgcggccgagctgcagctgttcgcccacctcgggaagcgccggtgcatcgaggccggcttcgtccagcaaggcaacgatacgttcgcaggcctcgcgcaccacacgcgccgcggcggcagcggagtgcgggtcgaatacctcggcaccctcggcggcgcacacgccacgcgagcagccctcggcaatcagagccgcggcaacgacttcatcggcggcaggccacgcagcatgggcgacggcgccgggcgtaaagcccgtctccttaggagacgctgtgtgcatggctgacagggtcgccgccagtgcgtccatcgcagcgtcgagcacagcggcattcgtatacagcgtaccgcccgagccggcaagctcgcgaacaacacctcgcgccaccaacccgtgcagtgcggcatcgacctcgccgacaccaagatccaaagcctcggcaacatcagccgtcgtaaccggcagcgtctgcagcgccagccaagcgcccacaccgcccgcgatatcgccggactcaagcgccgcatacagcgcacgctctccttcggcaagctcgcgcgagcgacggcagcgcgaaagcagcacgcgcccgccgccaataagcatcacgggcgaataggacagcaccacggcatggtccccggcgcgcagcggcagcgagttttccaagcgcacctgaacaatacgggtctcgcccaccgccatgggggcctcaccctccatgaacatgatgcgaccgacaacctcggctgtacccgccatcacgtgcacacgcgcacccgactcgagcacacgcggcttggctccctcgcgacccaaatacgtaaacgccatcataaatcgcatcgtctggccaaagcggcccgccacaccgagcatctcaccgcgatcgagcgcggcgacggcatcgcccaccaagttgagcgccacacgctgaccgggcaacgcccgcagcgtatcgccatgcacctgaatcccacgcacgcgacaggccgtacgcgacggcagcgcgacaagctcatcccccaccgcgacgggcgcatcgtgcagcgttcccgtcaccacggtaccggcgcccttgatcgtaaagcaacggtcgatgggcagacgcggtgcggcatcggtgagctcggcacgagcacggcaggcatcccagcaagcggcaacctgctcgtcgagcgcaaccagcaggttatcgattcccgcgccggtcttggacgacacgggcacaatcggcgcgccctcaaacacggtacccgacaaaaagtcatcgacatcgagctcggcaagctcggtcatctcggcgtcggccaggtcgcacatcgtcagcgcgaccaccatatgcgtaacgcccagcagctccagcacatgcacgtgctcgcgggtctgcggcatcacgccctcgacagccgaaaccacaagcaccgccacgtcgatgcccgtggcgccctgcaccatggcgcgcaagtaatgcgcgtggcccggcacgtcgaccaggccaacgatcttgccactcggcagtgccagctcgccaaagcccagctccacggtcataccgcgacggcgctcaacctccagacggtcgggattcttgccggtcaacgcctcgatcagtgccgacttaccatggtcaacgtggcccgccgtgccaacgataacgggacactctaccagcgcttgaacctcactcatcgagcaatcgccttctcaacgcacgcgacgagcgtcgatgccgccgtctcgatatcgcggtcgccaacgagcgtgcgcacgtcaaacaaaatgcgatcgtgcgaggttcgcgtgacgaccggcgtgtcgaagtcctggacaagcgagcgcttgagcgcgtcgactgtcaggcgcttgtcaacaagacgcacggccacgcacatcgtgggcagctcaacggtaggcagcgaaccgccaccgggcgtcgaggactcctcgacaatctccaactcaacggcgcacgggcaacccgccttatcgagcccggcggccatgcgatcgcggagcttgcgggcacgacgctccagatgagcctgcggaagcgtgagcatgttgagtaccggcacctcgcgatgggccacatccgccccgtccatgtaaatgcgcagtgtagcctcgagcgccgccagtgcaagcttacccggacgcagggcacgcataagcggatgcgacccgcaggcctggaccagatcgcgacgacccatgataatgcccgcctgcgcggcgccgagcagcttatcgcccgagcatgacacgatatcgagccccgccgcgaccgaagccggcgtggtttcttcgcctccgcgcaccaagatgtcgtcgggcaacagcgcgcccgacccctggtcctcgtagaacagcaggccatgcttgtgggccagggcggcaagctcccgagagcctacctcctcgtgaaagccctcgatgcgatagttggaaggatgaaccttgaggatcatggccgtatcgggtgtgatggcttgctcataatctgccaggtgcgtgcggttggtggcgccgacctcgacgagtttggcgcccgaagccgccatgacatcggggatgcggaagctgccgccgatctcgacaagctcgccgcggctgacgataacctctttgcccgcggcatgggtcgccagcaccagcagcaccgcggcggcgttgttgttgaccacgagcgcgtcctcggcaccggtgagtgagcggatgagctgcgcggcatgctccttgcgcgaccctcgcgagcaggtgtcgacgctgtactcgagcgtgctgtagccgcgcgcgacctcggccacggcctttgccgccgactccgcgagcggggcgcggcccaagttggtatggatgaccacacccgtggcgttgacggcagggcgcaggctcggcaacgcggagcggtgcgcacgccactcgatggccgaggcaaggtcgcgcttagagcgcggggcagcaccggcgcgaatggctgcgcgctcctcgtcgagctcggccgtcacggcggcatgcaccaccgcgtcgcaggtctcccccgccgccttcactaccggccactcggcaagcagctcgttgacggaaggaatggcgcgcaggcgggcgcgtacctcatcggacatgttctggctatcgctcatgtacggcctttcaaaagaaacgtggatcagtcgaatgcatcagctgagtcaattactcgctattatcctcgcgtgccgcgatcttttccacgcgaacggcgttttcctgggtgagcgcggcgcccgtcaacgggtcccaacgcaacggtgtatggtcgagcgggcccacgcccagggcttgagcgccaccggcatcggcgccaaacgaacgcccaccgggggcggccgaggtgaagatgcacgccggatgcagatagggcgtcgtctccacgcgcacgcgatcgcggcccatgtcgctcacaagctcgacgacctcgccatcggcgatacccatgcgagcggcggcatcggcattcatctgcacggcatccagatccgatccagcctcggcggcaccttgggccgcaagcctgcgcgaggtgtgcgactcaaagggacggttaccgctaatgaggcgaaacatccccggggcaggctccaccatgggagcgatccagttgggtacacgacccagaccggctcgttcccatacgtcgcttgccagcgcaattttgccgcgatccaagggaatcaccggctcgcccgtacgcgacggcaacgcaacacccgtgtcggcccagccgcgctccttgagctcgtccagattgatcccaaaaggcgccacctgggcagccgccagatcgtcagacgtaaactggaagtactcgcccatgccacacgcctgcgccagaccggcaaaaatctcccgaccgggacgcgtgtcgtcatgctgcacgggcagcacggcgttgcggtagaacacgcgcgcgtcgttgacgcccgccaccgttcccacgccgcggtcggcctccagatacgtcacgtcgggcagcacgaagtcagaagcgcgcgctgtctcggaccagcgaatatcaatcgtcacgagcaagtcaagctgctgcaaaatacccaaccaagcctgcgcattgccatagcccgcaccggggttactggcatagacgatgagtccacgcaaatcgccggcaagaatcgactgaccgatggtcgtgcacagaccgcgcaccggatcgaccagtggatagcgctcggaccccagcttgggcccgcgcggcaccggcggcgtcgcaaagcgtgcgggatcgaggtcgcccaacgcaagcggcgtgggcgggttgagggcaccgcccgcgtgtccgatgcagcccagcagcacatcgaccagacaaatcgcgcgcgcggtctgggtactgttggcatacgcgataccgatgccgccatgaaagcccgcatccaccacagcggcaggcgcggcggcagcgagatcgcgcgccgtggcgacaatctctgcggccggcacgtcgcacatcgattcggcccactcgggtgtccaagcactggccgcctgcgccagctcgtcaaagcctgtggcgtagcggtccacgaactcgtgatcgtacaggtcctcggctaccagcacatgtgcgatacccagcagcaacgccaaatcgcatccgggacgcacgcgcagccagcggtcggcaagcgcggccgaaccgctgcgccgggggtcaaccacgatgatcttcgccccgcgccggcgcgcatcgttgagtgcgtcaacggctcccatcgtcgacgaatcgacaatggaacgccccaaatacatgatgcaatcggtatgctccaggtcggaagcggggctgtagcccaggctgtgctcccaaccggtaagccggcttacctcgcaggcgccatcggcaccgtatacgttgggcgaacccagcgcatgcataaaacgaaacgcccagtagcggtcgaacgagggcacaccaagtgtcatgcccagcgcgcgcggaccatgcccgtcaacaatccccccaaggcgcgcagcgatctgcgtaaacgcctcgtcccaggaaatcgcatcgaaccccgagccatcctggcggcgacacatggggtgcacgatgcggtcgcgctcgtcaaacggcattgccaggcgatgccgtccgcgggcgcacagggcacgcgccgcgcacggatgccccggcaccggcagatcggccaccacacgcccatcctcaacatgggctgcaaaggcgcaatcggcatagcatcccccgcatgtggtcaccacggcgcgaccgtcacgctccacagcagatgccatctcgattacccctttcgcaagccaaacacaacaggcaaacagcccagcaacgagccccagacccaaaaagcctcccgcacggcaacgccccgcgggaggcccaacgtcaaacagacggcaccttacgcctcggacttcttggcgtagataaaccagtagccgagcgcgaccagaaccgcgccgcccacgatgttgcccagcgtggcggcgaacaggttaaacgcaatgcccgcagcattgagtgcatcagcgccagcgacgtcggcaccgtaaccgcatgcatgcatcacggcgcccataggcaaaaagtacatgttggcgacgcagtgctcaaaaccgcaggccacaaaggcggcgatgggcagcagaatgcccacgaccttatcgaccacggtcttgccggcggtaccgatccacacggccaggcacacaaagatgttgcacaggatgccgcggaagaagatcgtcacccagtcgatcgtcaccttgccggcggcgacgctcaccatggaattggcgaccgcctcgccgttgagcttgtaaatgccggccatatacaccaaaaagacgatgaacagagcgccgacaaaattgccgacccacacgacgacccatgccttgagcatctgagccagggagatctttttgctcttgagcgcgcagaccataagcgaattaccggtaaacagctcggcgccgcacaccagtaccagcaccaggcccaggcaaaagcacagaccgcccacgacgcgctgggcaccccagcccagcgtgctgtcgctcaagaacacggtaaagaacaggccaccgaaggcaataaacgcaccggcgaacattgccaacagaaaggcctttgcgaccggcaggttggccttggtcacgccggcggcctcggtcttggcctcgatcgcggcgggcgccaggcaatcgggagcgggatattctgccttggaatctgccatgtcaatcacttctttcctaatcagcagggacaagcgcacctattgctcttgtcccaagcggacaaagtgggaaaagtcgttggcggccacggcgtcgtacacggcgtcgacggcgtcaaagacttccggggacatggggttgtagaactccgtgtcgcccggctgaatccctatgaagacgatatcttcgcacgattgctcaatctcttcgatcagaatcgacaagggaagcgaatgcgtggtgaacatcgacttgcgcgcgacgtcggtcttatcgagcaggcggatggcaccgacgggcagcgccatgtcggcggcatcgaccaacactaggcgcggcggacgctcgcgcttgacctcgatgatgtcgtcctcgggcgtctgaccaccgtcgatggtgtaccaaccggcgatgggcgtgtcctccatctttttggagagcacggggccagcggcatcgtcggcgcgcagcacgcttcccgccgtgagcacaatgcccgcaaacggggcgtcgttcacacggccatccacaacgcgacccattactgcaacctccccgtcagatacacgcccgacacatcgcgcacgcgctcaaccagatcgcgaaacttcattaagaacgcaacctgctgggcatgcaggccaaagtcgttatcgaacaccgagatgccggccttggccgaaccgcgaaaaccgcgatcgtcgagcagcgtgtcacaggcctcgagcagcgacggcaccgccgccttgtcgagctggcactcgccaaaggagcggatggcctcgaacttggtcttggcctccccctccggcagcgcgtcgataagcgtatagaacacgttcaccggcaccgacaggcgcggctcaaagcagtcgagcacgccggtgtggtggcccacggcgagcgtgtagtacagcacgtcgcaggcctcctggggaacgtcttcctcggtctccacaaacttacgcgtgagctcatagaagaccacctggtcgggcgtatggcccaggcaggggtcggcgacgccctcggcggcctcgtcgcttgcgcgcgaggcatcgccaaaagagccgccgagcatgccggggcccgcaaagtaaccagagcggtccgtgagctccatctagcgacctccggccagtaccagatcctgtaacgccgagtacacctcaacgcggcgaggatcatcctgcttgtcgatgagcagcgccatggcaccgcggatatcgcccttgggcgcgccctcgagcgtatccataaactcgttggccaagtcgcggccgtaacggtagccgctcatggcgcgagcctcgcgctcgatggcaacgcgcagcttgtacggcacgccggggtgcaggatatcggcctgctcgccggcggcctccaccgtggtctcggcatggagcttttggtccagcaggccaagtgccatggcaaagccgtagacggtctgcgcggggctgggcgggcagccggggatgtagacatcgaccggcagaatcttatccgtaccgccccagacgcagtagttgtcgtagaagatgccgccggtgcagccgcacgcgccataggacactacgatcttgggatcgggtgcggcctcaaaagcgcgcagggccggcatgcgcatggcacgcgtcacggcaccggtgtacagcagcacgtcggcgtgacggggcgaaggcacgaccttgatgccaaaacgctcgacgtcaaagacgggcgtgatggaaccgaagatctcgatctcgcagccgttgcagccgccgcagtcgacacggtagacgtacaccgagcgcttgatcttcttaagaagggtcgccttggccttctcgatgctctcgtcgagctcgatcttggtcgggcggtactgaagccgctcgggcaaaagcgtgggttcggccatggttactcctccttcgtttcaaaatccatgatgatgccctcgaccggtgcaggaccggcggggatctcgggcgcatcggggttgagctcgcggtcgatatactccgggttcacgccgtggccgcccagatactccatgccggggccctggggctcaccggacgcaagcgtctcgttggcagccatgccggcagcgttgccggtctttacggccgaggcggcgcgcagggcgtcgagctcgcgcttgcactcctggcacataccgacggtacgggcagcctgctcggcctccatgccgccggccttttgcagcaggcgcttggcgtagtcgatctccttgtgcggggcaaacggcttgccgcagcgcgaacagtgctcgagcgtgtagacgctcttgctggtgaggtcgtccttgctcatgacggccagctcaaactcctcggtgagcttgatggcctccatggggcaggcttcctcacagcggccgcaaaagatgcagcggccatagtcgatcgaccaggtaatggtatcggccgcaaggtcggtgtccatgcgaatggcatcggccgggcacgccacgccgcaggcaccgcaggcgatgcagagctcggcattgtgctcgggtttgccgcgcatgtccttgttggtagggaacggcgcaaacgggtacttgaccgtcgcgtcgccggccttggcgttaaccttccaaagcttcagcatattagagcgcctcctcatcgagcggagcggccatggtgccctcgcccgcaagcggcgacttgtcgcgccagacgttctcgaactgctccttgtcgagcacatggtcgcgcttggcggcgacatcggtcaccgtcacgcggtcggtgcaggagtagcacgggtcgagcgagccgacgatcagcgccgcgtcgcccacggtgttgccgcggaacatgtagcgcaggaccggccagttgctgtacgtggcggccttggcgcgccagcggtagcacttctggttattgccgagcatggcccagtgcacgtcctcgccgcgcggcgcctcggtggcaccgatggcgtacttgtgcggggtgtactcccaatccgtggtgaggatggggcccgacgggcagttctcgagcatggtctcgatcatgtcgatcgaatcgtagacctcctggatgcgaacggcggtacggccgaaggcatcgcaggtgtcggccgtggcggcgtgcatcttttggatgtccggatcggcgtagccgtcgaagggatggtcaaagcgcacgtcgcgggcatagcccgagccacgcatgagcgggccgaccggcgagaagtcgcgtgcgatcttgcggtccaagatgccgatgccactcgtacgctcaatgaagttgggcgtggagagcaagacgtcgacgagctcctgaacctcggagcgcagctggtggatggtcgtgagcgtggagagcttctgctcggccaaaatgtcgcgacgcacgccgccgatcacgttgaggccgtaggtcttgcggtgaccggagagcttctcggccaggtccatggacttctcgcggacgcggaagaactgctggaagccggagtcgaagccggtgtagtgcgatgcgaggccaatattgagcaggtgtgagtgcagacgctcgacctcgagcatgatggcgcggatgtactgggcgcgcggcgggacatggatgccctgtgcgcgctcgacggcctcggcataggccaccgagtgggcgcagccgcagatgccgcagatgcggtcggcgaggaacgtcacggcgtcatagttcaggcgcgtctcggcgaccttctccatgccgcggtgcacgtagaacagacggtagtcggcgtcgacgatcgtctcgccctcaacgaacaggcggaagtggccgggctcgtcggaggtgatgtgcaacgggcccatggggacaagcgtcgtctccttgcccttggtatcggccaagaactcgtagttttccatgtcactcgcgggagcgggacggaagcggtagtccatggagtccttgcgcagcgggtacaggccgctgggccaatcgtcgggcagcaccaggcgacgacggtcgggcagaccctcggggatcaggccaaacatatcgcgcagctcgcgctcgccccacacgcaggcggggacgaacggcgtcacggacgggaacgtcatcttggcgggatcgacctcggtgcgcacggtcacccagccggggtcctccccctccatggagatgacgtagtacacggcgtaacggccgcacaggctgcgctcatcgttgccgatgatcacgggaatccagccgtagcgctcgtagtacaggtagtggacggcctcgggcagcttgtcctgcttgacggtaatcgtcagctggtcctcgcactgccactcaaccttctcgatgcagcccggaacggcgcggcgcagggcctcgacatggctctcgcagcgacgggcatacaccttgttctcagtttcaatcattcgttacttcacctcgctctgagcggtctcggtaccgaacacagcgcggtacatcggcgtcgcgtgaagttcctcggtgctctgctcgagcacgatgccggtcgcggtctccacaccgtgcacgaggggcagcggggtggcgatgccaaaccacaagatcatgacagccaggatgatttcgggaataagcatgagcgccggagcctcatgcttgcccatgccctggggcgcatggccgaataccgacttgagtgcgatacgggtgagcgcggagatggccacggtaagaccgagggcgaccacgacgaccagccacatgggaccggcggtaacaccggcgacaaaagtcaggaactcggagataaacatgccaaagggcgggaaggcgccaagaccgagcagcgccaggacggcgagcgcggcggttgcgggggcaacctcgacgacaccctgaatcttggccaggctacgcgtaccaaaggcgtgctggatgttgccggacacgcagaaggcaagcgtcttggtaaagccgtggaacacgcagtgcagcagggccgcggcgatacccagcgggccaccgatacccaggcacagggcgataacgcccacgttctccacagacgagtacgcaaagcggcgcttgaggtcgtcctggcgaaacatcgagagtgccgccaccaaaatggacagcgtgccgacgatcagcagcaaaagctgcggatactcggcgcccacggcctggatggtaaagccgtagaagcgcatgatcacaagcatggcgcacttaagcagcacgcccgagagcagggccgagacagggctcggggcctgggagtgggcatcgggcagccaagtgtgcatggggaacaggccggccttggtgccaaagccgatcacgataaacgcaaaggcgaggcgcatgagcgtcgggtcgaactggtcggcatacggcagcacgcacgacaggaacgcggcctcgtgggcgttgggaatcacgtcggcggcgttggcgtagatcagcagcgtaccgaacaggccaaaggccacgccggcggtgcagaccatcgcatacttccaagaagcctcgagggccgtcttgttcttgtagatacccacgaggaacacggtggaaagcgtggttgcctccacggcggcccacgtgaggatcatgttgttggacaggcacgcgagcagcatggtgaacacaaacaggctaaacagcgcaaaatactgcttggcgcgctcggcgggcatggagccctcctcgatatcggcctttacatagggcagcgagaacagccccgtaagaaaaccgataaagccgatgagcagcacaaagatggcgcccagcgaatcgaggtggaaccacaggccaagagcgctcgcggtttcgccgctcataaggacgtcgccggccgtcataatcgacagcaccaggacggctgcgacggagaccaggttgagaccggcaaacacgttataggacgtgttcttgggcaaaaacgccatgaccagcgagaacaccaaaggagtcgcgagcagggcgagaatcaacgtttccatggactaccccctcagctcggacaggtcgcgcgcatcgagcgagtgggagtcgtcccaaatgcgacgcacgacgatggacatgatgatgacggcaaagatggcgtcggtggcgataccgatctcgatgatctcgggagcggtgggggccaaaagcgcgagcgtcacgtggctgccgttttccataaggcagtatccaaagatctgcttcatgatgttgcgctgcgagatgatgcaggtgaggcccacgaagaagtgagcgaagctaatagcgagcgcaggcgttgcgacctcggccgtgggcaggctgatctgcgtcacaacggcaaagcagatcgcgacctcgacggcgatgatgcagatggcccacgcgggcttaaggccggccttgagcgatgcgtcgctcggctcgcccatcttcttgtatgcgcggttgaggatgtaagggaccaggacgaccttagtgataaaggcagatccggcccacattagcagctcctgcgcaccggtggtgacaccgagcgtggcgagaagccccacgagcaccagcgactgcaccgcataccagcgaatggcgtgcttgatgttcttggagacgaccaccatggtggacgtgacaatcagaaggccgccaaggatgttgacgatcgaataacccatgtcgttctacctcctaaccgatccagctggccgaaagcgggccgctgacgatgaccatgatgatgagcacgatgaacacgaacgccatcgcgcggggaagcggggctcccgcagcgacctcttcgctcggctcgccgggcaggcaatagcccatccacttgaggaaccaggcaaaggtggcgacggtctcggcgaccatgatgcacacgagcaccaggatcgccacgttgccggcacccacagaaaagccgccggcgatgatctggaacttcgagaagaacgtgttcatgggcggcacgccggcaatggcgagcgcggcgacaccaaagcccacgcccgagatcgggtacttctttacgatgccgcgaagcttgggcagcatacgcgtaccgagcgtaaaggagaacgaaccggcgatcaggaagaacagcgtcttggcgaaagcatggttaaagatgtggcacacggcgccatcaaaggccagatggctgccaaagaccgaaaggcccagaccaaagaacacataggagagctgagcgatcgtggagaaggccagcaggcgcttcatgtccttttgcggcaggtacataaggaaaccaaagagcatggtgaccatggcgtcgataatggcgacccagcccacgatctcgggaatctcgccggcagagacgagtgcacgcgcgaacacgcacacgccgaccttgaccatcgaggcgccatgcagataggccgaaacaggcgtcggcgcctccatggccgaaggcagccacatgtacatggggacctgcgcggacttggcccaagcggcaaagagcaccagcagaaggacgatagccttgagcttggcgtcgaggccggcaatcgcggtgatggcgaaggtgccggtgtgggcaaacacgatggcggcgcccagatacaggccgagcgcaccgatatgcgtgataatcagggccttcatgccggccttcttggccgtaggcgacatgtagtagctgatgaggccccaagagcaggcacccgtgatctcaaagaacacgagctggcccaaaagggtcgagctgtacacgaggccggccatggcgccgatgaaggtcgcgaggtacgcgtagaagcgacgacgtggtgcgtcgggatgctcacggttattctcgctcatatagggaatcgaatagatcacgacaagcaggccgatacccacaaaggcgggcgcgagcagcgtgctcatgcgatcgaaggtgaatcccatgacgagggtctgcccaaacgagatcagggggacctgcgtgtcgggcatgccggcaccagcgaaattcgcggcgagggcgatggtgcagaccgtcgagacggcggcacccaaaacgctgaaccacttggcgtacggacgggggaacagggcgacgagcaccgaggccaccatcggggccgcgatagcgaccaagccgagaagggacagactgactgcaaatgacattgtttctcccttctcctacacgccgacgaccacgaagacaaacgccagaacggcgatgcccacgacggcccaggtctgattgccaagcaccttaaaacgcgagcgcgagcaggagttttcgatcacgccgcatacgacaaagtcgatcaggcacttcaccaggaagatgaccgcgcccagaacggcagcggcgcccacggtcgctggctcgccccaggggacgaagatcgcgcagaaccaggcgacgaccaggacctgcttcatggacatggcgagcttggccatcgcaagcgacgggccggaaagctcggcgagcggaccttcctgaagctcctgctcggcctcggcctgatcaaacggcagcttgccgagctccatgtagcaggcaatcgcaaaggcgatgccggcgaggatcacggcgaccggcgcgtctatggcgcccgtcatgatgtgctggcccatggtggcgatgtcggtggaaccgcaaaccagggcggcggcaaacagcgccagcagcatggacggctcgatgagcacgctcatgagcagctcgcgaacgccgccgataccggcgtaggcgttggatgaatccacaccgcagagggcgaagaagaagcgggcgagcgccaggctgtacatgatggtgatggcgtcaccaaagaccgggatggggctttgtgccgtaaagagcggcagacccatcgcgagcataaaggcgacggcgaagaacagcggcggcataatgcgcagcgcaaagctcgcgtcctcgctctgggactcggggcgcgcaaagagcttggccaggtcgcggtagtcctgcatgatgctggggccgcgacggttgtgcatcttggcgcggataacgcggccgagaccggagaagaacggcgcgacggccatgacgaccacgccctgcagaacggcaagtacgatgttgttcatgctctcccctccttaacccatttgcacggcgagcacgaggaacaccacgagtgccgcgacgatgtagcagatatagatgctgtagttgccgccctcgagcttagtcgcgaggtcggcgagcttctcgacacccttatgcggggcatcgacgagaaccttgtcgggtacgggctccacagcctcggccacaccggtgagcttctggaagaagcgcgcgatggaccagcagacggccgtgcagcggtcgcgcagcgtgtagagcggctgcataaaccaggacacctcggaggcaaaggtcgtggccacgacgggcatatgctcgttgggagcatagccgcatgcccacggctgggacttctgcaccttaccgacggtcttgagcttgcgatagccgcaggcaaggccgacgagcaccacgagcgcaatagcgatcgcgggcgtggaggtgacagcgccggagtactggttcatgagctccatgccctcggcggcaaacacgccaccgtacggatgcagcacggacgcggcgacatcgaccagcacgggagcgatcacgggagcaccaatgcccagcacgacgcagatggccgcgagcaggccctgcgcaaacaccatgggggcgggaacctccttggcattggccgcggcctcggagcggggcgcggaggcaaaggaaacgccataggccttgacaaagcacgtgacggccagcgcgccggtaatggcaagcgcgacggcagcgaacacggccacgatcatgacggccttgtcaccctgcatggcggcattaaacagcgactgataggtaaaccactcggacacaaagccgttgaagggcgggatggccgagatggcaagcgcgccaacgaggaagcagatggccgttgccggcatacgacggaacaggccgcccatcttctccatattgcgcgtacccgtggagtacagcagtgcaccggcgcccaagaacagctcgcccttaaacatcgcgtggttaaacgtgtggtagagggcggccatcagagccaggacggcgatgccgaccgagttgagcgccatagcggccatggaggcgccgacgccgagcagaatgatgccgatgttctcgacggagtgataggccagcaggcgcttgatgtcatgctcctgcagggcgaaggccacgccgaggaccgacgagatcgcaccgaagaccatgaccataaggccccaccagacctgaacgcccgaggcggagagcaggtcgaggcccaccttgaggatgccgaagataccgatcttgatcatgccgccggacatgagggccgacacgttggacggcgcctcgggatgcgccttgggcagccagccgtgcagcgggatgataccggccttggcgccaaagccaaagaaggcgagcacaaagcacacggatgcgaccgcggggctaaactgcgtagcgcggaaatccgcaaaggcaaacgagccaccggcgaagttggtcatggtgaggaagctcgccatgatgagcacaaagcccacgtgcgcgatcacaaagtagagccaaccgccatggatggagttctcgttctcctcgatcacgaccaggaagtacgaggtcagcgacatgagctcaaaggcgaccaggaaccaaaacacgttgtcggcggtgatgacgagcatcatggacgccacgaaggtgttaaagaagaagccggcgcggccctttttgcccgggtactcatcaaagtagttgagaccgtagatcgaaccggcaaacgcaagcaccgagatgagcgccacgaacaggccggacagctgattgagcagcagctggaaatgggcaaacgggaaaaacacgatggtatcgaccgacgtgacattgcccagcacggcctggataccggccacaaacgaaagcaccgcggcgacggcgccgataaggcagccggcggtcttggcggcgttatcggccttgatcagcagaaccgaggcgagcgcaccgatgcacgagacggcaagcgatgcgataaacaacgtcatgctatccattgtttacgctcccttctgctttctcggacaggccctgggccacagcggtaacgtcgacgacgggaccgttttcgatcgagcgcaggcgcttggcctcgtcgagctcgcgatcggccgcgccgcccatgacggtcagtgccttggtggggcacgccgccacacaatgcgggccgtccggatcgaaggcgcacaggtcgcacttgacagcgcaggtgtactggccaggagcccacgtaagcaggctgctcagggacttaggatacgaaggcgtcgggtcgcacatgcctgcgacaccggcgatagacgtgccatcgggatggatggctccgaaggggcacgcgatggcgcacagcctgcacccgatgcactcctgctccttgacgtggatgcgatcgccatcgtgctcgatggcattcaccgggcaaacctcagcgcagggggcaccctcgcaatggtggcaggcaagggcggccgaaataccgccggtcttcacgagcgccagacgcggcgtatcctgaagaccctgcatccggtgggcgtcggcacaggcggactggcatgttccgcagccgatgcacctctccgggttgatgtcgatgaagcggttcatccccacttcctttcaaaataacgggccgggctcccgaacgtacgggacgcccggcccaaaaagccaacgagaacgggactacacgatttggttcacgtgcgtctcatcgtcgaacttggcggcgccgggctcaacgtcctggggagcggcggcatccaccagagcctgcttgagctcggtgtactgacgctcgacctcgccctcggcccagacctggtcggcgatagcgtcgacctggcaggcggagaacttgtcctcgggcgtatgcgagaccgggtcgaccttgtgaatggtcagctcgttgcacttgccgatccaccactggtaggtcatatagaccgtgcccttgttgatgcgatcgctcacgtcggcgcggctgtatacctggccgcggcggctgtgaatcgagacgatgtcgccgttcttgatgccgcgcgcctgggcgtccgcgggattcatgcggacaaagccgggctcgtcggcgagcagcgccagcgtcttgcagttgccggtcatcgagcggcagctgtagtggccgacctcgcggacggtgcacaggatgagcgggtactcatcgtcgggaagctcggatggcgcctcccagtcgtgcgccatcaggttggcgcggccgtccttggtggtgaacttaccaccagcgaacatgtcggccgtgccgtggtcgttcacatcggtgctcttgacgggccactgggcgtagccaccctcgggagccatcttctcgtaggttgcgcccacaaagttggggcacaggctaatgcactcgttccagatctgctcggtgttgtcgtagtgcatggggtaacccatacgcgtagacaggtccgcgaagatctcccagtcgtgacggcactcgcccttgggcggaacagccgcgtcaaagtgctggaagctacggtcggatgcggtaaagacaccctcgtgctcgccccaagaggtggcaggcaggatgacgtcggcgagcatggtcgtctgcgtcataaagatgtcctggcaaataaacagatccagctcggagagcgtcttgcgcattccggccgaatcgggctcggtctgcaccgggtcctcgccgtagttgtagaagcagtgcaccttgccctcgtcgaccaggtggcccaggtcggtgagcttgtagccctcctcgagcgggagcttttcctcgggcacgccccaagccttggcaaacttggcacgcactgccgggtcggtgactttctggtagccagggtacaggttgggcagcatgcccatatcgcaagagccctggacgttattctggccacgcacgggcgcgagaccggaattgggtttgccgatctgaccggcaacgcaggcgatggaggcgatggtgtgcaccgtcttcaggttctgcttctgctggcatacgcccatgccccagccaatgatggcagagggcttcgccgtggcgtacatctcggcagcttggtggatcaacgcgggctcgacacccgtgatgtcctgtacggattcgggagtgtagttcttgatggtctcccaccactcgtcaaagccgttcgtgtgctcggcgacgaattccttgtcgtagaggccatcgttgaccaagcagttggcaaaggcgttgaggaacgcaacattgcaaccgttcttgatcggaaggtagagatcggcgatacgcgcggtttcgatatggcgcgggtcggcgacgatgatcttgcaacccttttctttggctcgcacgatacgccttgcgacgatggggtgcgaatcggcagagttatagccgaagaggaaaatgcagcccgcatcctccataccggggatggagcatgacatgcaacctgaaccaaccgtgtccatcagaccgaggacagtagggccgtgtcaagtacgggcgcagttgtccacgctgtgggtgccgatgcacgcacgcgtaaacttctgcatgacgtagttcgcctcattgccgccgcctcgcgaagagccggtggtcatgacagcgttaggaccatattcgtcaattatggcctgcatcttagatgcggtgaaatccagtgcctcgtcccagcttacgcgctcaagatccgcgcccttggtgcggcggatcatcgggtgcagtacgcgaggagtcaagatcttggtgtcgttgatgaagtcgtagccgctcatgcccttaaggcacagctcgctctggttggtgatgccgttgagcggttcggtacccacgacctggccattttggaccaagaggttaaactggcaaccggcgccgcagtacgggcaaatcactttatgcttctccatgacaccctccttcctttctctgctaccgaatactcggtacttatttgacaatcattgggcctgtcgcccgacgcttacgcctcgttttcgatggtggcgcgggcacgctcggcagtcagttccgccaggcgctcctcgtctaccagggtgaggcccttggtcgggcacgcctcggcacacgccggaccgccgggacggtccacgcacaggtcgcacttgagcacgaagctcttggtctgcgaacccacgcgcacgtcgcccatcaagacggggacctgcgtggtcgccacactcacggcgccaaaggggcaggccatgacgcagctcttgcagccgatgcagttgtcctcgttgatgccgatgcgatggttctttggatcaaagaacaaggcgcccgtggggcaggccttggcgcacggagcgtcctcgcagtgatggcaagccaccggtgcggagatctcgtacgtacgcgtcacgcgcaggcgcggcgcggcgatgttgccgggaatatcgtgtgcctcgatgcacgccgccatacaggtttggcacccaatgcagcgtgaagaatcagccacgactcgtttattgcccatgttgttcactccctcctgaatcccatgccggagagaccctgccgacgttgccccggaccgcccgtggtccggcatcggcgtatcgagtgcatgcggcgaaacaggcacttcgatagaattcctccaacgatatacaggttaaatatacgcagttgcagggggcaaacttgagcataggccctgcaatacgggtgtattgcaggggttttggcaggttggaattattctctagaagctataaaggtgagtgtattacatgcgtacgcctcagagatttttatgcgctctcattttggatgtactacgcttgtattcgtgtttatggttatcaacttgagtgaaataaagtaatcgttataagatgctcaagtatcggcacatgccgcatttgaccgactatattgcacgctcattaagggggccagtgatgtcatcgactcaaaaaagagccatcctgcaggtgcgcattcgcgaggaagacaagcagcatgccgagcatctctacgatgccatgggcacatcgctcgccgaggctgtccgcttatttgtcgcgcaaagcattttgatgcgcaagctcccctttcagccggtcgccgtgcgctcaaaggacggcaccgccgcctatggatcgctcaaagcatatggtgaccccaatcgccgcgccgaggagcgcaatgcctggattgaatacctagccacagaaagcgatgagtcggttttgggtcccgaggaagtagatatccatgagtagcaccatcatcgacgagaccgtcatcctgcgctacctgcttaacgacgacgaggtcctgtcaccgcgcgccgccaaggtcatcgccacgcgcaccgctcgtgtctaccccgaaatcatcacgcgcgtcgtggtcacgctgcgcgacgtctataaggttccccgcgttgagattgccgcggccatgaaaaggctgctcgatgacgtcatggtcgacgagcccaccgttgtcgcccttgccgtcaaactctttggcaagacccatatggactttaccgactgcctccttgcagcccgaaccgccatctacaacgatgatgtcgtgagctttagcaagcccatcatccaaggcatgatcgattaccgccgcaagcgccaaaccgtggccgacgttcgcgaccgcgccgccgaagcccgcagccgaagcaccgactccaccatcgacaaactccgccatcacggtcgccactaaccccatccccacctgagttgcggtgaaatacggactgatttatgcctttaaaggccacaacagtccgtatttcaccgcaacttattgaaggtggaccgcgaacgatttcgctatcgggagtctgcgtagggttttattgtcggaatgccgtaaccgcgcatcatggcaccgaacgattctacgtcgtaggtgtccgagagtttgaaatgaatgacgttgtggcccatggcgcgaaggttcgcgtcgcgcatgagggccgctcgatacgtttttgccgccgcccgctctggatcattttgagcctcgtcttcaaacttgcctagcccatgcagctctgccagcgtccatgagccgtctggcatctgccagccataatctgctagataatagccagcgtttcccggtcgcgttatctcaacttgaagctcgggcgcggcaaccccagcgagaatcatcgctgctctcgcctcagactcgccgccattgtctgacctgccgtccatatactcaaaaacgtcaaaagcacgcgcgatgccatgcagccctcgacaatttgcctgcgcatatgctcgcagctcttcgcgttcgacatcgtactcacgggccaagccatcgacataacccagcgcatagcgaaaggcgctcgatcgcgcgatatcaacaaccgttcgacacggatccgtcagtgtaaacagaccaagccgccacacttcgcccgggcgccagcgcttgtattcaacgaactcatacgtatcacgccttgtagaccgtggcagcagcacttgcactttatccagaagcgtatacgccgagccgatgccgtagagcaacgctgctgtcgctccgcaaaacacagcatccggttcaacgaccgcaatagcggatgccagctgaaagatacgatcttcaaccccaagattattccaatagaccggatccgcatacacatggttgtaaagacgaagcatgagctcttcctgcataagctcgcgcgcacggcgttcatcccaaggatcaattgttataagcagctgtccatcttgatgaattccaacggccgagaatagcatccttgcataggactgcggaaaatgtttgcctttatcgagcatggccaaccccataaccatcacggcggagagaataccattacgctatcgcatgcttccgtccgcaggccttgccaaaagctgaccaaaagcttgacgtcgcaggtcagagcttcaaaaaatatttccactctcggtagacggtcgctacgatcctcccaacggcatcaaaatccaaccttacaaatagttgcggtgaaatacggactacatgggccataaaagccgaaaaacagtccgtatttcaccgcaacttaggtggggatgtggggtccccggcacgtttacgaaaacggctctgatcccaaagggaatcagagccgttaagctatcttatggagcgggcgacgggaatcgaacccgcgtcatcagcttggaaggctggggttctaccattgaactacgcccgcaagatatggtcgggacgacaggatttgaacctgcgacatcctgctcccaaagcaggcgcgctaccaaactgcgccacgtcccgaaggtgttgagcagctaaggtctaaaccttgcgtgtcccaaagcgaaggaaattataggggagactccccgcctgtgcaagcgcagaaaccctagctcctcgaatgtgcgacaaacttgctgtggagcagaccgatcacaaacgccaccacggcaaccggcgcccacgcggctccaatgtccgccagcggcagcgcatcgaacggcagccacgcacccgcaaagaacgcgtctcgaaccgaggtaatcacgctctgcaccgcgacaacgccgccgacccaaacccacacctgcggatgcgcgtcgcaaaaaccgtgcaccaggcccataagcaccagcacgatggcaacgggatacaaggcgttgagcatgggcaccgagaacataaggatcacgtcgaggcccacgttggagagtacgcacgaaaacgccgcgaacacaaaggcgagaatcgcgaaggggcggcgcatggcctcctcggaggcctccgctcccccctcgatcacatacgtctcgcagaagtaacgcgagcagcagctgatgaggccgatgcacacgttcatgcaggcgaggaagaaaatcgcaaataccacaaccgtgccggcaaggccaaagtgcatggaggccgaacgagcaagaattgcagcgccgttggtggcgtcgggcatcacggtgccgagctgcataccggcaagcgctaggccgcagtagatgatggccatgagcacgccggcgatcacaccggaacgcgaaatctcgaaggccacgcgtttgtcattggtaacacccaactcgtggatggtctcggcgatgatgatgccgaaggcgagcgacgcaagcaggtccatggtctggtagccggtcaagaagccctgcacggcagcaccggcatcatagggagcttgcggggcggcagccggtcccagcggcgagatcacggcggcacccacgaccagcacgatgagcgcaatgagcgcgggacccgtaatgcgcccgagtacgcgcgtgataacgcccggacgcagcgtgagcgcaaacgcgacgacaaagaagccaacggcaaacaccaggcgagccgtgccgagtgaaacgccctcgggcagtagcggcaccagcatctcaaacgccgtggaactcgtacgcggaatggcaaggcacggaccgattgccagatatactgccgcaacaaagaactcgccaaacttggggtgcacgcggccggcaagctcgcgcgccgttccggcaagcgccacggcaataaagcccatgacgggcaggccgatggcggcgatgagaaagccgagcatggcgaccggcgtggcagaaccagcctgcagcgccagcagcggcggaataatgaggttgccggcgccaaagagcatcgagaacagcgcaatgccgacggtaacgacatggtcggagcgcaaaccgcgcggagcggatgaggccatatgcacacctttcgggtcgaaacaaaaacgggacgggcaaaaggcccgtcccgcaagtatatacgctctagcaggctaaatcgcgcaaagcgtcaatcgcggtgtcgacttcctcgtccgtgttgaaatacccaaacgagaagcggacgacgccctggcgctcggtccccagcgcgcggtgcatgagcggagcgcaatgggcaccggggcgcgtcgcaatcccccacccttgcatgagcgcgtccgaaatctcggcagagtcgatatcggctacgttgagcgacacaatcgcagagcgcgcctgctggtcaaaggcaccgtagagcttaatccccggaatcttgcgcacaccggcaaggaagcgatcagcgagcgcacgctcgtgggcagcaatcgcctcgaccccaccctgggcctcgataaagtcgaggccggcagaaaggcccgcgatgccgtggccgttgagcgtgcccgcctcaaggcgcgtgggccactcaagcggctgcagcgcatcgaagctgtgcacgcccgtgccgcccatggcccacggagccacgtcaatgccctccgccacggccaggccgccggtcccctgcggacccatgagccccttgtggccggtaaagcacactatgtcgaggcccatggcctgcatgtcgacacgcgccgtaccggcagactgcgaggcatcgacgatcaccagcgcaccggccgcatgggcgatggccgccacacgcacaatgtcgacagcgttgccggtcacgttggaggcgtgcgtcacaaccacggcactcgtaccgggcgtgactagccgctcgagctcgtcgtagtcgagcacaccgtttgcgtcacagctcgcatgctcaacggtcacaccccgctccgctgccaggcggttgagcggacgcagcacggagttatgctcgagcaccgtggtgaccacgcggtcgccggggcgcaccacgccacagatggcggtgttgagcgccgccgtagagttgggcgtaaagcacacatggtccgccctcgggcaacccaaaaggcgcgcgagcttggcacggcaaccgtgaatggtacgagcggcgtcgagggcacccgacgtggcgccgcgcccggcattgccgagcgagcacatcgcttgcgtcacggcatcgatgaccgcctgcggcttgtgcatggtcgtcgccgcgttatccaggtagatcatcgcacgacctcccacatgtcgatcaccgtaaagccctcggtgggaacgcccgccgcggcgagttcgccgcgcagcagttcctcatcggcaggcaacgccttccacgccaaaccgcagccggcagcgacctccccgggcacgggaatcgtccgcccgggaagaccgcgctcgatgcacagggattcacaacccatggcggccgccgtggtaggaaacgtgatgacaagcgccgggcgcttctccctcatggcaactccaaccaatacgctacgggcgcacgacgcgcacggcctgctccatcttctccacgatcacgtacatgttggtgacctcgcccaccgcaagctggtctttaatgccatagtggtcgaggcaggtgccgcaggtgagaatctcgacaccctgctccgccaggcccttcaggtcgtcgagcaccggcgaaccctcgacggtgagcttggcaccgccgttgtagaacagcatggtcgcgggcagttcctcctgctgcgtcacggcaaagataaacgccttcatgagcttgtagcccagctcgtcgtcgccacggcccatgcagtcggtgtagacggaaatgacgagcttgcccttgccggcgctggcatcacagaaggcagcgccatcctgctcgggatcggccacggcaacggcgccagaggtcgccacggtcacgtgccactcggcgtcagaaaccttctcgaccaaggccgtgcagcccttctcctgcgccatcttggagatgttcttgacggcggtctcgttatcgaccgaggtcacgactgtgccctcgccatcgagctgcttcagggctttgagcgtcttgacgacgggcagcgggcaggcatcgcccatggcattgacttcaattttggtagacatagtttttcctttcaaaagggaccgcccagaacagtaggcggtcgcataaacggttttccttaatgcacaacgcgaacggcaggaccgcccggcaccggctcgcacacgcggccgatcgtagcggcaacgcgcccctcggcatgtaaacgacgcgcaagctcatccgcatccgccgcgggcgccgcaataagcaaaccgcccgaagtctgcggatcgtacagcgcatccagcatgcccggctccaggtcatcgtcggcagctacacgcgggccaaagaagtcctggttgcggtaggagcccgcggggataatgcccagacgcgccatgtcgagcacctggtcaaagagcggcaccgcccccgacgcgagctcgatttgcacgcccgagccctcggccatctcgcacgcatgcccgatcagaccaaagcccgtaatgtcggtgcagccgtgaagctcaagtccctcggccagacgaatcggagcctcgttgagggtgcgcatcgagtcaaacatggctgcggcctcgtcctgctcgatgagctcgcccttaatggccgtggtgataatgcccgagccgatcgccttggtcagcagcagaacatcgcccacgcgtgcgccgctgttggcgagcatgcggtcgagcgcgacaaaaccactcacggacaggccgtacttgggctcgtcgtcgttgatggtatggccgcccgcgatggagcaacccgcctcgacgcacttgtcggcgccgcccgccagaatctggccggcgacctcgatgcccaggcagctcgggatgcacagcaagttcatggcatggctcggccgcccgcccatggcgtagatatccgacagcgagttggccgcggcgatctggccaaagaggaacgggtcgtcgaccatcggtgggaagaagtcgatggactgcacgagccccaggttctcccctacgcggaagacgctcgcatcgtcggaggtatcgaaccctacgagcaggttgtcgttatgcacattgggtaaatcgcccaggacctgggcgagggctccgggagccaacttagcggctcaaccgctcgcggccgtcatggacgtgagcctaatctgatcgtcagccatcgatacctcctctcatcggtcaatcattttctcccagtatacgcatgaatgcgagcctgcggcggatgcattaattgagcgcctgtgcgcgaatcgccgcgccaatcgctccggcaaagcgagcctggggcgaggtggtcaccggcgaccccagcagctcgcccaaccgctccaccacgaaggcgttctcgcacaggccaccggtcaggtagtacggggcgcccgcggcctgcccggccatggtcgccacgcgcgagaccacgctgtcgatcacgccacgtgcaatgttctcgcgcggctcaccgcgaccgatcaggctgatgacctcgctttcggcaaacaccgtgcacatgctgctgatcttggtgggctcaccggaacgcgcaaggtcggccatctgctgttgggaaatacccagacggtcggccatgatctccaaaaagcgccccgtaccggcagcgcacttgtcgttcatggcgaacttggccacgcggccacttttaagctgaatgaccttggtgtcctggccgcccacgtcaatcaccgtgccgtgatcgccaaacaggcgcacggcaccggtgccgtggcaggtgatctcggtcacgaccttgtgcgcatagggcacggcgacacggccgtagccggtcgcgatcacgcgcacgtcgtcggcagccacgtcatagtcggctgaagcgagctcgccgcgcaagcgctcggccgcatcgaccgacgaataccccgtcggcatgacgcaggtccacgcaatggcgccgtccgtctccaccactgcagccttcgcggccgtcgagcctatgtcgataccaatgccagccacggcatcctccttctatgcggcaaaacaactatccctttgccgcatttgtcctacagggtttcgataaaggcggcgatgcgggtctcgatctggcccatgtcaccgttgctgtagtcggtctcgatcttcatatacggaatacccgcaccctcgacggcctcctgcatgcgcgcgctctcaacgttgaaggtgtggcacgcctggagcacgctctctaccacgccatcgacatggtacttctcgcacatggtcagcgtgttctccatgcggccgtcgttaggcgtcatgaccgagcagttgatatccaggtagcggtcggcgatggcgcgcagaatgtcgggcgcgtccgggtcgatcatcatagccgccgtgcgctcgcccgagcagtcgtccatgcacacgaccacgccgccgttggactcgatggtgcggccaatcttgttgatcacaccgcccaccgggcaaccggtgatcagaatgcgcttggcgtccgccgcaaccgggcgctcgcccgcgtcgtaggcctcgcgcagcatggcgaccttttgctccagctgctgcgtataggcctcaatatcaaagctgaacgtaccggcaaacatagtgctcatcaagtcgacgccgctcatggccgccggctgattggcctgcagcgcaaacatctcgagctgggccgcacgcaagcggttgcgacgacggacggcagcacgcaggtcatcgtcggtaatcgtgatgccgtagaagccctcgagctcctccttgagcaggcggcactcctcgtaccagccttcacgctcgtaggcgcgatcacgaccctgcggaagatgcagaatgtgcgtgcgcttgagctcgttgagtagctcgtacatcttcttcttgccgtcgcaggtggtctcgccgatgatcatgtcgctaaagtacgtaaacgggcacttttgcgagtaggcaaaaccgtaggtcgacttgatgagcggacacagatttgccggcagcaccttctcggcctcgggaatcacctcgtcggatgtaccgcacaaggccacacttgcagcgcccgcggcatcgatgatctcgagcggcgtatagctgcacaaaaagccgaccaggcgattgcccgcctgcttgtaatccttaacgcgaataaacgccgccttgcgctgctcgttgaactcctcaaacgtggatggcaacggctgctccatattttccgacatataactccttaacaaaccttttaaccaaccaaggaaacggctttcccaggtgcccgaggttgccgtgaaaaaggagcgccgcgtactttggtacgcaagcgacggtttgaacggcaagatcgggtgcctggggaagccgccgggacgaatagtcctaaatggtttccaagaaagcctcaatcctggtttgcagttggcctgcatcctcgccggcgtagtcggtcgtgatgtgcataaacggaatgccggcctcctcggcagccttctccacggcaaacgactccatctcgtagagcgtgcagaactgcagggccacgtcgacgatgccgtcggcatgcaagtccttggccatctggacaatgtccttcatacgctgatcgttgggcgtaaagacggcgcagttaatcttaaagtagcgctcggcgatggcgtcgagcatctcttcgaccgtctcaccggactcgtcgaccaggtccttgtagtagcgcgagcccgtgcaggactcctcgcctaccacaacgccgccggccttctcgatgaggttgaacagcttccagttgggcacggccatgggcgtgccggtgtacaggatgcgcttggtccccttgggcgccacgccctcgccggcctcaacgcgctgctcgcactcggcggccatctcgttgatggctccggtcagacgcggcgtatcgtccataaaggcggcctgaacggtcagcaggctgtcgagaccgctgatgggcgccggatcggcagcgcgcgtggcagccagacgctgcagggcgcgacgcttctcgttgacggcgtggatggcagccttcaggcgctcaggcgtaatcgtgacgccgcactcgtcctcgatcttggcggcgagcttcttgacctcggccttccaggtcacgagcgtcgactcgtcgtgcacgttgggaatatccatgacgtgcatgttcttttgcgtggcaaagaactcgtaggctttcttcttaccgtcgcaggtgttctcgcctaccaccaggtcactcgactcaatgtaggggcagacctcgcccagcttaaagccggcaaagctcttgataagcgggcaggtgttgcgcggcaggtgctcctcgaccttatcggttgcccaatcggcacccgagcacaggcccacgggaatgccgtcacaggcaagcacgatctcctcgggcacgtacacgcagaacgagccgacgatcttggtggcctcgccggcctccttcttgtcgagcatctccttaatacggccgctgtggatgttggtggcgacaaaatccaggtaggacgtggacttggggcgattgttctgcgtcaggaacatatcgccgtacatctggcccacggcgcccagcagcatgtcgtggtcggcaagattcatgccgaggctctcccacatcggatggaaatcgaattcttcagccatgacggttccccctctcgaaccaaatacggataactacggtattgctgcacggtgggtggcgaaaacccagccgtgctcaaacccggaattttggggaacctgctttgcagctgattatttagttgtgcgtcgtctctcccggagccgtgaacatacctgctcatatgcggctccgagccatatacagggcgcgcacggcaacgcgacgcgaatatgtcttatgcggcatcggcgcgccctccttttctcgtcgaaggtaactatatcaacggttgtcgtcaagacgaacaccgtcgacacgcgtacgacaacgttgggatgtgagcatctcgctgtctgataattaattatcagactgataaggtttagtcatgtagaaatcggcgaacggcgaagtgaaaacaaagcggtcgaggactacctcctcgaccgcatcgcacccgcattatcggcaaacgagatgaatcctgcttgcatcaaaatgcatgcgcagagtctcacccgcctgcggcagctcttccacgggtacactcaccttattcaccttccactgcagacgcgtgggcgcatcagcacgcggcacgtccagcagcaccagccgctcaaagcgcgaatcgctcacacgggccacgtgcaaatcgtagctgttgcgaccgcgctccgcgcgattgtcaacatggaagtagctcgcacgaataccgaggtacgtcacgttatcgggaacctcatggcccacgttaaaggtcatgccccagtccagggcttcaacttcctgagacccgatcttgcgcgcccggcttgtgttcttgcagcccgtcaggcgcagcgccgccagcgtctgcggacggcggaccacgtcctcgacggagccgatctcctcaacatgcccgtcgtgcatcacgcagatgcgctggcacaggcggcacgcttcgtcgatgtcgtggctcacgtagagcacggtgcggttgcatacatcgaacaggtcgagcatgttttgctcaagcgcgctcttgagatacgcatcgagcgcgctcatgggctcgtcgaacataaaaatgcccggatgcgccgccaccatacgggcaagcgccacgcgttgctgctgcccgcccgagagtcgcgcggggtagcgatcgacaaaatcggccagaccgaaaatgcccaaatagcgctcggcgagctttttgcgcgcggcggcgtcgccagcatcctttacaccggcgcatacgttatcggccaccgtcatgttgggaaacagctgatagttttgaaacaacagggcgcattttcgctcctggggtgacaggttgatgccagccgccgagtcaaaaaaggtcacgccgttgacgacgatcttgccctcgtcgggcgtctccacgccggcaatgcagcgcagcgtgcagctcttgccgcagcccgaggcaccaagcagcgccacacgctcctcgccggcctcaagctgcatatcgagcataaaccccggatagcgcttttttatgtccagaacgagtgacatggcctatcgacctccctgcatagcgggctcatcgcgcatgagctcggccagtgcctcgcgatcgatacgcaaggcatcaccgcccgccgggtcgagtgaatcgccctgtccggcgagatctttggcctgcttacgttccgcacgggaaaggccacgctcgcggtatttttgcgaatgcgccgtgtacatgttgatgaacaggatgactaggaagctgaacgctattacgaccacgacccaaaagagggccaccgacgtattgccgcccatccattcaaagtaaatcgcaatgggaatggtctgcgtaataccggcatagttgcccgcaaagaacagggtgcagccaaactcgcccatggcgcgggcaaaggcgagcaccgtgccggcggcaatcgagggccagccgagcggcatcatgagtttggtgaagatgcgtcgctcggaccagcccagcgtgcgcgccgcatcgagcatttgcgtgtcgaggctctcaaaggcgccgagcgccgtacggtagaccaggggaaacgataccaccacggcagagatcaccgccgccggccacgtaaagacaatcgagacgccgtgcgcgataagccactggcccaccccggtcgagcggccaaacagcataaggagcagaaagccgcagaccgtgggcggcaacaccatggggatggtaaagaccgagtcgagcaggcccttgatgcgactcgaggtgcccatggtcttccacgcggcaaacaggcccagcgcaaaggagatcagcagggcaaggccgctcgttttaatggacacccaaaacggtcggtagtcgatgccgcccaataaggaggccagagaggtcaagggcccctgctcatcccgcaacacgacagacgatgcttctaccatttgagcgctatcaagccaacgcgcgccgcctttggcatcacccgaggctgatgcaatcaccacatagcggcccccatccgcaccgcgctcgtcaaagccataggtatacccgccggcatcaaacgttgtttccgccgtgacataccaaggaagatccacgtcccctagctgcgcacctcccatacagtttgcgctgtcgagctcacagacgagggccttgagacccgatacgcactcgttgttctgcggatccaatccatacctctcgatcgccttgggcgatatccacaccacaacgcgatcggcagcaggcgccactacaaggtccacgtcctcgtcaacgggaaaccggtagccctcaggctggccctccatggcacgagcggtccccttggccaaccgctcaaaaccctcgatcccataggaaagcccatgagcagtcgcagcaacctgggccccgtcctcagcgtccccagcaaacgcaaatcccggcacccagcaaagcgcgaaggtcaaagcacaggcgacaaggatgcggaatctattaagcacgaaaagctccaagcgaatataaggacggagtgagacacaaaacgatggaattatcgcgccaagccgcactacgcggaaagctcaaagccgtacttagcccaaatcttctgagccttcctgttggacagacagaagtcgatgaacgccttggcttcgtcggcgtgctcagagctctcggcaacggcacccggatacacgatgggcttgtgcgaatcctcgggacacacaaaggcctcctcgatgccgtcgtagcggaagatatcggagctgtagacaaagccggccacgcagtcgcccgtggacacataggcggcggcggtaccaactttgtcggccagggccaccttttcggcgatctcgggcgcatactcgccgtcgtcgccctcggtgccggtgtagaggcccacggaagccagcgcctggttggcgtacttgccggcggggacggtcttggcgtcgccaatggcgatcttaccgtccaggttcgcgacgtcggcgatggcctcgaccttggtgtcggagccctcggcgcgaatgatcacgagatcgttgacgaacatgtcctcacgcgtgtcggcgtcgacgagctcggcggcctcggcgtcgtccatggtacccttggaagcggtgatgagcacgtcgacggcggcaccggcgcgcatctgctcgacaaggtcgccagacgccttaaactgcgtgtcggcaaaggtggtgccggtctggtcggtgtaaagctcctgaacctcgggcagagccttctcgagcgagttggcggcaaagacctgcagctcgacagccttcttcttagagaaagacttggcggagccggcatcggaaccagcgggctcggacgtctttttgcccgagcaaccggcaaggccaaggccggcggcagcagaaagcgagacgaaaccgcggcgtgaaaccatatcgaacatattcaaccctttcggatcttgtgcccgggtaccccaccgcgggctttaatctgcaatcagattatacttctgcgcgaataatgaaagtgagaaattattctcgtcagagaatatagtttcgaattaccgtgcacctcggcgtcgcttcggcggaaaacaaaggcggagcagccgttcaggtcgccccgccgcaggtaaaccgcttagttggtatgtccgccgcccgctgtcatctgagccgcatgctccagctggtctgctatggcctcccagctttcgcgggcggccttcgtagaaccgggaaagtttacgacaagtgtatgacctcgttgcatgcaaatagcgcgcgagagcatagcgcggcgcgtcttggtcatcgaatacgcacggattgcctcggcaatacccggcacatcgcggtcacagacggcacgcgtcgcctcgggtgttacgtcgcgcatcgaaagccccgtgccgccgcaggtgagcacgacattggcgtggcactcatcggcggcttccgcaatggcatcaccgatctcgctgacgtcgtcacgcacgaccacatgcgaggcgaccgtccagccctgtgccacgataagctcctcgagcgcagcacccgcctcgtcctgggcaagatcgcgcgtatccgagcacgtcacaatcgaaatcttcaactccatagcattcctcctatagcaccgtgccctcaggcaggtcgacgcgaacaacgtccacggcatctcccgccttgagctcgcacggtccttcgtcaatacgcaacaggcagttcgcacgctgcatagttccaagcagcgccgaattctgtgtcttagcctcggtcaccaacaactcaccggtctcggggtcgcgcaaaaccgtggcgcgatcgaagaagcggcgatgctgtcgctttttcacgccgtgcgtgagcgtcgcctgctgcacgggacgcgtaccctcggcaaagccgcgcatcttgcgaatcgccgggcgggcgagcatctcaaagcccacatacgccgcggccggattgcctgaaagccccaggtagggcttacccccgagcaagccaaacgtgatggccttgcccggacgcatcgagatgcggtcaaacagcacctcgccctcgcgccggacgagcgccgtcacatagtcgtaatcgcccgccgaggcgccaccgctcgtaatgacaaaatcgcactctcgcgtggcgcgatgtaccagctcggcaatcgcttgctcatcatcgggcgcgatgccgtagaacacgggctcggcgccggcatcgagtgcctcggccatcagcgccgaggagttggaatcgcgaatctgaccacgcgccggtaccttactcggtgcgaccagttccgtgcccagcgagatgatgcccacacgcggggcagcgtgcaccttcacgctcgcgtatccggcgctcgccagcagacccgcgcccgccggagccacgacctcgccggcgtgcatcacaacatcgccggcatgggcctcctcggcagcagagcgaacgttctcccctaccttggccggcgccgaaaagcgaacgtgcgagccctcgttgccgtcaccgtcgagcacatcgacgatctcgtacttcaccacggcatcggcaccctcgggcaccggcgcgcctgtcatgatgcggaccgcctcgcccgcaccgattgcgccctcaaacacatggcccgcggcctcgtgtccgataacgtcgagcgtcaccggcgcctcgccagatgtctgcaccaagtccgccgagcgcacggcatatccgtccatagcgctgttggcaaacggcgagatatcgatatcggccaccgcgtcctcggccaagggaaaaccagccgcctgccacacgggaatctcgacgagatcggtcggagcaacgtgcgacaggacaatcgactgtgcgtcctccagtggaatgagtttctctgccatatgcacctcttaatgccacggcgcacaacaggggcgccaattctttatgcttgtctcagtataatcccccaacgcacgaccgcgactcggcctgtacccgcaaatacacctgtcggttgcaggccgcgaaacagaatggaaaccaacccaccggctcgtcgcgtttaccgcgttttataatgcttgcgttgcaacctaaaagaggaacgtatggctcataacgacaaacccgaaagcgcaaacaaagcgcaggatcattcccagccgctcgacgacggcggctttttctcccttaatgacgtcatcacggcaggcaggcatcaacttacccgctccgagcatctcttggctgccgacacgcgccgcaacgcccgcaacctacttgcgagcgctaagttgctcgtactcgtcgtcatcgtctcgctcgccatgggcgttgccgcttgggcgtttttggcctcgctgaatatcgcgaccgattatcgcgagcaccacgtgtggatttacgcgttgcttcccgttgtgggcgttgccaccgcatgggtgtacaaaaaccacggccttgccgccaaacgaggtaacaacctggtcatcgactccgccctgggcacacgccttatccatatgcgcatggccgtcctcaccttcgtctgctccacactcacgcacctaacaggcggatcggccggccgcgagggcgccgcggtgcagattggcggcaccatcgccagcaacatctcgagcctcgcccacctcaaaaagcatgaccaccacgacctcatgctcgccggcatctcgtcggcctttggcgccgtattcggttcacccctcgccggagccttctttggcatggagatgtgctttatcggcaagatcgactacaccgcgggcgtctactgcctggtcgcctcgtttaccggctactttacatcacttgccctgggtaccgagtacgaagcgaatgtcatcgccagcgttcccgctatgacgcccacaacggtcgtcatcgttgttatcagcgccattatcttcggtctgacggcacgcctctttgcctggtcagttcgaaccgtcaagagcctgtacggtcgctttatcaccaattatcttattcgcgcactcataggtgcactcgtggttttggccgcctatgccctcctcgacgcctgggactacgccggcctttccacgtggctttccggcgccggatttgccggcaacaccaccctggcggacgcagtcatcaagttggtcgtcacagcgctcaccctgggcgccggcttccaaggcggcgaggtcacgcccctgtttggtatcggtgcggcgctcggcggctggatcggttgcctcgtcggaatcgatcccagctttctagcagcgctgggcatgctcggcgtgttctgcgccggccttaacgtgcctatcaccacctgtatgatggccatcgacctgttccacggcacggcagccgggttctttgtcatcgtggcctttatcagctacctaaccgccggacaccgcggcgtgtaccccgcccagcgcatcatctcgcccaagcgccgttcgcttattgtggatgagggcggtacggtagcggatgctatcgagcgccacaacgacctgatagagtagacgtaagtattcgacgtgcagccacaatcgggggcaattcgacctgagcgcgaccgcaccgtcacgtcatacgccgggagtcgccccatgcacgcaactgattttggcctcacgctcatcatcgccaacccagccgcccagtcgggtgcggcgcgcgaagttgccgagcgcctgcaacgctttttggatatgaccgcgcgcgcatcccagtttgacctgatgctgaccgagcgcatgggacacgccaaggagctggccgcacaggctcagggctatcgcaccgttatcgcccttggcggcgacggcgtgattcacgaggtcgtcaacgggcttatgacgcaagaggaggacacccgccccgctcttgccatcctacccgtgggctccggcaacgattttgcccaaacgctcggcatcgacgatttctccggtaaggattttggcgcgctgctcacctgcgagctgcagcgtcaggacatcgggcgcattcgcttatggaaccccacaagcggcagcggcgaggctaccgttgagtactacgaccagacgctttcggtcggcatcgatgccgccatcggccttggcaccaccgagctacgcaaaaagacgagcctcaccggcgcgccgctctacactctttcgggacttgagcagtttggcctacgctatcgcaattaccccatgacagtcagctttgacggggcgcccgccgagcgcgtaagggcgatcatcatggcgattcagctgggtcctacctatggctcgggctatcgcatctgtcccgacgccgacccctgtgacggcatactcgacgtctgctacgcctgcggccccgtccctcgcgcggttgccctgcctatgtttctttcggccaaggacggccaccataccaagttgccgccggttcgcatgcgccgctgccgccatgccgagctcacctttgaggagcccgactaccccattcaggccgacggcgagcccgttgtcgcctcgcgcatcgaggtcgacatcctcgccggcgccctccacgtctggcaccccacccgctaaccccacctaagttgcggtgaaatagggactgtttatgtagctaaagccgcaaaacagtccctatttcaccgcaacttattgataagatcattcctccccgcccggcttgcgacggttggcctttttaatggcgttgaagtgcttgtcattgagcctgcgctggcgagagcgctgaggcaccttggtctttacgcgtcggcgcggcggacggccacgacgctcaagctctgcacgcagcttacgcagacagcagatacggttctggaactggctgcggctctcgcgcgccgtcacggtaattcccgaagggatatgtttcatgcgcaccgccgaatccgtcgtgttgacgccttgtccgcccggaccagtcgcgcgaaacacctgcacctcgcaatcgcgcgccaactcctcggccgacatctcggcatagcgcgcatactcgcgccatcccatcttgttctcgtccatatcaacacctcccctcatacaaaaaatgtgacaaagggaaagccctttgtcacatcgcataccaatcgcttgtgttgcgcgcttaggcgaaggtgatctcgccggtctcgcagtccatatcggcaatacgggccaggctctcgacgcggaagccgcgctcgcggagcttatcgccgccgccctggaagcccttctccactgcaatgccaataccggacacctcggcacccgcagcctcgcagatcttgataaggccctcgagcgcgcagccattggccaagaagtcgtcgatgatcaggaccttgtcgccctcagacaggaagcgcttgccaacgatgaccgggtactccttctgcttggtaaaggagtagatggtcgtggcatactgctcgccgtctaggttgatggactgtgccttcttggcaaagaccaccggcacgccgccaaaatgctgggctgcaatgcaagccatgccaatgcccgaagcctcaatcgtcagaatcttgttgatctcgacaccctcgaacagacgggcccactcggcacccatgtggtcaaataactcaacgtcgcactggtggttgaggaaggcatcaaccttaaggacgttaccggcctttacgatgccgtcatggcgaatacgatcctcaagctcctgcatggcgcaaccccttctcgcggcaacgataccgcgcgattaataaacgttgttcgatagtctaccacggaccgacccccgcccgtcccacaagccgcatcgcaccacaaaccagtctttttgggacaatgcaaatcgtggcagacagcctcccaacacgctaatggcgggcgcgcatcttcaccaaacgcaccatggcaagcgcaaagcccacagcggccacagccatcaacacatagaacaccgaacggaaaccaaacaggaacacatccggacgtcctgcaacaaaactggtcacggcctcgcccatcgccacgctcatctgtccatacaggatattcgacgccaccgtaatgccgattgccatacccgcataacgcgccaggctacccagactacccgcaaagccaagtgcctcgcgcggagccgagcccatgtacagcgagttgttggggctctggaaaatcgacgtaccgcacgacataaatgcgacgcagcacacgatcacagggatagaagagtgctcgtcgagcgtgcttactgcaaagagaccgcacacatacacgcccaggccgaccgccgtgggaccctcgcagccaacacggtccgaaaccgttcccgaaagcgggccgataaaggcattcaccattggcagcgccaaaaagagcaatccggaaatgtcagaaccaaagccttgggcgtcctgaaaatagaacggcagaataaactcggatgcgccaatgccaacgaacacgatgagcatgcaggcaaggttgatggtgaaggccgaatttgcaaagcagcgacgagcggcctcggcaaggggcatgggacgttcgccggcctctggcctaacatgcggcagcgtgtagagtcccacgataaacgagatcacgccaatgggcaggttgatgaggaagatgctctcccagggaaagcttgccaccagcatgccgccgagcacggggccacacatcatgccgagggccacaaaggtcgcgagaatacccatggcacggcctcgttcgcgcgccggaaacgactcggtgatgatacccatgttgttagccatggccgccgcgcaaccgatgccctgaacaatgcgtgccaggataagaacctcaagcgaggccgaaaggccgcacagcagcgaaccgaccgaaaagacgatgacgcccaactggaacacattcaccttgccgcgcacgtcgcccagacggccaaacggcaacatagccacgcaagtcgcaagcagatacaccgaacttaccagctgaatgcgatcgaggcccacgcccagctccttttgcatcacgggcaacgccacggtcacgacggtcgaatccagacacgacataaacgtcatgatgagcacggtaaacagaatcgcccatttgttcttgccatgggtgtcgccctcaagggcaatgtgctcgcggcgcagctgctctgcggttttctccatatccatcctttcgagtggcgcaaggcaaaaacggggccccaatcgccagcaaacagccgcgattggggtcccgcctacggaatcgaaacgaaaggtcgccgaagctttctgccagcatcggcgccttatgcgaacgctagcctagcactgctcgagtgcctgctcaaggtcggcaatcaagtcggccgtgtcctcgaggccgcacgacaggcgtaccatatcggcggagatgccacaggcgatgagctcctcatcgttcatctggcggtgcgtggcattagcgggatgcaggcagcaagtgcgggcgtcggccacatgcgtggcgatctgggcgagcttaaggctcttcataaaggtctcagccgccgcgcgaccaccgttaaagccaaagctcacaacgccgcaggtaccgttgggcatgtacttctgagcgatgtcatagtacttatcgccctctaggcccggatagctcacgaagcgtaccttgggatgactctgcaggaacttggcaacggccaggccgttctcacaatgacgcggcatgcgcacatgcaggctctcgagcgagctgttcaggaagaaggccgcctgcgggttctgcatggggccgaggtcgcgcatgagctgcgcggtggccttggtaatgaaggcgccctcgcgaccgaacttcttggcatacgtcacgccgtggtagctctcgtcgggcgtggtgagacccgggaacttatccgcatgggccatccagtcaaactggccgtggtcgacgattacgccgcccaggtaggcagcatgtccatccatgtacttggtggtggagtgcgtaacgatgtcggcgccccactcaaagggacggcacatcacgggcgtcgggaaggtgttgtcgaccatcagcggcacgccgtggtcatgcgcggccttggcaaagcgctcaatatcgagcacggcaagggcggggttggcgatcgtctcgccaaagacgagcttggtgttgggccggaaggctgcctcgagctcctcatcggtgcagtcgggagcaacgaacgtgcaggtcagccccatacggcccatggtgtgggcgagcaagttgtacgtgccgccatagatggcagagctcgcgactacgtgatcgccggcaccggccacgttaaagatcgcaaggaaattcgcggccatgcccgagctcgtgagcatcgcagcggagccgccctccatctcgcagatcttggcggcaaccaaatcgcacgtggggttctgcagacggctgtagaagtagcccgactcctccaggtcaaacaacttgcccatgtgttcggacgtgtcgtacttccacgtggtggactggtagatgggcacctgacgcggctctgcatcgcccgggcgatagccgccctgaacacacgtcgtaccgatggtctgcttgctcatatctagctcccttgcctgggttttagtttaattcggttcacgataccgctaccccgcacccctctcaacccatccccaaggtaggttatgggactaattgatcagggtcatttatctcaagccttggacatttgctcgatagataaaaatgaggcatacatgaagctctcgatgattacatgcaccgtcacgggtaccataggcgggtacaccgtgaccaaggagacaacgatgaagcaaatcgatacggcccagctcgacatcaccgcctgtcaggctcaggctgccgaataccacgcccgtgggtttaactgcgctcaggccgtcgcctgcacgctcgctcccgccgtcgggctcgacccccaggtcgcctttaccctcaccgagggctttggcgccggcatgggcggtatgaccgaaacctgcggcgctatctcgggcgccgtagccatcatgggctttgtaatgagcgacggcatggaaaaccccaagaccaagggccagacctacaagctgtcgcgcgaaatcgccaagcgttttggcgagaagaatacgacgaccgtctgcggcacgctcaagggcatcggatcggacaagggtccgctccgcagctgccccggctgcatcgacgatgccgtcgcgatcgcctgcgatgtgctaaagcagctcgccgagtaaacggcagcaacggaaaaacaaaggccggcgtgcgcttgggatccatccaaaagcacgccggccgtcgccgttagaactcggcaaattcgggagcgccgacctcaatctcctcgcgccccgccataagctcgcgaatcttagcgcaaaatgactcctgctcccccgccttaaacaccaaatgaatcgtcacggcatccgcgtaatcggtatccgaaaccttggcacccgaatcctgcgccaaacgaagcgcctgctcatactgcggataggccacatgcacgtcaacaggcacgacgcttgtcatctcaacgatctgccctgcctcctgagccgcggccaccgccgcctgcgtcgccgcggtataggcgcgtaccaagccaccaggccccaacagcgtgccaccaaaatagcgcgtcaccacgcagcaaacttttttgagccccgcaccgcgcagcacctcgagcgtcggcatgccgctcgtgcggctcggctcaccatcatcgctctggcgctcgcgcccatcgaccaaaatccacgcgggaacattgtgtcgagcgtcgtaatgacgcttgcgaaccatctcgataaaggcattcgcctcatcctcggactcaatatggaccagctgggcaataaaccggctcttgcggtccacaaactcgcccgaagcctcaatattcgattgcagagtaaaatagctgtccaacaaagcccctcaacaacaagcaaagcaacaaacagcctcaataatacggcaaagaccgtaccgataacctcggtaaaaagaacgaagccacctatgattccgtcaacgaaagcgagaacccgtcagcgcgagcaaggtgccttgaaagacgagggcattgaccttatggtcatgcccgaaggcttgaaaggcagattgccgcgctgacgggttcgcagcgtcagcaaagtgctgagcgggcctataagccgggttctgtcgtgaacggtcatttatcttgtctgcacgttaccgtgcagctccacgcacgctacccgaacgcggaccgggccggcccatagcgttcctattcgcgcttgctccggatggggcttgccaagccgccgtgttgccacgacgctggtggtctcttacaccaccgtttcagcttttccctttacgccttgcggcgcaggtgggagtcttcttttctgcggcgctttccgtcggatcactccgcccggccgttagccggcatcccgccctctggagcccggactttcctcacgcgtactgcaaacagcacatcgcgcgaccgtctggcccactcagcagtgcaagagtgtagcacaccgttgccgcaggcaatggcacaacacaagcgttcgacacgataaaccaagaaccacgccatgcagtacaatagggttgtcgatgggcaatgtcgtcagtcgagacgcgaccgcgctccgcacccctccgtctactcggtgcgttcccgcctcctccccgaggcgggatgtcggcatttttttattcaccgacaacccaatagcctgtggacagcccgggtagcatcgcgtgcatcagcagcgaaagcaaaaagggacccgtccattgcgaacggatcccttaaaacaagtgatcgtcaaaccgatttactcggcgtcggtctcctcgtccttcttctcggaaggaagcggggtaacctcgatctcgacgcccagagtctcagcagcggacttcatggacagagagatacgacgacggtcgaggtcgatctccatgaccttgacctgaaccttgtcgcccacgtgggtgacctgagaaggctggtcgacgtgcttgttggccatctcggagatgtgcaccaggccctcgatgccctcgcccaggtcgacgaaagcgccaaacgggacaagcttggtcacagtgccctcgacgatagcgccgacggggtacttcttgaccagtgcgcgccacggatcctcggtggtctgcttgagacccagggagatgcgctcgcggttgagatcgacgtcgagaacctcgacctcgacctcctggccgaccttgacaacctcggaaggatggttgacgtggttccaggagagctcggaaatgtggatgaggccgtcgataccaccgaggtcgacgaaggcgccgaagtcgacgatggaggaaacggtgccctggagacgcatgccagacttgagcttggacaggatctcggagcgctcggccttacgggactcctcgagcacgacgcgacgggagaggacgacgttgttgcggttgcggtccatctcgatgacgcgggcctcgatgcgggtgcccatgtaggaggtgaggtccttgacgcgacggaggtcgacgagggaggcgggcaggaagccacgcaggccgatgtcgaggatcaggccgcccttgacaacctcgataacctcgccctcgacgttctcgccggagttgaacttctcctcgatgcggttccaagcacgctcgtactcggcacgcttcttggacaggaccagacgaccgtccttgtcctccttctggagtaccagagcctcgatgggatcaccgagtgcaacgatgtctgcagggttagcgtccttgcggatggacagctcgcggaccgggataacgccctcggacttgaatccgatgtcaacgagcacctcgtcatgctcgatcttaacgacagtgccgttaacgagatcgccctcatcaaagtcggtaatcgtaccgtcgatgaggttgttcatctcctcctcgttgacatcgtcaagagagaaaatggacgagttctgaatctcactcaaaggtggacccctttcgaactacggggccccgattgctaggacctacagaagggtgcgacaagcacacaacgtttaggaacactcgggagccgacagatactaatgtgacgcttatgcaatcacgttcgtataggttacggggaaatgagttcgatttcaagcgtgaactgcgattttttactcgtgtggagactttttcgtaatcttatgaacacacgtctccgcaacttgacgataaccagccaggcattcggctttggggtaaagtatccggagccaacgattctagatcgatttttcgagaaaggtgcccgcgtgctcaaagcagtcgttttcgatatggacgaaacgcttctcagcatcaacctcaacgcgttcatccttcgctattttaaggatgtctcttcgatgctcgcggatatcgggcgccgcagccgcggtggcacgatggcgcgcctcggcaccatcctggtcgacctcaacgccaatcgccgcagcggcacggacaaccgcaccaatcttgagttttaccaagaagaggtcgagcgccgatgcgggatctgcctctccgatcccctcatctacgaggcgtttacctactatgaccgcgaagttcttccgtacaagaacgacgatatcattaacgcccacgccatgccgggcgcacacgccgcgctccaggccgtacaggacgcagggctgcgctgcgcgctctttaccaaccccagctttccccagggggccatcgagtgccgcatgggttggggcgacctggccgacgccccctttgaactcgtgacgcacatgggaaacgccacccgctgcaagcccgatgccacctactatctagagcagcttcaggtgatggggctcgagccacacgaggtccttatggtgggcaacgatcccaagcgcgacttccccagtcccgcctgcggcattcaaactgcctatgttggccagggaaaacccggccgagccacctggcgcggaaccatggaagacttcgcccgcgactttaacgccgtaatcgaagccttctacgaacaccaagtagccgacgaactgtcgtaggacccctcgctccaaaccaaatatcgccgcaggttgagcacaagtcagcgaaaatgcccctaagcgagcaatgtgccttgaaagaggagggcataggccttctggccatgcccgacgattgaaaggcagattgccgcttaggggcatttgcagcgtcgactggttacgcggtttggtaaaaccgcgtaactagcacacctgggttttgccgatcatgatgttgaggatctcgatgtcggtgtccttcatgcccacgcggcctacgtagcccatactggcgattgtttgctcaacggtatcttggatcaggccctcgccggcgcggaagccgcgaccctgcatggccatatcatggcccagaatcgccgcatcgacggcagccgagatcttggcggcacagctcgccttggcgccgtcgcacacgatgccgcccacgttaccgagcgtgttcgagacggtcgcgccaatctgttcgcgcgtgccaccgcacagccaggtaatcgcagcgccggcgccgcacgcagcgcaaatagcaccgcaaaacgccgaaagcgcaccaatatagctcttgatatgcacggcgataagatcggacagcatcacggcgcgcaccaggcgctcgtggtcgcaacgcaggtactcggcatactccatgacgggcaatgcgcaggtaatgccctgattgcccgagccgcacacaatggcgaccggcagcgcgcaaccgttcatgcgggcgtcggacccggcggccgcacgggcacgggcgcggcaggcgacgtcatcggcacgagcacccagcagcgtacggcccacctcggcgccccaagcgtgcgcgagaccctcggcactgatcgcgccattcagctcaatctgacgctcaacggcagcgcgggcgtcctcaatgtcaccatcctcgataaagtcgatgatggtctcgatcgacatgggcgtgtcggcgttatctgccgcacgctcggccaccacgcgctcggcgcaggcggcgcactcccccgccgacttaccgcataccggaataccgtcgagcgtatggcacgtgacattagtgtggtgatcggtaatctcgacgaccgcggtatggcccccggccgtcgcagtcaccttgatgtagaggttgggcacaccctcgacaagcgacacatcgcagtagtccgcatcggcaagcagctcggccacgcgggcgcggtccgcgtcatcgacgctctcgagcacctcgagcgcgctcttggcgtcgccgcccacggcacccagcacggccgcggcctcaataccgtgcataccgcccgagttgggcacggtcacgctcttgacgttcttgatgatgttgcccgagcaggcaacatccatatgatcgggttcgcaaccgagcgtctggctcgccagcgccgctgcataagcaacggcaatgggctcggtgcagccgagtgcacaaacaagttcgcggttcaaaacatcgcaaaacgcggcatcacgaagggaatcggcaggcataggtatctcctacttgtataacgggctgggctctcaataataattagctcttttatttgataacaatgcatcaaaaaccgcaacccaggttccggtagacggcattcaggcgcaaactgacggcattcattcatgagaaaccggtcttgttgcatgctaaagcgtttgaccaaaaaacgcccaagcgtttacacaaaagtcgcgctatcatgcagtcgaacgcggtaaaacctttagcaatctcgccgcacagaccagagaggaactatccatgaagatcggtatcggtaacgaccacgccgccgtcgagctcaagaacatcatctccgagcacctgaaggagcgcggctgcgaggtcgtgaactttggcaccgacacctccgagagctttgactaccccatcgccggctacaaggtgggtaaggccgttgccaacggcgacgtcgatctaggcatcctgatctgtggcaccggcgtcggtatcagcctggctgccaacaaggtcgagggcgtacgcgccgtcgtgtgctccgagcccttcagcgccaagctctcccgcatgcacaacaataccaacgtgctcgcttttggcgcccgcgtcgtgggctccgagctcgccaagatgatcgtcgacgagtggctcgacgccgagtttgagggcggtcgtcacgagcgtcgcgttaacctcctcaacgagatcgatcacacgcgcgcccttaagatcgtcgacgaagcctaaactattcagtgccacaagctaacagcaggggcccgctcggaacacatgtccgagcgggcccctgcatagattttggaataaaagggcgccgcggatggagttccgcggcgcccaagccacacgctaacagctttaaggagtcaaagctggtttagccaaagaagcgcttgatctcaatctcggcgttctccaggcagtcggagccgtggatcacgttggcgttgacatcgacggcaaagtcgccgcggatggtaccaggagcagcctcaagcgggttggtagcgcccatgagggtgcgcatcttagcaacagcggagagaccggaaacgaccatcttgacgaccggaccgctcgtcataaagtcgcagagaccgccaaagaagggcttgtcggccagatgggcgtagtgctcctcgacggtagcgcgctcgagcgtggtcatctccatgcgctcgatgacaaggccgctgcgctcaatgcgagcaacgatctcgccgatcttgcggtcgcgcacggcgtcgggcttaatcatgatgaaggtcttctcgatagccataaaagtagcctttcaagtaggttcgcgcgtgcccaagtcccattccggcacccgcctggactgcatcgtaacagagttttagctgcagttaaacaaaaagctgtttattgaaacgttgcaatttattaaagcgctccatatgtgtcacttctgtttcgaagcccgattagagtaccatccgaccgcccatcaactgcgccgaacagagcaggcggtcggttgccgcccgcgaacgtatccccttcacaacctgcccaaaggtcctacagaagttctcgacaagcccctcccccatagcaacaaaatacgggctcccacatcagcaggcgcccgtaaagcgaaaacgatttatcaatacatggccaaaacggcttcagccaaacctctactttgccccgtgacccatctcgacgaccttggtcagcgatccaaacacgccctcgtcagccacgagctgtgcctcggcacgctgcaactgcacggcaacggcggcaggagcggtgccgccctcggtcgtgcgcgcggtgacaatcgacgggatatcgagcgcctcggtaatgtcgcgctcaaagagcgggcttgcctcctggaacacctcaaacggcaggtcctcaagattgcagccgcgcttctcgcacatcaggaccagatggcccaccacggcatgtgcctcgcggaacggcaggccacgcttggccaggtaatcggcaacatcggtggcggcaaggtgccccacgccgcactcgcgcgccatggcatcctcgttgacggtccaagtcgaaatcattccggccataacggacaggcactgcatgagcgtatgggcggtatcgagcgcgccctccttgtcctcctgcaagtccttgttataagcaagcggcaggcccttcatggttaccagcagctgcaccaggttgccgtacacgcgaccgctcttgccgcggataagctcggcaaagtcggggttcttcttctgcggcatgatggacgagccagtggagtacgagtcggaaagcgtgataaagccaaattcggagctcgaccacagtacgatctcctcggaaagacgcgccaggtgcatcgccatgacggatccggcgtaatgcagatcgagcagaaaatcacggtcggaaacggcatcgagcgagttggggatcacgcccgcaaagccaagttcggcagccgtcatctggcgatcgagcggatagctcgtaccggcaagcgcagcggcacccagcgggcagttgtcggcagcatcaaaggcggccttcaaacgcgtaaagtcgcgcgcgaacatccaggaatacgccagcaggtgatgcgacagcagcacgggctgagcatgttgcatgtgcgtgtagcccggcagaatcaccttgtcgtacttcttggccgcatccaccagcacatggcgcagctcaagattggcctccatgagctccttggccagcgccttgacgcccaggcgcgtatcggtcgccacctggtcgttgcgcgaacgcccagtatgcaagcgcttgccagcctcgccgatgcgacgcgtcagctcgctctcgatggacatatgaatgtcctcatcgttgatgtcgaaggtaaagttgccggcatcgatatcctgttcgattccggtcaggcccttggcaatcgcctgctcgtcctcggcactgatgatgccctgggcggccaacatcttggcatgcgccttagagccggcgatatcctgcttatagagatgtttgtcgaccggcagcgacgcgccaaactcctgcgtgacctcggccacgcccgcctcaaaacgaccgccccaaagagccatggaaccgtctcctttctccaaataccaaaacaagcgtccaaagcaatgtgccctgtcgctaaagcgatttatcaaccgctagttttacacactccctgccgcgcgcggggccatgtggctaatttgcaaagaagtgacgcaccatgcacttggcgcccaacgtctccctccggatgttgccctgcgaaccatcgatccaggccttcaggctcataggaacgtcctcgacccttacagcatcgaactcgggcgcgagggcaagcaaagcatgcgcgatagcattgaacataatggatactcctcatatatataggcacagagccgccaaattgatagaaggagccccgccggacaaccccggcggggctcggactcagccgcagacgcggcatcatatatgcgggcggaacgtaggggccaccgatgttaagaagtgtcagcaagcataacgaaaggtagggaccccgtgcgcccgttatgtatcacgcggatgggccgcgcggataccaagggaaggaggcgctaggcctgggcagcagcagagctggggccctggacctttgcccacgtcttgagcgacagcgtatcgatctcgataaagccggcgctggccttctcgtcaaacgtggtgtcgcggtcgtaggtagccaggccgtagtcgtagaggctgaagggactcttgcggccgacgacatggcagttgcccttaaagaacttcagacggacagtgccggtcacgaacttctgggtatcggccataaaggcgtcgagcgcgttcttgagcgggctgtaccactggccgttgtacacggcggtggcccaatcctgctcgagcttgatcttggtcttgagcaggtcgccctcgacgcagatgtcctcgagcgccttgtgggcggtgatgagcgtcagggcgccgggaacctcatagcactcgcggctcttgaggcccaccagacgatcctcgaccaggtcaagacggccaaagccgttgtcgcccgaaatcttgttgagggcgatgacgatctcggagagcttcatcttcttgccgtcgacggcgacaggcttgccggcctcaaactcgatctcggtataggtcggggtgtcaggcgtgtcctcggggttcttggtcataacccaagcgtcatcgagcggctcattccaagggtcctccaggtgaccgcactcgatggcgcgaccccacaggttgtcgtcgatggagtaggggttgtcgttggcaccctcgggaaccggcacgttgtgggcgtgggcataggcgacctcgtcgggacggcacttcaggtcccactcgcgaaccggggcgataaccttgagctcggggtcgagggccttgacggcggcctcaaaacggacctgatcgttacctttgccagtgcagccgtgggcgacgtaggtcgcgccaaactcgtgggcgacctcaacaagcttcttggcaagcagcgggcgagacagggcggagagcagcggatacttattctcgtacatggagtttgcggcgatggctttggtcaggaactcatcggagaactcgtcgcgcaggtcgagcacctggcaatcgagaacgcccaggtcgagcgccttctgcttcttggcatccagtccggtctcttcctggcccacgttgccgcagacgcaaacgacatcgagattcttctcgtcctggagccacttgacacatacggatgtatcaagaccaccggaatatgcgagaacgactttttccttgctcatggctgtttcctttcgcccttggtagctagttagaacatcggtcagttgcaagtcatttcaaggtcatataccgtgcaatatcaggttaaatagcaaaaatcagcacatacatgccctagaaacatgcagcaatgtcgtgctaaaacccaacgacctcaaaatgactctgttgaggcaattcgccccatgcggacagagacgattgttatcgtcgtcgggaaattgcgcgctggcgtcggatggcattgtctgcagtggtgatgatctttacgaactgcatctgcctctcctttcacgtatcgccgggcgcaattcaaatatcgtaaacggtaccttttactcggtaagcggttgtttttccgtctccgttttcgatggtcgctatattacgctaaagtgcccgcagcacaagcgacaaattcaaatttctgaaaagttttttcattactttgtgaagcgtggtgcaaatacgcaccattcctgcgaaaatacgctcgactactagttgatggttataacgtctgaaacaatctcgaaacgaaaggcgcatttttatgcaaacttacgaatcggacgccaacatcggcaacattaagattctcgccgtcgatatggacaagacgctgctgaccgacgagcgtgtgctgccccagggtcttgatgagcgcctggacaagctcgccgacgccggcatcgtattctgccccgccagcggacgtcccgcccccaagctcgaggagatgttcgagggcatcaagaaccgcctcgccttttgtcccgacaacggagcgtgcgtgatctatcgcggcagctatatctataaaagcaatattgacgtggagctgtatcagcaggtcttgaaccgtgcctcggaggatcctcgcgctgtccccgtcctgtgctgcttcgacgagttctacgtgcttgcccgcgaccatcaataccacgacgagatcagcgtctactacaacacaatcaactacgtagacagctttgagggcattgatttcgagtccaacaagatttcggtcttcttccccggctacgacgccgagcccgctttccgcgagacctatagccccgagttctcggacaaactctacgtcaccaacgctgggcgcgagtggatcgactttatgaacctgggcgtcgacaagggcgccggcgtcgctcacctgtgcgagcacctgggcatcgatattgccgatgctgccgccgtgggcgacacctacaacgacatccccatgctggagcgcgtcggtcacagctttatcgtggacaatgccgaggagcacatgaacgcgcatgccaaatggcgcattccgagcaacaacgacgggggcgtactgacgctcatcgacgccatcttggcggctcgttaacgtggctcgtcggacctggccgggcgagacgggtaagtttttcgttcggtcaggtcctgggctcgctcggaaagcacattaagtgctttccggctcgtgcggaatctacgaaaaacttacccgcctcgcccggccaggtcctagggtgacttgcttgccgcctagatggcgtcttggcgtctagatacttggctgaataattatggatgaagggagttccttgctgaaagggactcccttctggtttggctgctttggacctgtggctgtttttctatttcgcgtcggcccaggttatgccggtgctggcttcggcgattagggggacgcggaggtctactacgtgctccatgacgtcgcggaccatggtggttaggcgctcgacttcgtcgatggggcactcaaagtccagttcgtcgtgcacttgcaggatcatgtgggcggcaaagccttcctcttccaggcggcggcttacgcgggccatcgcgatcttgatgatgtcggcggcggttccctgcatgggatggttcatggccgtgcgctcgccaaagccgcggagttgcgggtttttggccttgagctccggaatatgacgacggcggccgtacatggtctcggcgtagcccgtctgcttggcgcgtgccaccacgttgtcgaggaacgtgcgcacgcccgggtaggcctcgtagtagcggtcgatcatgtcgcgtgcctcggccatcgagatatgcagcgactgcgacaggccgtaggcctgctggccatacacgatgccaaagttcacggccttggcgcgactgcgcaggtcgggcgttacctcggacaccggcacaccgaacacgcgcgccgccgtctcggcatggaagtcctcgccctcgttaaaggcgcgcaccaagtgctcgtcacctgagagatgcgccagcagacgcagctcgatctgcgagtagtccaccgccaaaaagacgcttccctcgcctgccgaaaacgccgtcttgacggtacgacccagctccgagcgcgtcgggatgttctgcaggttcgggtcgctcgaggacagacgccccgttgccgtgatggtctggttgtacgtagtgtgtacgcgaccgtcaccacggcgtagcgggcccagcgtgtccagataggtggacttgatcttagacttctcacgccagtccaagatcagacgcacgatttcgtggtcacgcgcaaggtcgctcagcaccttggcgttggtcgaataatagccgcgcttagtcttcttgaggcccttggtcggaagccccatcacatcaaagagcacgtgcgacagctgcatggggctgccaatattaaaggtctcgtcacccgccaggtcgcgaatactgcgctcaacctcggtaatctgggtcgccagaccctcggacagactgtgcagacggtcggggtccacgagcatgcccgcgcgctccatcttggcaagtaccggaacgagcggcatctcgatgccatcgaacacgttggcggcattctcacgggccatgcactcgcgcaacggtgccacgagcgccagcgtcagagccgcagtacgggcggcaggcgccggagcgtcctcaccggcaccctctgcgccgcgcgccgcaggcagcgccatctgcagatacgtatcggcaagatatgcctcatcgaactcggagcgatcggaatccagcagataggcagcgaccacggtatcgaagatacgcgtggaatcggtagcgagcggatccatgagctcgggctcagaagaatcgacgggcgaaagctcgtgcaacagcgccttcatatccgggctcgccacgcgaccctccataaacagacgcgcgagcacgccggcaatcacgccgtgaacgaagttgaagccctcaacctcagccgccgcacagctgtcgccctcctcgagcgcgaacaggcccttggacgtcgccaaccacagcgtgcgcgtcagtccaaagagcgcgccctcttccttgtcgtcgtccaccacggcggcgacccactcgccggcatcaatcgcgcgggagacctcagccgcaacggcaccaagcgcgtcggcatcgccggcggctgcgcgaaccatagcaggtatctcaaccacactggaggcagcagtagccccgccctcgccgccgaccagcgccaagaaacggttctgcatggcggtgataccaagtgtgcccagcgccgcggacacttcgtcggcagaaaacgccgggaaggacgtttcgtcaaagtcgagctcgacgggcgcatcggtgcgaatggttgcgaccttgcggctcagcagcgcatcgtcgatgtgcgcacgcaggttctcgcccatcttgcccttgacctcgtcggcatgcgcgatgacctcgtccaagctgccgtactgtgcgatgagcgcgctcgcctttttggggccgatgcccggtacgccgggaatgttgtccgacgtatcgccctttagaccgtaaaaatcgggcacgagcgccggcgtaatgccgtgatacaggtcgtccacgctctcgggcgtcatgatcgccacgtcggacaggcccttgcgggtcgagaccacgttgacgtgctcggtcacgagttgatacatgtcgcggtcgccggtcaccagcagcatgtcgcagccggcctcttcacccaggcgcgccatggttcccaggatatcgtcgccttcccagccctcggactgcagaatcggcacgttgagcgcggtgagcagctccttgatcatcggaaactgcgcatgcagatcggggtccatgggcgggcgttgcgccttatactgcggcagcatctccatgcgcacgcgcggtttgcccttgtcaaacgccacgaccacaccgtcggggttaaaggcatcgatcatcttgagaaacatgttcagaaagccgaagatcgcgttggtggggcggccgtccggcgcattcatggtgggcggcacggcgtggaaggcgcggtgcatgagcgagttgccgtcgataacggcaaaggtgcggcgcttgtcagacatattgaatacctcgctttgggctgggcacggtttgctcacaccagtttacacgctccccgccccgcggccaccgcacatcaggcttccctgccgccgcgggcccgcgcgtgatacgatggctcacggtacatcaaccagcacgatcgatccgaaaggagcctgcgtcatggagcgtccctgcgcatggaaaaagtacacgccacagcaagtcgaggagctcgaggagctttgccgcggctataagcagtttttgagcgagaacaagaccgagcgcctgtgcgtcaagaccggcatcaagatggccgaggaggcgggatacgtcgacctggagaccgtgatcgccgagggccgcgagctcaaggcaggcgacaaggtgtacgccgccaaccacggcaaggaccttatgctcgtcaacctgggcaccgccccgctcgagcagggctttaacatcctgggcgcccacgtggactcgccgcgcctggaccttaagcagaatcccgccttcgaggccggcgacatggcctacctcgacacgcactactacggcggcgtcaagagctaccactgggtagcctccccgctcgcactcgtgggcgtcatctgcaaaaaggacggtaccaccgtcgacatcaatatcggcgacaaggcggacgacccggtctttaccatctccgacctgctgatccacctctcgagcgagcagatgtccaagcctgccaaggacgccgtcgatgccgagatcctcgacgtgatcgtgggcggtcgtcccgtcaagttcgatggggacgacaaggacgcccccaaggagcccgtcaagcagatgttcctggacatcctcaaggagcagtacgacgtcgaggaggaggacttcctctccgccgagatcgaggtcgtgcccgccggtcccgcccgcgacatgggcctcgaccgctccatgattttgggctatggccacgacgatcgtgtctgcgcctatccgtccatgctcgcccagatcgacgtcgccaacgtggagcgcacgagcatcacgctcatcgtcgataaggaggagatcggctccgtgggtgccaccggtatgacgagccgcttcttcgagaacaccgtcgccgagatcatgacgctcgccggcgaggatagcccgctggccctgcgccgcgcgctcgcccgcagccgcatgctctcctccgacgtgtccgccggtttcgacccgggctatgccggcaagttcgagacgaagaacgccgcctttatgggtcgtggcctgtgctttaacaagtacacgggcagccgcggcaagagcggttccaacgacgccgatgccgagtacgtggccctcgtccgcgacatcatggacgaggccggcgtggacttccagacctgtgagctcggtcgcgtcaacgcgggcggtggcggcaccatcgcctacatcatggccaagtatggcatgaacgtcatcgactccggcgttgccgtcctgtccatgcacgccctgtgggaggtcgccaacaaggccgacatctacgaggcctatcgcggctacaaggccttcctcgagcgcgcctaaccaacccttcatcagttgcggtgaaatacagactaaactggcccataaacggccaaaacagaccgtattccaccgcaacttttttggcagagtccatgcttcaagtcatcatttcgcccgccaagcagatgcgcgcggcccaagatgcttttgaagtcctgggcattccaccctttgtgcgcgagacggctcgcctccaccgcgcactgctagatatcgagcggaatgaaggcagcggcggcctgcaggcgctgtggaacgtgagtgacaaactgctggggccttgcctcaacaccctgcatgagttcgggcccatcctgaaaagcggcgatctcgacaatcccgcactcgcccgtcacatctcccctgccgtcatgtcctatcacggcattcaataccagagcatggtacccgaggtgatgaattccgcgcagctcgcatggctgcaagaccatctgtggatcctctccggcctctacgggtgcgttcgtccctttcatgccgtcgaaccgtatcggctggagatgggcgcgaagctcgccgttgacgatgcccgagacctctacgcgttttggagcgacaagctcgcgcgggctatcgccccggcaggctcaaacaccacgatcgtcaacctcgccagcgtagagtatgccaaagccgttctgccccacctcgcgggcgacgccacggccgtcacatgcctctttggcgagggtatccgcaacgggaagcccatccagcggtcgaccgccagcaaaaaggcgcgcggctccatggtgcggtggatggcagaaaacaagctcgaggatgcaagcgagctcaccgcgttcgacgttggttatcgacactttcccgagctctcatgcccaggcaccctcgtgttcatcaacgagcactctagagccggcacccaacactgacccgctcagctttctccatataacttgcggtggaatagttcctatttgagccttttatcgcacaatcaggaactattccaccgcaacttttatgaattggctgctaggctcgacacctattctgctagaccgtcggcctttgcaatcccatttgtcgaaccgtcctgatagacaatcttgacgtgctcaacctcggacaccgcaacacccgtcggaggctccaaacgccattccgtcagggcgatatccatggtcgtgggcacgtccccctgatctttgagctttaccgtgagcgttttgagcgctgcatcaaacgtcacgcgttcgatttcttcacccggaatggatccaccactcagctgcaactgcacaaactcgtcgcgcggataccaataatcgcccggaacggcgagcgtattggcattaccgccagtactcctcaccgtcataatcggcagggcatcatcggcctcaaattcccaggcagcgccgccgcgaccgccaaacgtccaaatacaaaaggcaatcaccagcacggcaagcaccgcaaagccaatcgcgactaacccatggtgcgcacggccctcctcggccgatatgtcccattgtgtctctcgatatagatgcttgtcttccatgtacgcctccccactggcacgtccgttaggccaatcgtacccattcgagctatacttgagcccattacataaacggggagcttgcaggacaagacggcaggctgagactgggcgcgcccgccctgacccgcaaacctgatatgggtaatgccaacgaagggagccgtgccaatgagcacacagaccgagcccaagctcgtcacgcaaatcgacttcgcccgcgccgggcagatcacaccgcagatgaaggaggtcgccgagcgcgagcatcgcgaccccgagtacatccgcgagcgcgtggccgacggccgcatcgccattcccgccaacatcgtgcacatcaaaaagggcatgcgcgcctttggcgtcggtgagggcctgtccaccaaggtcaacgtcaacttgggcatctcgggcgataaggccgatgccgccgaagagtggaagaaggtcaagatcgccgaggactttggcgccgacgccatcatggacctctccaactcgggcaagacgcgccagttccgccagcagctcatcgacgagacgccgctcatggtaggtaccgtccccatgtacgacgccatcggctacatggaaaagccgctggtcaagcttaccaaggacgacctgttcgaggtcgtgcgcgcgcacgccgaggacggcgtggactttatgaccatccactgcggcatcaacaagtcggtcacaaagacctttaaggagaccggccgcctcatgaacatcgtgagccgcggcggctcgctgctgtttggctggatggaggtcaccggtaacgagaacccgttctatgagttctacgacgagctgctcgaaatctgccacgagtacgacgtgacgatttcgctcggcgactcctgtcgcccgggctgcctctacgactccaacgacgccaccgagaccgccgagatgatcgagctgggcaagctgtgcaagcgcgcatgggccgccggcgtccaggttatggtcgagggtccgggccacatggcgctcgacgagatcgccgccaacatgaaactgcagaagcgcctgtgccacaacgccccgttctatgtgctcgggccgctggtgaccgatatcggcgtgggctacgaccacatcaccgctgccatcggcggcgctatctccgccagctccggcgccgacttcctgtgctacgtgacgccggccgagcacttgtgcctgcccaacgcccaggacgtgctcgacggcctcatggccaccaagattgccgcacacgccgccgacatcgccaaaaaggtgccccacgcccgcgacatggacgacaagatgggccaggcacgccgcaagctcgactgggacgccatgtggaagtgcgcgctcgacccggttacgggcaagaagcgctacgaggagtcccccgccgccaccgagggcacttgtaccatgtgtggcaagatgtgcgccgtccgcaccgtcaacaagatcttcgagggcaccacgatcgacctcggcatggaggactaaccctgtcgccgcggccgcttctggcggcgagctggtgcctgtcaattgttgacttgtgaacatttacttacacttgcgtagagattgcatcgcccgcccgggttcggcatagagtcggcccgggcatctttataatgctggcttaaagacccatttgattccgaccgaacaagggagcgaacatggatcgtagtaaggtacctgccgtcctgtccatcgcgggatccgattccagcggtggcgccggcattcaggccgacatcaagaccatcacggcgcaccgcctgtatgccgagacggccatcaccgccatcacagcgcaaaacaccctgggcgttaccgccgtgcaggatatctcgccagatatcgtagccgcgcaaattgacgccgtttttgacgatatccgccccagcgccgtcaagatcggcatggtttcttctgtcgagattatcgaagtcatcgccgaccgcttgagcgcctggaacgcaacgaacgtggtcgtcgaccccgtcatggtcgccacctcgggcgcgcggctgattgccgaagatgccgccgaggcgctcacccgccgcctgttcccgctagcgacggttatcacgcccaatattcccgaggccatggcactgctcgactatgaggtcgactccgagcgcacgcagcaaaatgctgccatgctcctcacccgccgctttggttgcgcatccctcgttaagggtgggcatcttgtcaacgaggccaacgatgtactggccgaacccgcgccactcgatgacgagggcaaccatctgggagatccactcaccacgtggttccgccacaagcgcatcgagaccgacaacacgcacggcaccggatgcacgctctcgtccgccatcgcctgcgcgctggctcagggcatggatcttgccgacgccgtcaacgccggcaaggcctacctaaccggcgctctggccgccggctttgacatgggcaaaggctccggccccgtcaaccacatgtggcagtactaagattcgcagtccaaaaccaccgcaaaggggacagacacctttgcggtggttcccacagacatctcgatccgtaacagttagagtccatttttcggcccacctgttacagattgagacattcaaattctgccgagaagataatctcgatctgtaacagtagatcggcaaaatcgaccctagatgttacagatcgagacaaacgaccgatatcaacctgaataatctcaatctgtaacatctagcccgttttcggccttacagctgttacagatcgagacaaaccaacgaaacaagccgccgcaagggaaacttttgtactggtttggggctgcgctactcaccgagcatctcttggagcttggctgccacggcatgtcccaagctctcgtggccttcgggcatcatgtgcagataatcgatatcgcccggctcggcaaagtcggcggcattcaaaaagtcgcagccaaactgctcagccacatgcgcgtagtactcaccaaaatgttccgaggcttctacggaatgctcgtcaaaatcggtcatatatacgtcggcgatctgcggcttaatcttgataggcgccatcagcagaatccgtgggcagggcgcggcatcggtccaggcaaacgcgcggacggcgcgaatcagtgccatggcgccacgggcgatatcggaggctgtcacgccaaagaccgtcttgcagtcgttggtgcccagcataatcacgatcgcgtccagcggcttatgggcttcgagcagcatcggcagcgcgcgaatgccgttgaggttggtgtccagatggcacatatcgtcgcgcaccgtcgtgcgaccatttaggccttcctcaatcacatgccaaccctcacccaggtcacgctgcaccacaccgcaccagcgcacatcctgcgcatagcgcactgcggtgccgtcgcgcatacccgccggatcatagccataggtgttgctgtcaccaaagcacagaacgtttttcatcttgagttccccattccgtaaaaagccgacgggagcaatccctcccgtcggcttggcatatcacatcgcgcgcaccgcttacaggtacttgcgccagtcgtcctcgtcctcatcgtcctcggctgctgcctgggcctgctcggcggcacgagcggctgcggcgcgggcggcaacctgggcataggactcctcgttgcgctcggggaagtttgccagcacgtgctcgaacttggcaaaatcctcgtcccagcgcgtagagggcacggcaaagaagacctgcttgaccttgaagtcgcccgatgcgagctccttgcggaagagctcggccacggcctcggcgtcaaagccgttgttctcgcagccccaagcacccagtacgagcttctcgcggcccagctcatcgcagatagcaagcacaaagcgaatgcggtcgcgcagggcgtcaagcaaggcatcgtcgctcacgcggtactcctggcgagcacgcttggcgttgggtgcagcggcgacgattacgtcggcataggcgtgcacatgcttgcggtcgaagcgcaccgcgggcaccaccagcgcacggttgcggtacagctcacagttgatgttgcggcgacggttctcgccgtaccatttacgctgcttatcaaggacattgtacaggtacgaatcggcgcacagcgtggcctcctggcccagatagccctggatgtagccaccgcccggattggtgaacgaggcaaaggcaagcacagccatgtcgcagaactgcgcgtagcctcgaccgttatccagaatggcctgcgtggcagaggcgtcgagcacggtgacctcgggcaggaccggagcgggctcctcggcggcaggcgcgggctcggcttcggtggcctcctcgacgggctcgggcgccacctcggcatcgaccgcagcctcgacctcagcagcctcagtagcctcgacctcggcagcctcgacgtcctcggcagcttgctcctcagcagccgctgccttctggaccctggccttcatcgccgagacaaagccggcaggcataccgtcaaactcgcgaacaccggcaagcgaacgctcgatatccttggcgcacgcttcggacacagttgccacgtgacgctcggcggccttggcacgggcctcgcgcttgggattgggctgacccgctcggttggacctgcggttacggttcctgttgtcgacgtctgccataagtggtcacctttctcggtctctgccgctatcggcttttcccatccatgataccccgccgcgtacaaaaaagacggccccgaaggaccgcctttcgcatcgatttgcacgcacggcaagcaccgccgcaattcgccactagtcgcgacggccgaggatgttcaggatgcgcaagaacacgttgataatgtccacgaacagattggacgccatgagcacggcgttgggcagcgtaggcggcaccgtcgtggcaacataggtgtcgtagccaataaagccggcgaacaccacgatcacgatcaggtcggtgatggtctgtgagacgcccatgaacatcagcacgatctcaaccagaatagtagcgagcagaatgccaaaaccgatgccatatacgcgctggaaaaacttggggaacgtcacgcccaaggcgccaaagacaaaggtgatggcggccgtggcgataaaggcagtgttgatggtgggcaggtcgtagttggcaaggccaaacgacgcggtcaggccaaaggtgctcgcaaagattacgtagcccacaagggacaggcccacggactgcttgctggcggcggccgacatcatgaccatgccgacgatggtcaaaataaatgagccaaagaccagcggcaaagcggcgccgctcatcatcatgcgcgcaaacgacatggtgctcgtaaagtaagcaccgacgcccatggcgcaaaagcccaaaaagatcagggcagacatgacaaggttgtacgcgcgcggcgacatctccttggcgcggcttgcgccgctctcgacggggccgttctgatagccctggatatcgttcataggttcgtcctttcaaaaagtgccgtgaaagacggcgcagcaggtgacaagattcctgtcattgtacccgaacgccgtgcgtccttacctacggcgctcgccctcaagcgtacggtcgaatgcccacacccaccaacgcatcaggtgggcctgcgagccatctggtcgttcgcgcgtctggtcctccagatacaactcggtcgcgtgcccgccaaaacgcaccttataggttgccgtacggatgccgtgaaccgtcaggccaaacccagcggtcgagacaatctcgtcaatcgtaaagcaacgaccgtcgacccagcagacggtgaccggcacgacctgtccgcccgcgaggatgcgagccacgacgtccacatactgcttgtgcacgcgccgagttttgccatctgtctgtcgatattccatgtctcctattatcgaacgcatgtttgcatgttgtaaagcgaacagactgtggttttggagtgtcggagcgaacgcgcgtgtccgcatggcgtgatagcaaaaagaacacccacggtcaacagggctaatattcaattttagtgccaaaaaattacttctcccatcagaactcggcaaagaaacccgtaggaggtgatacgatttatcatgtttttgtaacgtgtctgcaaacttcgagaaagcccatatatggacgtaacgttctcaaccttcctcggccaaattgtgtcgaacccagtccttgccgtcaccgtgatcctcgcgttgggcgccatcttcgtcaatggatggaccgacgcgcccaacgccatcgcgacctgcgtcactacgcgttgcatgcccgcccgcgccgccattctcatgagcgccgcattcaacttcctcggcgtgctcatcatgacgcactttaatgcgagcgtcgccaacaccatctcacatatcgtcgattttggcggaaacagcaccatggcgctcgcctgcctgtgcgcggcgttgttctccatcgtcgtctacggcgccacagcgtcgcgttttggcatccccacctcgcaaagccacagccttatcgccggcctgaccggtgccgctatcgccctcggcggcgcgagcagcgtcaacgtccacgagtggatgaaggtcatctacggcctggcgctctccatcggcctgggctttgtcatgggctgggtcctgtgcaaactcgtctcgattcttttcgccgccgccaacaggcgacgtgccaatgtcttctttaaatacgctcagattgcgagcgctgcggccatgagctttatgcacggcgcgcaggatggacagaagttcatcggcgtgctctttttaggcgtggccttcgcaaacggccagaccagcgtcggcgatgccggcatccccatctggattatgctgctgtgctcggccaccatgggtatcggcaccagcgtgggcggtgagcgcatcatcaagtccgtcggccagagcatggttaagctcgagaagtatcagggcttctccgccgacctcgcgggcgccgcgaacctgctgcttgccacccttaccggcatccccgtgtcctccacacacatcaagacctgcgccatcatgggcgtcggtgccgtcaagcgcctctcggccatcaacttcggcgtcgtcaaggacatgatgttcacctggttcttcaccttccccgcctgcggactcatcagctttgtcatggccaagctgttcatgatgttcctctagtcaaaccgaacgtccatctggaccgcaacacttcgcccacccgtcttcgcctcgaaaggacccacccatggcaaagaaacccgattcgttctactttgacaactacgtcgcctgcgccgaccttgctgtccaggccgcagagttgctcatcaagatttttgagaactttgatcccgcgcagatccacgacatgctcgaggagatgcatgcgattgagcatgcggcagacaagaagcaccacgagctcgaagacgccctgctcaccgcctttatcaccccgctcgagcgcgaggatctggatctgatgagctgcgcgctcgacaccgtgctcgaccgtattgagggcgtcgtgcagcgcgtctacttcaccaacattcagagcatccatcccgacgccatcgtcatcgcccacaaggtgactgacgcctgccgcgccatgaaagacctgatggtcgagctgcccaactaccgcaagtccaagaccctgcgcgagctggtcatccagatcaacaccatcgagtccgaggccgacgagctctacatcaacgccatgcgcaacctgcacgttaacggcaaggatccgctcgaggtcatcgcttggcgtgacgtctacgccttcctggagtactgcgccgactgctgcgagaatgtggccgatgttgtggattcgattgtcatgaagaacagttaattgggggtacgtgtcccggcggcgaagggccggccacggtttgctttctcactccggctgctttgcagagtcgttcgaaagtaaaccgtggccggcccttcgccttacgtaccaccattggaactttggctgatagttagagcgcaatggggggttggccgagggggcctttaatacccaattgaacactttggtattcggtgggcgtttgggtggatgggggtttgggtaccctttggtttaccttggattgatttgctgactttggagggtttggttatggggtatttggatctggctcggggtcggtattcttgtcgtgagtttgaagatcgggctgtggagcaggctgtggtggatgccattgttgaggctgggcggattgctccttctgcttgtaataatcatccttctcgtgtgatggtgctggatacgcctgagcttctggagaaggctgctgcttgtcagcctcggtttgctcgtgatggatctatctttggcgctccgctcatcttccttatttgtagcgttaccgaagacgcttgggtgcgcccgtatgaccagatgaattccagtgaaatcgatacgtccatagtgtgcgatcagatgatgatggaggccaccgagcagggcctgggaacgtgttgggtatgccattttaagcctgaggtggcgcaggagcagttcaatctgcccaagggcgtctatccctatcacatgctcgtctgcggatatcctgccgaccacatcgccgattccgagcatcgcgaggcccgtaccattcccctctccaacttcctcctcaagtagattttgggacatgccctaaaacctatccttgaccgctcaccggttcgccgagttctgcgccactatgtgcagggctcggttttttatgttgcgcgccccggtacagtcataaaaaaggacccgcaagctgcgggtcctttctaggcactaaattgtaggccgaatgttagtccaggtcgtcggcagcgaagttgtcgatcggggcgaagggatcggccacggggacaaccgggtcagcgacgggcagcggctcggcgggaacagtcaccgcaggagaagcggcagaaccgaccggcgtggaggccatgaggtcggccgggaaggagttctgggcatcgtccatgaagtgctggatgagcttgagatactcggccttgaactcctcacgagaagccttgagacgatcgatctcctcgagctcagcctgcttttcggtcagagcctggcggataacctcgcgggccttggcgtcagcctcgttgcgaatacgctcagcgttctcattggcatcgttgacgatggtctcagcggtctgctgggcagcgatcagggcagcggaaatctggcgctcctgagcggagaagtcaggggcgggagcagccacgggggcggcaggaacggcctgggcgggggcatcctgagcctgggcaagctgagcctgcgcatcggcaagctgctgctcggtagcagtcagacgacccttaaggtcgacgatcttagcgagcatagcgtcaacctcagaggacagcgtctccaagaagacgtcgacctcggcaggatcgtagccacgcttggcctcagagaaagtctgagcctggatgtctgcaggggtaatagccataacaagtctcctttttcatcgcctcggcgctacacgcccgacgtaagttactaagtcagttctacacgagtatacctataagaagctgcagaaccagcctctgcaccaactgcaacgcaataatcgcaacgaccggcgaaaaatcgataccgcccatcggcgggatgaaacgacggaacaggttgagccacggaccgcacacgctatcaagcaccgcggcaatatcctgaagcaaaccaccctgcttcatgggaatccacgtcataaagcagtagacgacaatgagcgtggaatagaagttgaacagcgtgttgaccagctggacgatagtgtagatgttgatgggaatctcctcgtcttgtctttacttaaggtagccgtccgcacgaagcttcttgagatcggaatctttgacctcgcaaccggcgggcagcaccatgaacacgcggtcgcccacctccttgaccgtggcacccagaccgcaggcaaagccgtaagagaagtccaagacgcgcttggcaacttcggtgcgtacgcccacaaaaatcagtgcgacaggctgcttggtgcgaacgcggcgcaccacggtctccacgtcgtcatagctctcggggcgcaggacataggccggcagctgcggtgtggcgttgatgatattgctcgcataggccgaggcatcgctcggtgcaggcgcgggcgcagcggcggcacgggcgcgggtgttctcggcgtagctagacggcgtgtcataggcaccaggacgataaccgctcgcaacactgtcctgcgagcgcgaaggcgggttatacgttgtggcatggcgagagtcatcgccgaccagctgaccggagcgcgtatacacggcaaccgactcagcttcaccgcggcgcgtctgaccaagcaggccgttgctcggctcgtcttgggtgtagaagccctcgcccgaagcaccactgtagccgttgccctgatagccatcgtcgtagccgtcatcgtagccgtagtcgtcgtcctggccataaccctggtcgtaaccctgctggccgcccaggtgcatcttatttttaatctcgtcaaggaagcccatggttgtgtcctctcgcggtttagtgcaggcgccccgataatcagtgcgcacttcagagccttattttactgcaaactccgggctaaatactaccctgcccaggcgaacgagcgtagagccctcctcaagggcagactcaaagtcctcgctcataccgcaggaaagctcaggcaggttcaaatcgggatgcgccgcctccagctcatccctcagctcacgaagccccgcaaaggtgcggcgtgccacatccttattcccccggggcgccatagtcataagcccctgtacgaaaattccctcaagttctgcaagctcacccgcggcggcgcgaatctcatcgggtgaaaagcctcccttcgactcctcaccactcacattgacctcaatgagcacacgctgggggccgacgagctcgcctgcctcaatcttgcgaacagcacggctcgagatcgcctgcgccagatgcagcgaacccaccgagtgaatcagctcggctgagcccagcaccgcattgatcttattggtctgcaggttgccgatcatatcgaagcgcacctcgggcagctccggatgctccgccagacccgtgagcttgcgaaccagctcctgcgggcggttctcggcaaaatggcgataccccgcctggatggcggcaacggtctcatcgacaccaacggtcttggacacggcaatgaggctcgcggcgtcgtggggacggcccgcgcgatcgagcgccgcataaaaacgttccagaatctgctcgcggcgagcgcgcatcaagtccaaatagttatccattgccaatcgcctccgctgacagccaaacaagtagtcccatgctaacgcaagagcgcggccccgcatgtgcaaggccgcgctcacttaggtatttacaatctttcgacgaacggggttacttactcctcgtcgtcctcgccatcgtcctcatcctcaagatgatcgagcaggtagcgaagaccctcgctgacctcgttaacgggcaccttggcaacgtagcgtgcatcgacggcgggcctcatgataacaccctcgcccgaaggcacgcgcatgctctcgagctcatcctcatcagtgcaggcgatatcaccggcagtcatacgctgtccggtcaacaggaaggtcagacggcaggcggcatcgatggaaatcgaggcgatgcgatcgagatagcgcgataccatgatggcgcggcgcaggtcgtcatagttgctgtcgtcgtccataaaatcgcccgtgtccatgcggttaaaggtgcggaagaacttctcgtaggcggcgtgcactggctcgtcctcgacggccaagttgcagatgatggacatgtcgttggtgacgagcgcagaaagcgaagagcccagcacctggtagacggcctcagcctcggcctcgaccgtgccgacaagctccttgggcagcgagatgtcggccttgatcatatgacgcgtggcgcggcaaatctggcgaaccttatcggtcatgcgctgcaggttaaagtcgacgtagatgatcgtctgcagcaagcggaagtcggaggcgaccggtgactgcgtggcaatcaggttgtagcagacggcctccaggttggcgcagcgtgcgtcaatcgaaagcgtgcgcttcttggtcttggtggcgagcttgcggtcgtcggtcacataggccttcacggcatcgtggagggccagatcgacggcctcgtagatgctcagcatctcgtgacgggcctcgatgagctgacgggaaaacagtttgcgcatggttcactccaatcagttgggtgcggtcatgccgcccgcacagtgaatacgcaccggaccagatccgatcggcttgggactagtcgcaccgatcagccaaagcggccggtgatatagtcttccgtccgcgagtccaccgggctggtgaagatcgcgtcggtttgaccatactcgatgagcgtagcgggctcgccggcaacttcctgcaagaagaacgcggtgtagtcactgatacgagctgcctgctgcattgaatgcgtgacgatgataatcgtcatctcgggcgccagctcggccatcagatcctcgaccttagagacggaagtggggtcgatggcggagcagggctcgtccatcaggaggacatcgggttgcaccgcaagcacgcgcgcgatgcacagacgctgctgctgaccgcccgagagcgccaaaccatccttgttgagctgattggatacctctttccagaggttggcgcgcttgagcgattcttccacgatgtcatcgaggtcgcttttgctagtcacgccctgcagacgagggccaaaggcgacattctcgtagatggatttgggaaacgggttgggctgctgaaagatcatgcccacgcgacgacggagatcgaccggatcgacaccctcggcatagatatcgttgccgtcgagcgtcatggtgccctcgacgcgcgtgccctcaatcaggtcattcatgcggttgatgcagcgcaaaaacgtcgacttgccgcagcccgaagggccaatgaaggaggtgatggcgtttttggcgatgttgaggtcaagccccgtcagcgcatgaaagtcaccgtaccaaaagttgaaatccttggccgtaatggccgcttgctccagcgtgggagcggactgataaacggacatgggactccttaactagcgacgcttgcgcgacaggaagcgcgcaaacaggttgaaggccagaatgatcaccatcagcaagagcgcggtgccataggctgcgttcatgttgatgccgtcgttggcaagcaggtacaggtgaaccgtcatgggacggccggaatcgagcggcgaaataggtagattgatggcctggcccatggtgtagagcaccaccgcggtctcgccaatggcacggccgatggcgaggacgatacccgtggcaatacggccaaaggcagaaggaagcacgatcttggagacgacctgccacttggtggcgcccaggccgtacgcaccccaccggatatagcgcggaacggcgcgaatggcctcttcggtggtgcgcatgacgatgggaagcatcaagagcgcgagtgccagggcggccgagaccatcgaaaggcccagacccatagcctcgacaaacaaggcgtagccaaacaggcccataacgatggagggcaccgaggccaaagcgtcagcagcgtagcgaatgagctcgacgaccttgccctgcttggcgtactcggccagatagacggctgccagcacagcgatcggcgtgcagataagcatggcgagtgccgtcacatagacggtcgagacgattgtgggccaaattccgccctcggcgttgacgccctggggccaaccgaagataaagtcgagtgagatatgcggcaggccgttaatgaccacgtaggcgatgatagcgaccagcaccagcgtggtgatgtatgccgcggcacggaacacgccaagcatgatcttgttggacaggtccttgttgatgcggcccttcttgccgtgggaaagggcacgcttgatgcgctcgcgcgacgaggtcgtatcgaccgtcgtgtcaacggaatcggacatagcctaccccctcttcttcttggaaatcagacggacgatgcccaccagcgtggcggagatgataaacaggaccacgcccatgccgaacagcgccgagcggtgcagacccgaggaatagctcatgtcgagtgcgatctggctcgtgagcgtcgagatagggctcgcaatgctgtcgggaataaccggggcattacccacgaccatgagcacggccatggtctctccgatggcacggcccatacccagcacgatggcatccacgatacccagcttagcggcaggtagcacgaccttatagatggtctgccacttggtggcgcccatggcatacgatgcctcgcgaatgcccatgggaatggaattgagagcatcgatggtgagtgtggtgatggtaggaacgatcatgatggcaagcacgaaccacgccgtcagcgcaccaaaaccaagaccaccggtcagttgcgcgataaacggacggatgatgatcattccaaagaagccatagatgatagaagggatgccggccaacaggtcaacggcagggctgataagcttgcgcacgcgcttgccggcgatctcgaccaggtacacggccgtgcccacacctagcggcacgcccatggcgagcgcaccgacggtcaccagacctgagccggcaagcagcgacatgatgccgtagtggccctcagagggcgcccacgtaaagctaaagaagtccgccagaccgatgtcggtaaagacgggcagcgccgagtacgtggtaaagacaaaaatcaggatgacggtaacgaccgccaagaacgcacaggcaaagaagatccactgcagcgccttctccttgatataggtactgcgcgatacgagcgccagctcgcgcttcttgggtgcctgagcattctgctcagtctgggagttttcctgtgcttccatgctactcactccccttctcgtcgttggtgacgggaataaagcccgcctcgcgaatctgcttgtccatcttttcggacgtcacgtagtcgatgtaatcctgcgcctgctgcgaaggagcacccttcacaaagaagtaaaggtcgcgcgagatgggatagccgccgctcgcgaccgtcttctcggacgcctcaacatgattgaccgagacggccttgaccgaggtcttggcgttgaggctatcgacgaagcccagcgaaatgtagccaatggcaccgcgcgaacgagataccacgtcgcgcacctggcccgtgcccgaaagaacggccgagcggcgatcgaacggcgtgccgtccatcacgatggtacggaaggcctcacgcgtgccggacgcctcatctcggttgataacctgaatcctcaggtcctcgccaccgacttctttccagttggtgatcttgccggcgtaaatatcgcggagctgctcggtcgagaggttatcgaccgggttatcgtcgttcacgatgaccgcgataccgtcgtgggcaatgacgatgggagtcaggcccagatcctgttcgtcggcattgagtccacgggaggagctggcgatatcggccgtgccggcgctgacggcctcgatcccagcggaagaacccaaaccggaaacgagcacgtcgatgccggtctcctccttaaagccctcggccgcaatctcggcgataggaaggcaggtcgtggagccggccacggtaatggaagagctagaagatcccgaagaacaggcgcacagcgtaagcgtaagcacagcggcgctcaggaccgatacgatctttctcatagcatcacgccgatcgcagcatggcgcccacaggtgccgtcctcgttacggtaggaataaaagcggtcgttctgacgcacggtcgaaagctgggtatccacgatattatccgcgtcgacaccgacatctaccagcgcctcgcgaatggcagcggaaagatcgagcatgcgagaggtattcgcatcgatgcaagagaactcggcggcaaagcgatccatgagttcctgggatacctcatattcgtcacccaagatatgggggccgatataggcggaaacgtcgctcgcatcgcaaccggcagcatcgcaaagcgcctggcacgccttggcggaaatacgtgcaatcgtgcccttccaaccggagtgcaccacggcaaatccgccgggggccaccagcaccacgggaacgcagtcggcaaagcagagcagcacgggcacgttatgcgccgtgcagacgatggcatcacagccctcggcaatctgctcgcgaacgtcctcaaggtcatcggcgccgttcgaggtcaccgcaacgatatgatcaccatggacctgattgggaacgagcaggttgtgctcgcactcggcggcacccatagcctcgagcgcacgacgacgattttcttgaacagcaaaggggtcatcgccaacatgcgagcccaagttgagtgaggagtacgcatcttcggaaacgccaccggcacgctcggtgaaggcaaagcgaacatcggatgtcgcgccctccaccaacgtaactccatcatggtcgacacgcgaaactttgtccgcacgtgctgccatactaaagcctcctaataacacaagtaccgcggcatcgccgctacagcccgcgtttatacggctgtcatacttctctaaaaggatacctgctgcgctggaggcaatcgtaaagggaacgtaaagagattggaggttctagtttacaaagtcgaaataaaaagggcgcgtccatacggacacgcccctgtgcacaacaatgcaaagaacgacttagaagctaccgcgcttcaggaagtcgggaagctcgaactgatcgttgccgaagttaggaagctcggtgccaccgacgttgcgggtcggagcggcctgagccgggctcgtggcaggagcggtgcgctgcggctcagcggaggcagcggccttgctctgagactgctgagcagcaaagagctcgtcctgacggttgacgttggagtcggagaagcccgtagcgatgacggtgatacgcacctgatcgcccagggactcgtcgacaacggtaccgaagatgatgttggcctcggggtcgacggcgttggcgacaacgtcggcggcgtcgctgatttcctggatgcccaggtccttggaaccggcgatggagagcagcacgcgcgtggcgccatcgatggagctctcgagcagcgggctggagatggcctgctgggcagcgtcgacggcacgggtgtccccagaagaggtaccgatacccatcatggcggtaccggcctgcttcatgatggtcttaacatcggcgaagtccaggttgatgataccggggacggtgatgaggtcggtgatgccctgggtgccctgggaaaggacgccatcggcaatcgcgaaggcctcgagcatggtggtcttcttctcggcgatgtcgagcagcttatcgttagggatgacgatcatggtgtcgacgcaatcggagagggtcttaatgccctcctcggcgctcttcttgcgcttgcggccctcgaaggtgaagggcttggtcacgacggcgacggtcagcgcaccgacctcgttcatcgcgatatcggcaacgatgggagcagcgccggtaccggtgccaccgccctcgccgcaggtgatgaacaccatatcggcgccagcgagcgcctcggcaatgtcgtcgcgggactcatcggcagccttgcggccaacctcggggttggcgccggcgcccaggccgcgggtaaggtcggtgccgatgtgcaccttgatatcggcatcagagatcgcgagtgcctgagcatcggtgttgatggcaacaaactcgacgccgcggatgccctcttcgatcattcgattgaccgcgttggtaccgccgccgccgacgccgaccaccttaatgacggcaaggtagttgttgatctctgtctcgtgcatgtcggtcctccgaacaaaggttatagccatagcatgggtcgacccctgcgcacattaaccttcaggttgaaagtaaatgcaaaggtaaaccgtattatggttgcacattatgaacgtatcagtcaaataattgaccgtgaaaaccaaacaaaccagataaacggcgtggtatggcccctcaacaaagcatcaaccagcgctacgaggtcggagcattcctaaatgtgtagttgcccggagagcgcacattgatatacgttacgccctctacctgcgaaagcaacttggtgactacgcgttccttcttggcgatatcgtccgaatcgcccagcgacacctcaatgccgctattgaggtttgccgagatggcttcgaccgaaggcgtggaaatatccttgacttgtcccaagaactcgctcgaaaaaccacgcacataatccaagccggccttaacggccttggagctcaccgcctggccggaaaccggagcgacatccgccgagacatcagtcaacagcaccgcgccataatgcttagcgagcgccagtgcggcatcaatgccggtcaaggtatttgagccctgccctgtcgtgatgacgttgccctgatcgtccacttcgaccgacgtcgacagcggggcgatccaggtgtcatcatccccgatggcccaggcaaggtcatcggagctgatgtaggcaattgcaatgaccttgcgctccatcggcgtaatgatgagcgtatgcgggaactgacgctggacatccacgcccgagacccacgggttctgcttgagatcctcggtaatctggtcgggatcgacgttaaaaagcgacgttccctcgggcaaatcgatcagctggatagcatcgtgcttcgtcacatgctcgctgccttgaatctgaatatcagtggcggtaaacaatccagagttaatcaccacgatggcaacgacgacgagcacggccaaggcggccagaactccgcccacgattttgcctttgcctgcaacgacagaagcggcgtctgatgttttatttgccatcgccccaagtgaagacaacgggtttacgccttttttactcaaaggcttcttggcggtagccggcaccgatgtcagcgagcgcggtttcgatgcgcccagtgtgcgacctggacgcgccgctttagttcccgtcgagggcttaggagttgccatggggcgggcaggcttggcgcccataacaggctttgacgtcaccgagggacgcgaggacttttttgcagccggacgattaccgagctgcgagccgacgaccggacgactggcctgtcgagcatgcccgacaggcttagagtgcgcgacggtattgcgttgaggtttggcaggcgcgccggaacgccctccggcgcggcggaaggtgggtttcgatgctctagaagccgaggaatttaacttccggtctgagctcgatgccatacgcctccctcacctttccgtgcacatgtctgataaccgcggcaacgtcatcggccgaggcagttccgttattaacgataaaattagcgtgaacgggcgaaacttccgcaccgccaatcgaaaaaccctttaatccacaatcctcgataagcttgcccacactcgcatcgggcgggttacgaaagaccgacccgcaggatgcgcgacccatgggctgcgtacgcttgcgcctcgtcaggtaccgttccatgcgctcgcgaatgtcggccttgggcgccggtttaagcttgagcacgcactcgaggatgatctcattgcggggaaggctacattctcggtagccccaagtgatctcggaccccgcataatgcttgataccggatgccgggtcaaacgttacgacatcctcaaccagcgagccaatccactcggtccgtgtgcctgcattcatagatatcgcaccgccaaccgaaccagggatgccaacggcaaactcaaggcccgagaggctacgcgacagggcatcgttgaccaggcgcgcaaacatcacgcccgcaccgaccgtcagcgtacaaccgtcatcggcaacaaccgtgcgctgaaactcacgtccgagcgaaatgacggcaccgcgataaccgccatcggcaaccagcagattggagcccttgccgatgatgacccacggcacctgctcgcgatcgagcaccgccacggcgcggcgaagggcatgatagctatggcacgtcacaaagaggtcggccttgccgccgatacgatagctcgtatgacgcgcaaggcgctcgtcctcgatcacatccgtgtcgatcatgcccgagagcgccataacggcgttaaacagacccattagacttaagcgtctttcttggcagtcagatactcaatgaactcgggaccgacggtcgtaacgtcaccggcacccatagtgagcagcaggtcgccctcgcccaccatctgctcgagctcctgattaagctcaagacggctggagcaatacacgacctccttaccaggatgcttggcgcgcacggtatcggcgagcatcttagaggtgacacccggaatgggcatctcgccagccgagaacacatcaatcagcagcagtttatcggcattggcaaatgcatcggcaaagtcgtcgcacagggcctgcaggcgcgaatagcggtgcggctggaacacgacgtcgacgtgcttgtagcccagcgacgaagcggcagcaagcgtcgccttgatctcggtggggtgatggccgtaatcatcgaccacggtgatgccatcgatatcgcccacgtgggtaaagcgacgacggacgccctcaaagctcgagagcgccttggcggcggcgtcgatgtcaaggcccaggacatgggcgacggtgagtaccgccgtggcgttgagcatgttgtggcgaccgggattgctcttgatctccacggcatgctcagtgccatcctcaaagcgaacgataaagtcactctggatgcccttgacatccgggtgcatgcagacgatgtcgttgctctcggcaaagccgtaggaaagcacgtgacgacccgtcgacttggcgagctcgaccagatgcgggtcctcaccgcagacgatgacggtgccgtcctcgcccaccaggctcatgaatttggcgaaagttgcctcgatctcctcgatacccgagtagtgatcgaggtggtcggcctcgacgttggtcacaatgactacgttggggttcaggaacaggaaggagctgtcggactcgtcggcctcggcgacaaagtagtcgcccgagccgttcttgccgttcgtgtcatagccctcgacgatgccaccgatcaggaagctcggatccagacccatgcggtcgagcatggtggcgcacatcgaagacgtggtggtcttgccatgcgtgccggcaacagcgacggtggtgtagccgtggcccaaagcagagagcatcttggcacggggccacacgggaataccaagctcgcgagcgcgcacgagttcagggttagactccggaatagcggtggagacaacaaccacgtcgggcttgacctcgtcgatcgtggcggcctcatggcccacatgcaccttcacaccagcgcgggtaagctggcggatataacgtgacgtcttaaggtcggagccggtaacggcataaccgcgctcgtgcagaacgagggcgatgccgctcatgccggcgccgccgataccgataaagtgggcgctcttaaactcgggcgcggaggttgcagtctgggaatcagccatgtgctcgtgtactccttgcgtaaacactgcctgtaacccgttaactgtaccgcacctaccgcatcagcgcgagggcgaccgacgatatcccgtctaactaacgcaaaccctctaccgcatccgccagaagagcggcggccctatcttgagccagaccacgcgccgcctgacgcatggcgtcgcgcgccgccgcgtcatcgaccaggtgcagcagctcatcggcaaaggcagaactgtcgatatcggcatcggcacagagcacaccggccccggcgtcgactagataacgggcattggtggtttggtggtcggccgtcgcatgcggatacggcacgagcaccgagggcacggcgagcgcagcaatctcggccacgctcgatgcacccgaacgcgagagcaccaaatcggcagcagccagcatatcgcccatgttgtcgatgtaaggctggacgcggtaacacttcgcctcctcgggcgtcagcgccaaagcgcgctcggtctcctcaaagccgtcggcacccgtcgaatgcaacacatagaggttcttgcgcgaaagcagctcgtttttgagcgaaaccacgcgctcattgaggtgctgggcgccaagtgaaccgccaaagacgagcagcagcgtagcgtcctcgggaacgccaagtgccttgcggccgcgagcgcgatcgccctcgatcaccgagcgacgtacggggttgccggtcatgagcacgtggccagggtcaccttcgcgctcaaagaccgaacgcgctgccggcaccgagatgcacacgcgggcggcgtgggagttcatcatcttgttggccaggcccggaacagagttctgctcatgcagcagatacggaacgcccgcgcccttgcaccaccccagcagcggaacctcgacataggcaccaaaaccaatggcggcatcgggcttgccgacctttgagaaatgactggcgagcgcacgcttggctttgttgacacgccacagcgaggtcagcgccgtccaaggacgggagcggtcgaagcccgtgaccgtaatgggcacaaaatcaaacccagcctcggggaccagacgaccctcgagcttgcgcgactggcccacgaacacaacgtggtggccacggtcacgcagttcttcggccaaggcgagcgcggggttgatgtgtcctgccgtgccgccggctgcaatagcaacggtcattttatcggtcatggtagtcccttcgtacacgcggtccctggtcgtcggtacgcagacgcgccgacgggtccgagttcaaatcgattcgattatatccgccgcccgcgttgcgagggctggggcgctgcggacgaccttgcggagccattcgcgggcgtggacgagctgccggctcggatgcagaaccatccaggacggtaaaaccgttacgcgaagatcgctcgccgcgcacgtggggcacgccggcggtactctcatccataacggcaaagctctcgcggcgacggtcgtactcatcgcgacgggcgctctcgtacgaaacgcgcaggatcaacccggcaagcataagcgacacaataatcgacgaaccgccgtagctaataaacggcaacggtttgcccgtcatgggaaacacgttgaggatgcccagcgcgttaatcaaaaactgcaccgcgagaatgaccgcggagccagacgccatgagcgcgccccgacgatcggtcgcctgctcggcaatgcgaaacgccgagtagatcagcatcgcaaacaccaagaagaacagcacggttccgacaaaaccgacttcctcgccaatgatggccaagatgtagtcgttgtgtgcctcgggcagatacgagtacttcatggttgagttgccgatgccacggccgaacagaccgcccgaggcaaaggccatgatggcaagcgtggcctgatagccgtcaccatactcgtcggcccaagggttcaaggcaacctgaatacgcaccatacggtacggctctgcgacaagcgcaatcacgatcacgagaatgccgaagattagcacgccgatgataaatctggggtcgagacccgcaaacaacgccatgcacatgagggtcaacaggatgatcagaacagtaccgaaatcgggctggataaagatcagaaagagcgaaattcctaggtagatgcccatcttgcgaaggaattcgttgatgttgccaccgggcgaaaaaaagcgatcaagcatgatggccgaatacgcaatggcaaatggctttaaaaactcggaaggctggaactgaataccggcgatgttgagccagcgcgtggcgccacggctgccgctgcccaccaagaacaccagaagcagtagccctatcatgccgataaggaagatcctgagcatatcctccccaaaccagctgtccggcaaaacgcgcacgatggcaatcagcgccagaacaccgaccacggcaaacgcggcctgtcgacccagaaaaaacgtcgccgagccattctcgtgcagcgcctcgaccgaagacgccgagtacaccatcagcaggccaaagcataccaaggtaaacaagcaggccatgaatatcaaacgggggcgcatgatacgggcgggaacgccggcaatatagcgttcgctaaacgactgcccgccgcggctggaacgcggtgtgatgcgacgtgaggaagcacggtccgagtcgggcctcctcataccttgtcgggggctctcctctctcaccgcaacccctattccatttgtgatttcgctgcagcggcaagctgggccacgtagtccttaaacacgcggccgcgatcctcatagcccgagaactcatcgaacgaagagcaggcaggagaaagtaagatcacgtcaccacggctcgacagcgaacgggcgacgtccacggcgtcgcgtaggtcatccgcctgggcgatatccacatcgccatcgacatcggcctcgtccatagcggcggtgaagcgctcgcgcgcatcgccaaagcagacgaccgagcgcacgttgtccataacgacgcgcgagaagtccgtgagcggcgtgcccttatcgtggccgccgagcagcaagatcacgtcgtcatcgggaaatgccgtcagcgccttctcgaccgcatcggtgttggtcgccttggaatcgttgacgtagcgcacgccgtcaatctcgccacacggctccacgcggtgctcgagcggctggaacgaggcaagaccgcggcagacaccatcgacatcggcaccgaccgccaaggcagccgtggcggcgcacagggcattgataacattgtgatggcccgagatcttgagctcggatgtagcgatgagcggggtctcgacgcccttcaggcgcacgatcatcttgccatcgcgcacaaaggcggcatcctcgccctcaggctcgtcaaaggcaaccttgcagatgcgacgacccggcgtgtagatgtactcatcgaactcgtgaatgccggcgtcttcgacgtcgacaaccgccagatcgtcatcgaccatattgtcaaacagtttgatcttggcaagcgcatagttcttatggctcttatgccagcccaagtggtcgggagtgatgttgagcagcaccgccacgcgggggtggagctcggttgtcgtagcaatctgatagctcgagagctcagccacaaaccactcgttatgggctcggccgtcaatctcgttgaccggcggctcgccgatgttgccgacagcaacgctgtcctcgccggcagccttgagcagataatcagtcagcgacgtggtggtcgtcttgccgttggtgcccgtgatggcaatccagttatcgggcgacagacgataggcaaactcgggctcacccataatctgggcggcatgctcgcgcccggccttaaagaagcccgagaactccgagatgcccgggcacgtcacgcatacgtcataggcgccctcgacctgttcggtcccatagacaaacgacacaccagcagcctcgagcgcacgcgtggcgtcattgggctcagaggtgccgccgccatacacggtaacggcgcttacgcgctcgggatgtgccagcgcccagcgggcgacatcgagaccggatttgccctgacccaaaacgagcaggctaaagacatcagcaagaggcatgaaagaccactatcccaactggaagaacagggcaaggccaacggcaccaaaggccgcagcgataatccaaaaacggatgacgaccttggtctcggcccagcccttcttttcgaaatgatgatggatgggcgccataaggaagacgcgcttgtgcgtaaagtggaagtagacaacctgaatcatgaccgacagggtctcaacgataaacaggccgccgatgatgagggagacgacctcggtgttggtcatgatggacgtgcaggcaaacgcggcgcccagggcaagcgagccggtatcgcccataaagatgctcgccggatagcagttgaaccacagaaagcccaagcaggcaccggcacacgcggtgcagaagatggacaggttcacgtctccgtgcaaaaacgccatggcagccatggcgagcatggcaatcatggaggtgccgccggcaagaccgtcaaggccatcggtcaggttcacggcattagaaagaccggcgatcatcagccagcaaaagacaatgtagagccacgggaacgaaaggccgcagatggtggtcgaaagcacgccaaggtcaatcgtcaggccgccgggaaaacgaatctcgggggcgacgccgcaccagttgacggcaagtaccgtaaaggtgacacagataatggttaggccgatcatcttggcatgaggcgtcagaccgagcgagcgcccatgcgtaacggaggtcaggtcgtcgatcaggcccagcacgccggtcgccagcgtggcgagcagcacgagcacgagctcggtggtgagcttgcccatcagcaggcaggtcagcgaaatcgcgacgagaatgacaacgccacccatggtgggcgttccctgcttaaccaaatgacgcttggggccgtcggcacgaacctgctggccgataccctcgaccttgagcagcttgatccaccacggcatgagcagcagcgcaatggcagcggcgatgccaagccccaaaaaagcctgatacgttggatacgagggattgccgaacatgggctagcacacaccttccacaaagcggtcgagctcaacaaagcgggaacccttgaccagtacaacatcatgtttttcaagcgcgccgcccatgcggtcgagcacctgctgataatcggagaacacctggatgcggtcctcgtccatgcccatcatgcgcgcggcatcggccataagctgggccagctcaccacccacgcacgccagcatgtcgagcttcttggcggcggcataggcgcccacgagctcatgcatgcgaggagcctcatcgcccatctcgcccatctcgcccaggatcgccatgcgagaccccgtgcacgaaagcgagcacagtagatcgaggccagcagccatggattcggcactggcgttataggaatcgtcgatgacgcgggctccgctcttggcgcgcttgatctcctggcggtggccggtgatcgtaagacccctaaaggcagcatcgatctgctcgggcatcacgcccaggcgataggaaaccgcggcggccttaacggcattaggaacggactgcacgccggggatggcaagcatggtatcggtcgtctcaccctggccaaaatcgagcgtaaagaccggacggccctcgtcatcaacacgaatgtcgcgggcacggacctcatcatcgtccgagacgccggccagcatcacatcgataccagcaggctgggcgaacgtatcgcgaatgaacggcgtaaagtcgtcctcaccgcccaaaaccagcagcggcaagaagtcgccggcggcgcacataccctggacaatctcggccttagcgcgggcgatgttctcgcggctgcccaaaatgccgatgtgagaggtaccaatcttgctcacgatggcaaggttgggattggcggactgggacaggcgctcaatctcgtggaaatggttcatgcccatctcgagcaccaggacctcggtatcggccggagcggaaagcaccgtgagcggcatgccgatcaggttattgaaattgcccttggtggcccagacacgatagcgcttggcgagcacggcggcgagcacgtccttggtcgtcgtcttgccgatggaaccggtaataccaacgaccaggcagccaagctccaggcgatacgtgtgcgccaaacgcagcagaaactcctcgggatcatcggtcagcaggatggcgcaccccttgtcctgcgccagcgagaccagctcggcctcgggctcacgcgtcatcacgacggcgccggcacccgactggacggcacgggaagcaaaatcattgccgtcgacgttttcaccgggaaaggcgacgaaaatcgtcccttcctcgacctggcgcgagtcgataacgcacccgcggcatacccgatcggcttctcccgtcacggttcgggcccctgttgcggccgcgaggttgttgacggcgatctctatcattgcagctcccctgtaaacctaataatgctatcggcgtattgtatcccagcgccgcacatgcgtggtgcagggcatgtgaacaccctcatatgggacaacaaacaacgccccaaagattgtaaccccctacttcgtgtgcgggatacccagcacgtcgagcgcgttggccataatggactggaacggcaccgcagcggcatctgaaccgctcggcgttccgtcgagcgtgatatagcacagcactttgggcgattgtgccggtgcaaagcccataaaggacgacatgtagttctccttgaggtagccgccgttctcgtcggcacgttcggccgtaccggtcttacccgccacgtcatagccgtcaaccgcgccgccaacgcccgtaccctcggacacgaccgtctgcatgcacgatgtcacctgggatgcggcgtcctccgaaatcgcgcgctcgccttcgccccagtccttctcgtcgcccttgctggacttatagaagtgcggtgtcatcatcacgccgccgttggcgatgccgcccacggcacgtgcgatctcaattggcgagacggacagtgcctgtccaaagctcatcgagcccagcgtggcgccgtcatactggtcacgctccttgacgatacccaggctctcgcccggaaaatcgacacccgagctgtgaccgatgccccacttgtccacataggcggcaaagtcgtcggcaccgatcttgcgccccactaggacaaagcccacattggacgaacggcgcatcatctcgcgcacatccatggtcatggcatagtcgcgcttgtcggcatcggtgacggtatcgtcgcccaccttgatgctcgccggcacctcaaacgacgtactcgatcgcacgacacccaagtcgaagccggcgcccgccacgagcgtcttaaagaccgagccgggctcgtaggcgtcagtgaccaggcgcaggttcatatcctcggtcttggcgttctccagatcggtctggtcgtaagtcgggtacgagcaggctgccaagatctcgcctgtcgtaggatcggtgaccagcgccgagccgttcttggcctttgtcttctcgacagcctctgccagggcatcctcggccgcacgctggatattgacgtcgagcgtcgtcacgatatcaacgccgtcgaccgcagccacctttttataggcaccgcccgcgatatagctgccgtccctcgcgcgctcgcgtacgagagaaccgttcgtgccggtcagaagcttgttgtattgcttttcgagacccgtcaagccgtcgttgtctacattcactacacccagcacctgcgatgccagattgccgtatggatatacacgcttcatggcctgctcaaaaagcacgccgggcaggttcttcttctccagcgccgcaacatcgtcttcgtccacctggcgcttgatatacacccaggttccatcggactcgacgagcttgcggcaggtctttttatcgattccagttgccttgaccagcgccgacaccgtcttgtcaacatcctcgacaagctgcgggttcacggcgatgttgcgacattcgaccgacgacgccaacacgttgccgttgcggtcgtagatggtgccgcgtttggcatagagggtctgcgcaagcaggcggcgcgcatcggcacgctcgcgcagtttatcggcttcgacaatttgatagtcggcaaggcgaaagacgcccaagcccaagccaagcccgatgaagcccatgacggctttgcggcgaggcagaggcgcgcctgtgagccattcggtcgacgaactcttgcgcgacctggtgttatgcacttgagggccgcccgagccgcgaagtcgcgacgccgggtcgttgccacgggaccgcccggcgttgtaagattgccgacccgttccttgataaccagaacgtccccgcgacgagggacgtccagaaccgcggcccccatcggaaccgcggcgatagtcatttgtcatactcagctaccgtcttgctactgagcggtcgcggtcgcgttggcgcccgcggctgcatcctgcgaaaagtcaagtgtaacgctctcgctgggctccaccatgccataagcgcccgcaaggtcgcgaatgcgcgtgtcggcaccatagaccgaatgcatgacctccaggtcggagctctcatcggtcgccttttcgagcgtgctggtaagctcggcgttgctgttgagcacctgggccgtaacgccggcgagcgccacgcgggcgacgccgatcgtcatgaagatagccgcaatgatgcaaaacgttttaagaacgctcatgaaaaccgggcttaccgcctggtttgcctgacggcccgcgcccgtgtagacatcaaagcgcggcgtgcgctgctcacggggagcaacgggggcctgcggcgtctcacgataggcgggcatggcgttcatatcataggcgagtgctgcgcttgaagtgttgtagcccatgatatgccgcctcccatcccgagtacgttggtagtgtgtttaagcttcgtttatggtgcgagcgggaggtccaatatcgcgcggtcgcgcctacagacgctgcgccacgcggattttggctgatctcgcccgagggttgcgctcaacctcatcaggctgggcaaccaggggtttgcgggtgatgaccttgagtatcggcacgttgccgcacacgcacaccggaatctccggcggacacgtgcacccctggctcatctccttaaagtggttctttacgatacggtcctcgagcgagtgatacgagatgacgcagatacgtccgcccgggttgagccacctggtggcggcatcaagccctcgttcgagcacatcgagctcgtgattgacctcgatgcgaatggcctggaaacttttcttggccgggtgtccgccatgccgacgagcggcagccgggatacccgccttgatgatctcgacaaattggccggtggtttcgatcggttcttgctcgcggcagcgcacgatctcgcgcgcaatctgcgaggcgaacttctcttcgccgtagacgcgtagaatccgggcgaggtcgtgttcgttataggtgttgatgacctcagctgcatttaaggtgttattacccggatccatccgcatgtccaatggggcgtcctcgttatacgaaaagcccctgccagggatatcgagttgcggcgacgaaacgcccaaatcgaacaggaagccatcgaccccgggcacctcggccgagcaaagcagctcgtccaagtcgccgaagttgcccttcaggagctggtgcggaacgccgggaacctcgcggtccagacgggcgccagcggcctcgagggccatgtcgtcctgatcgacgccgagcaaaaggcccatctcccccacctgcgcggccatctttaccgaatggccggcaccgccaagggtgcaatcgcagacaacggagccgctctttagccgcagcgactcaagcacttcgccgagcatgacaggttcatgccgatattcttgtgtcaagatcccacgctccatccgttacccgtgccttgcccttacgagaagaagaggtccagcagggcctcatcgtcatcgtcctcatcggccgcggcgcgatcccaaacctcaaggtggtcgtagttgcccacaaccgtgacctcgcggtcgagtttcgcctgcttgcggagagactcggaaagaccgatacgaccggcgctgtccacgtccatcgacgtggtgcgcttgttgatcgccctcatgagcttctggtcattaatgtcacgcgggttaaaaccctcgtggccctcacgacccgcgaagagtccttcgacccacttatcgaaggcctcggcagagaacacgtacagagcatcgacatccagggctttgaacacgcgaacctgctctccaagctcctcgcgaaggggtgcaggcagggacagacgaccttttgcatcgagattgcgctcgtatgcaccagtcattcccatgtgcgccctcccctcggttactcagatggcacgtacgcggagaaccaccccgcctgtcgacgtcattaataatatggggaaccgccccatttttcaacacctttccccactccttcccccacctcgccccaccgctccacccaccatatattgcaaaacacccccaagcatatgttcgaaaacacaatatgttgtgtttacagcaacggcgggatgccacctgtggcaccccgccgttcaacctcaaccttcaagttgaccttgaagcgatttttgcgtccctttacatgccattcacatcgcccccaaactcccccacccaaggcacgtgcggcccaccaccgcgacgccaagtggcgaaaaatgggacgggcaccagattgcccatgcgcgcgcaaaagcacgccacggcaatctggagcccgtccccaaatacctataaatatgcaggtcagcgatgtgttaacgatgtgccagcgggtgcgccgccagatagacctcggtcagttgcgtacgatcgacatgcgtgtagacctgcgtggtcgatatatcggcatgtcccaagatctcctgtagcacacggaggtctgcgccgcccgcaagcatatgggtggcaaaggagtgacgcagcgtatggggatggagccccaccagtcccacctggcgcccgtagcgctcacagatggcatggatgccctggcgcgacagacggcggccgttcttatttaaaaagaccgccgaggtctcggttccgcgggcatgggccgccaagcgagaacgcccctcagttacataaagcgccagagctcgcgccgcgcttcccaccagcggggacagacgttccttcgagcccttaccgcgaacgagcacaaagccatcgtcgatatggatatcgcccacatcgagtcccaccaactcgctcacacgcaaaccgcatccatagagcacttccaagatggcatggtcgcgcaagcccatctcgccctcggggaagtcttgatcgagcagcgccgagacatcctccaccgatagatactccggcaaacgctcagcctttttaggcaggcgcaacgccgccgttggattttgggccacagccccatcgcgcaccaaaaaggcatgtaggcccttcacggccgcaagcgcacgctccaccgaggcatcggaatagcccccatcgcgacggtcggcgacaaagccctccacgacctgacgggtcacctcttcaaaagacacaatacccgcccgctccagataggcgcagtacgtcgtcaggtcacgacgataggccgcaatcgtgttgcgcgccaaaccccgctcgaccgcgaggtaatcgagatactcccccgccgccacggcgagcgacgagggagtagcttcggtatgttccttattcgccggcacccttagtccgtagcgaggttcatgggcgtcacctgcagacggtcgacaccctcgtgctggccgatcgaagcgcgcacgaactcgcggaacagcggctgcgggttggtcgggcggctcttgaactcgggatgagcctgggttgccacataccacggatgcacgtcgcgcggcagctcgaccatctcgaccaggcgctcgtcgggcgacagacccgagataaccaaaccggcgtcctcgagctggtcacggaaggcgttgttgaactcaaagcggtgacggtgacgctcgtagacgagctcctcgccatatgcctcgcgagcaagggtatcggcggcgagcttgcacggataggcgcccaggcgcatggtgccgcccttctcggtcacgtcctcctgcgagctcatcagatcgatgacgctaaacgggccgtccggatcgaactcggaggagctggcgccggcaaggccgacgacattgcgcgcaaattcgcacacggccacctgcatacccaggcaaatgcccagatacggaatcttgtgctcacgggcaaactcggccgcgaggatcttgccctccagggcgcgcttgccaaagccgccggggaccaggatgcccgaggcgtcgcccagaacctcggagacattctgctcgtcgaggctctcgccgtcgaccagctggacgtccacatggcgatcgtagaagacgcccgcatggtgcagggcctcgataaccgacaggtacgcatcgggcagctgcgtgtacttgcccacgacggcgatcttcaccttgtcggcgtgatggttggcgtgattctgtttgcgcaggaactcgttccactcgctcatgtcgcgctcacgcgggtccagacccaggcgctcgcaaatgcgcaggtcaaagtcctgctcggcaagcagctgcggaacatcgtaaatgctcgcgcagtcctcgttggtaaagacgcaatcggtgtcgacgtcgcagaagcttgcgatctttccgcggatagcgtcatcgatatggtggtcggagcgcagcacgataatatcgggctggatgccaaagctgcggagctccttgacggaatgctgtgtgggcttggtcttgacctcgtgggcggcggcgatatagggaacgagcgacacgtggatgtagcagacgttctcggggccggcctccttgcggtactgacggatggcctcgacaaacggctgggactcgatgtcgccaatcgtgccgcccagctcggtgatgactacatcggagccggtctgctcctcgatgcggcggaacttgtccttgatggcattggtgacgtggggaatcacctgcacggtaccgcccaaaaagtcgccgcgacgctcgcgggcgattaggcttttgtagatggcaccggtcgtaaagttggaatcgcgggtcaggttctcatcaataaagcgctcgtaatgacccaggtccaggtcggactcgtaaccatcctcggtaacgaagacctcaccatgctggaacgggctcatggtaccggggtcgacgttcagatacgggtcggccttctgcatcgttactttgtagccacgcgacttgagcagacggcccagcgaggccgcggtgatacccttgcccagggacgaaaccacgccaccggttacgaacacatgcttggtcatattgagttacctgcgcttcccgtagaagttgtttatccacatcttacgggtcttcattgtaatactcgcgccgcggaccgttcgcaatttttctcgcgtgcgattgcatttctcaatcttgaaacaaaacgccgcccggtttcccaggcggcgtcgctatggcaagggttacatgctgctatcgatcagcaacctcgtcctcaagcatttcttgaacgagcatgccggtacggacgccgtcaagataccactcgccacgttcggtgaggcaaatgccatttgcaagctgaccgccgtcgtcgctataacgcgagacgacatcaatcatgccttcggaatccaagcgatcgattgcggcgcgggcacgatacggcgaaacccccacgcgctcggcaagcgttttgcgcgagaaaccatacggcccgccattgtcttcggtttgctggtcgatttccatcaacaccagcacctcaacacgcttcatatcgttgacactcgcacgacccttgcccgccatagcagcctcctcaaaccgagcacgagcatctaacgcgccgtgcgcgaccgacacacctcacgatggcaggtaatatccatcatgcggcatcccgctaaggatgaaacagttacggttattgtataccgctcaaattgtttctaggcaggtaaacagctatttttcgccgaaataggcgctttattgatcaaaaagccgtaccgggcgctaactcgatacggccaaaatgcaatgcaattaccgcggtgcttcaaacttagcgatggaagaaaccgcggcgctcaaacttgggctcgcagcacacgttgatacccagtttgcgcagtaccgtctcgtccgtcggcgagataatcacgctaaagaaggcatcgcaaccgcgcagctgctccaggcccgaaaggacgcgagcggccgtctcactcgtggccgaggtgatcgacagcgccataagcgtctcgtcggtgtggagacgcgggtttttgctgcccaggaaatgcgtcttgagcttgctgatgggctcgatcgcttcatcgctaatgacctcgagctcaaggtcgacgcccgagacatgcttaagtgcattcatgatgagcgagctcgcagcgcccaggcgcgtggaagtcttgccggtcaccacggagccatcgggcataaccatggcacccacgggaccacccgtcagttgctccctggtgagggccgccgagcgcgccggtgagtagttcttatcgatgccggctttcttcataatgatcttgagacggtcgacttgctcatcgcccacgccggtacggcgcacattttcgaccgcggtaaagtagcggcggacgatctccatcttggaagcgtcgcggcaggcatcgtcatcggtgatggcaaagccgaccatattgacgcccatgtccgtaggactctggtaggggctcttgcccaggatcttttccatcagagcacggaccaccgggaaggcctcgacgtcgcggttgtagttgaccgtggtcttgttataggcctcaaggtggaaggagtcgatgatattggcatcgtcgaggtccgccgtggccgcctcgtaggcgatgttgaccggatgcgtgaggggaaggttccagaccgggaaggtctcgaacttggcatagccggcggccgtgccatgcttgtgctcgtgatagagctgagacaggcaggtggcaagcttgcccgagccaggaccgggggcagtgaccacgacgagcggtcgggtggtctcgacaaactcattcttgccgtagccatcgtcggacacgatcagatcgacatcgtgcggatacccctcgatgggatagtgcaacttggcgggaatgccgagcgcgttcaggcggttgcggaacacatcggcagcaggctggccagcatactgggtgatgaccacagccgcgacggcaaagccgttgccgcggaacaggtcaaccaggcgcagcacatcctcgtcataggtaatgccaaggtcaccacgagccttgtttttctcgatgtggttcgcgttgatcgcgataataacctcgacatcgtcggcaatgctcttgagcatgcggaacttgctgtccggctcaaaacccggcagcacgcggctcgcatgatagtcatcgaacagcttaccgccaaactccaaatagagcttgccgccaaactgcgagatgcgctccttaatatgagcggcctgcagctcgatatatttcgcgttgtcgaaaccctggcgcatgtatggctcccgtcccgtttccatttaatgtcctaggcgattatagcggagcagaccctcccccacgcacttcccctgcaccaacaaagggaatgtcgcaggttgagcataagtcagcgaatgggcaccagtgcgggcaagctgtccccctgcaccaacaatggcagcgccgcaggtggaacaaaagtcagcgaaagcccgccagaacgagcaaggtgacgtgaaagaggaggacatggcgcaaagcaatctgacacctttgcaccaacaagggaaaagtcgcaggttgagcataagtcagcgagcgccgcccaggacgtacaagttggcatgaaaaaggcaaggcatagaccttttggtcatgccttgccttttgaatgacaaattgtcgtcctgggcggcgcgcagcgttgactggttgcgcggttcgtagaaccgcgcaacataagtgcgccccctcccgcgcacggaacgggagggggctaaaggtaggagtctaccggtgggtttaccccaccggacagacgatgaccaggtgatcctctacaggatcgtcaaggtttccgtggggtacccgttgggtacttagagcagcacgcaggcgacggtcaggatgacggcacagacgacggagagagcgacgatgagcttaagggcaaacttgagccaggtcgtccactcgatcttggccagggcgagaccgcccatgatggcgccggaggtcggagtgaacaggttcacgacaccgatggcggcggagaagatcatgaccatgacctcgggcgagaagccgagcttaacagccagcggtcccatgatgggcatggagacggtggccataccagaggtcgaagggatcaggaaggacaggccgaagtagaccaggaagctcatgggagcgaagatcacgccggacaggccagccagggcattggcggcagcgtcgaggacgaagacatcgaggccggtgttagccatgaggacggagataccacgggcgagggcgatgacgagaacaacggacatcatgtcggcagcgccggtgatgaaggtgttgacgatctgcttctcggacaggccaccgatgataccgatcaggacggccatgaggaagaaccaggtggaagcctcgtcgaagtaccactggccaatgggcaggccggtgatcagggcagaccagccctggacgacggcgttaccgtcggcgtcgtagacagcgccggcgtcgaagaagttggcgacgccctcgttgaggtcggccagcggaatgaagccgacgatcatgacgacgaaggtgaaggcgaaggcgatcagaacacccttctgacgaccggtgagcttgacctccttgtggacctcggaagcagccttgccgtgagcctcttcggcgtccttaagctcctgcatcgacaggatggtggaacccttgtcagccttgaccttcttggcatagttcatcacgaagaagatggacatagcggtagtgacaatccacaggacggcaccaaggccgatgatgatggactggttgacctcaatgccaacgccggtcagagcgtcgacggcagcgccgacggcgaacgggttaaccgtggagcccaggcagccgcagccagcgccgagcaggacggtagcggcaccgaccatggggtcgaagccagcggccatcatggtagcggcgagcagggcgtagaagggaacggtctcctcgcacatgccataggtggtaccaccgagggagaagatgagcatcagcacgggaatgagcataatctcgttgcccttaagcttctgcaccagaacggcgatgccgttgtccagggcgccggtctcggtcatcatgccgaggaagccgcccaggatcataacgaagaggcagacgggcagagcgtcagcgaagcccaggatcggggcggtgcagaaatcgctcagacgggcggcagtaaccgcgccaccggacgtgccggagacgataacggtaatcactgcaacaattgccagcagagcaagaagaatggtgaacgatgaaggcataccgcgctttttcttagcggtctcagtcatagttctcatccccccttcataaatcatttactgatctcgcccgaagcggctcttccgtgccgtgcctgccgcttgatgcgagattattaccagataaaaccgctcggggtgtccagcaatacaccccgagcgagatgctagatgctcttacttgagcgtggcgtacatgacagccttgatggtgtgcatgcggttctcggcctcgtcgaagaccttggaagcggggctctcgaagacctcgtcggtgacctcctgctcggtgatgccgaactgctcgcacttctcggcgccaatcgtggtgttggtgtcgtggaagctgggcaggcagtgcaggaagatggcacccgggttggccatagccatgacctcggaggtaacgcgatacggggtgagctgagcgatgcgctcggcccagacctcgtcgggctcgcccatggagacccacacatcggtgtagataacgtcggcaccggtgacgccgtccttgacgtcagtggtcagcttgatggtgcagccgttagcctcggcgatgggcttgcaggcctcgatgacgtcgtcagcgggcatgcactcctcggggccgcaagccacgaagttcatgccgagcttggagcagacgaccatgagggagcgagcaacgttgtttttgcagtcgcccatgaagacgagagtcttgcccttgatgtcgtagttgaagttctcctgaacggtcaggatgtcggcgagcatctgggtggggtgccactcggtggtcaggccgttccacacgggcacgccggacttggcagcgagctcctcgacgtcgtcctgggcaaagccacggaattcgatgccgtcatacatgcggccgagaacgcgggcggtgtcctcgatggactccttcttgcccatctgcgacgaaccgggatcgaggtaggtgacgcccatgcccagatccatgccgccgacctcgaaggcgcagcgggtacgagtggaggtcttctggaagagcagaacgatgttcttgccctcgagatagcggtgcggaacgccagcgcgcttcatgtccttgaagttcttggaaagcttgagcaagtactcgatctcctcggtggagaggtcgaggagcttgaggaagctacggccggagaggttaacacccatggttcgtttcctttcgaaaaaatgaattacgtaagtattagtgttgcccgtttgacgggcgaaaccggtgcggttgtagggggaccgcaccggaaacggaaagacttagaggtcctcgcgccagaagggcatgctcatgcagcgcgggccgccgcggccgcgggagagctcggcggagggcacgacgagaaggtccaggccctccttgtacagcacgtcgttggtgacggtgttgcgggcgtagacgcagatcttgccgggctcgacgcacagggtgttggagccgtcgttccactgctcgcgggaggccgcgatcgggtcgccgccgccgcaggggatcagcttgacctggtcgacgccggtggcgtcctccaggacgtgctcgagggtgtcctcgatcaggcggatgttcacgtcgcccgggttcttgccagcggtcagctcgtagacgcgcagggtgcccatgatggcggggtggatcgtgaacttatcgacgtcgatctgggtgaagaccgtgtcgaggtgcatgaaggcgcgcgagaccgggatgtcgaaggccaggatgtgctcgaccttggagtcggagttccagaagatgttctgggccatgacgtcgatagcggcggcctgggtgcgctgggagatgccgacggcgagggtcttctcgttgatgttcagcacgtcgccgccctcggtgtggaactggcagtcgcggcggaagtacagggagacgtccttgtagtcggggtggtacttgaagacgtacttgccgtacagggtctcgcggttgcgggtgaccgagtacatgcggttgaggttgacgccctcgccgacgaccgcgaacgggtcgcgggtgaagtagaggttgggcatcgggtcgatgatcaggtcggactcggactcggagttgaccagggagtcgagggtcgtggacgccgtgaggggcatgtcgatctcggccttggtcatgccggccatggtcttcttgacgaactcgaggttgtcctcgatggagtccagcttctcgcggacgatctgcggcatgtgctggccgcggatgccggcctcggcgatgtactggtcggtgaactcggcgcgggcgccggggacctggtcgaacacctcggcgacgaggttctcgaggtagaggacctccacgccctggtccctcaggatctgggcgaaggtgtcgtgctcctgctgtgcgacctccaggaacgggacgtcgtcgaacaggagtcgctcgagctcgtcgggcggcaggttgaggagctcgtcgccgggacggtgcaggcagaccttcctgagcttgccgatctcggaaggcacgtgcagacctttcgtcatggcctcctacctttctttcgggcccctgtcagggccgattcgttagcgcccctccgtgtgaggcgttattgctgacgacatatttatatccaaaatcagttcatacttccacctcgcccccgaacggttttatatgatgggtgaacggcatacacatatacttcacgcatggcacactttgatttaataaagtttatttacgtgcttaaacgcgttttcaatctaaataacaaatggaacttaactttattaaaccaccctcaaattgcatatttccaataaagctatgaatagaattagcgattcataccgcgtctcaaccattttcatttttattcagaaaaaagtttgtcctattcatttctggtaacaaattaccgtttaccagacgcttgataccgttcaccggaagctcagtataaggcccatcggataccggttcgccttacggcctcatttgtaacaacttgacttctcggtatagaaaaacagacccgctcccctcttgggaaacgggtcagttatcgataatcgtagacagatttgagcggctttgagagccgtcggaatcctagcgatcgaacaccgccagtgcctcgcccagaagcctcagaccctcgcgcagaacgtcctcgctcgcgcagtagcccaggcgtgcgccgcagggaagctcaaagcggctgccgggaaccaacagcactcccctctcggacagcaggcgcttgcagaactcctcatcatcctcgggaatgtcaagctggataaacgaggtggacacgccctgcggggccgtccaggaaacgcgatgctgcgtatcaatccaagcctgcgcgatatcgcggtttccaaacacgatcttgcggttgcgctcgaggatcttgtccttgtgcttgagcacataggtcgccagggcgtcgttgaacacgccgccgcaaatcatggtgtagtcgcggtacgtgcgaatgcggttagatacctcttcgtctgccacaacccagcccacgcgggtcgcaggcgtcgaataggtcttggacaccgagttggtgacgatggccttctcgtacacatcggccatcgacaaaaagtcctcggtgttctcaagcggcaggtacacctcgtcgcacagcacataggcgccaaccgagcgggcaatctcggcgatctggccgagcgtatcggcatcgagcaccgtaccgatagggttcgatgcgttattgatgcaaatgagcttggtgttggggcgaacgaggcgcttgagctgttcgatatcgggtttccatccgagctcctcgcaaagctcccaatactcaacctcggcgccgagtgtacgcgggatctcatagagcggcgcataggtgggccactcggcaatcacatggtcgccgggctcgaccacggccatgatggcgttgaggttggcacccgtgcagccattggtctgcagaatatgatcgggattgacctcgcgacgatacagcttggcaacctcggccttaaactccggcgaaccctcaatccagccgtagttcattttctcgcggtccaggcgctcgtagaacgtggcaccatcttggtcgtcgagcgcgcgcagctcgcccatggtaagcgaggagattgtcgactgggcgatatcccacgtagcgctcttctcccaaacgttaagccattcctcaacgccgattgtcttgatgtccatggcaaagctccttacaaaagcagtcatccaaccgtgttgacgttcctcatacaagattggggcggtgcgaaaacccgcaccgccccaatgggagacatctaatggcagctagatgtatgtattatgacctgtacgggtccttgaagaccttagaggtcctcgcgccagaagggcatgctcatgcagcgcgggccgccgcggccgcgggagagctcggcggagggcacgacgagaaggtccaggccctccttgtacagcacgtcgttggtgacggtgttgcgggcgtagacgcagatcttgccgggctcgacgcacagggtgttggagccgtcgttccactgctcgcgggaggccgcgatcgggtcgccgccgccgcaggggatcagcttgacctggtcgacgccggtggcgtcctccaggacgtgctcgagggtgtcctcgatcaggcggatgttcacgtcgcccgggttcttgccagcggtcagctcgtagacgcgcagggtgcccatgatggcggggtggatcgtgaacttatcgacgtcgatctgggtgaagaccgtgtcgaggtgcatgaaggcgcgcgagaccgggatgtcgaaggccaggatgcgctcgaccttggagtcggagttccagaagatgttctgggccatgacgtcgatagcggcggcctgggtgcgctgggagatgccgacggcgagggtcttctcgttgatgttcagcacgtcgccgccctcggtgtggaactggcagtcgcggcggaagtacagggagacgtccttgtagtcggggtggtacttgaagacgtacttgccgtacagggtctcgcggttgcgggtgaccgagtacatgcggttgaggttgacgccctcgccgacgaccgcgaacgggtcgcgggtgaagtagaggttgggcatcgggtcgatgatcaggtcggactcggactcggagttgaccagggagtcgagggtcgtggacgccgtgaggggcatgtcgatctcggccttggtcatgccggccatggtcttcttgacgaactcgaggttgtcctcgatggagtccagcttctcgcggacgatctgcggcatgtgctggccgcggatgccggcctcggcgatgtactggtcggtgaactcggcgcgggcgccggggacctggtcgaacacctcggcgacgaggttctcgaggtagaggacctccacgccctggtccctcaggatctgggcgaaggtgtcgtgctcctgctgtgcgacctccaggaacgggacgtcgtcgaacaggagtcgctcgagctcgtcgggcggcaggttgaggagctcgtcgccgggacggtgcaggcagaccttcctgagcttgccgatctcggaaggcacgtgcagacctttcgtcatggcctcctacctttctttcgggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctcggaaggcacgtgcagacctttcgtcatggcctcctacctttctttcgggccttactggccgaatgtatcagcgcccctccgtatgggacgctgcttgctgacagctctagttatatccaaaaaccaccagcaattccacctcgcccccgaacggtcagcaaagtgcgatgaacggtatatcgcatatgattcccccatgatgcacttcagttctctaaagcaggttttcaaaggtaatcgttcttttttctaaggaattgagcaagattgcacaaataatttcatgtttaggaattgcatagctaaaactgttttctgcatatatatgtcgtctgtccatgattcaatttggattcgattatattcagctcgcaatcattcttattcatacatcctcaccagttgagtatggatatagattgttttcaaaacgagtcgggcagttagttgcatgccttgacggcgtaagaagtaggttaagataccgttcgcacaatacgtccgtgccacaagtcgactaaattgagacaatagtgaatagggttaggctaccgtcccctgcggggactgaacggacagatgcatatgccgagcaaaatcgaaaaaaagcaagccgccgcaaagctgcgcaaaccgccgcgcgacttctcgtacacgcagaaccgagagctcagctggctgcgctttgacaaccgtgtgctcgacgaggcttttgatgagtccgtgccgctgttcgagcgccttaagttcgtctcgatcttcgagtcaaacctcgatgagttccttatggtgcgcgtgggtggcctgtccgaccttgccgagctcaaaaaacaacctgtcgacaacaagagcaatatgactgcctccgaacaggtcgatgctgtcatggccgaaatgcccgggctccttacccgttgggagtccatctttaagagtatcgagggcaagctcgacaccctgggcgttcaccgtgcgcgtgtcgattcgcttacgcccgaggagcgcacctttgtaacccgctacttccaggcctacgtgtcgccggtcatctcaccgctggtgatcgacccgcgccaccctttccccaacctgcgcaacggcgcactctacctggcctgcggcctggacggcgtcaccgacgaggaaagtctgctgggcctgatcgagattcccgcctcgatgaaccgcgtggtcgagatcccctcgcccaccggcacctactcctacattctgctcgaggacgtcatcctcgcctgcctggacagctgctttggctcctataagccgctcgaccgcgcgctcatccgcgtcacccgcaacgccgacatcgatccggacggcgagggcgtcgaggaggaagaggactaccgccagcatatgaagcgcatcctcaagaagcgcctgcgcctgcagccggtggttctcgccgtctcgggttcactcgaaaaagcaacgctcaagactatccgcaaggcactcgagctctcgcgtcgctcggtctttacctgcgacatcccgctcaacctgggctatgtcttcggcattgagggcaagattcccgagcacctgcgcaacgagctgctctttacgccgtttaagccgcagcccaaccccaccatcgatatgacccgctccatccgcgagcaggtacttcagcacgacaagctgctcttttatccctatgaggccatgaaccccttcctggatctggtgcacgaggccgcctacgaccccgagtgcatctcgttgcgcatcacgctctaccgcgtggccaagcagagccgtctgtgcgagtcgctcatcgatgccgccgaaaacggcaaagaggtcacggtgctcatggagctccgcgcccgcttcgacgagcagaacaacatcgagtgggccgagcgtctggaagaggcaggctgcactgtcatctacggctccgagggctttaagtgccactccaagatctgccagctcacctatcgcgagggcatggcgctaacgcgcctcacacttttgggcaccggcaactttaacgagaagacggccaagctctacagcgactttatgctcatgaccgcccatcccggcatcggcgaggacgccaacttgttcttccgcaatctgtcgctgggcaacctgcgcggcgattaccgcttcctgggtgtggcgcccgtcggactgaaaccgctcatcatgcgcgggcttgaccgcgagatccagcgcgcccttgccggcgagcccgcccgcgtgttctttaagctcaactcgctgaccgaccgcgaggttatcgacaagatcgccgaggcatcgtgtgccggcgtgcgcgtagacatgatcatccgcggcatctcgtgcctcaagcccggtgttccgggcaagaccgagaacgtgcatgtccgctccatcgtcggacgctttttggagcacgcccgtgtttacgcttttggcgtggactcggacatgatttacctgagctcggcagacatgatgacacgcaacaccgagcaccgcgtggagatcgccttccccgtgctcgaccccacctgccgcgccctggtacacgagtacatgggcatgcagctgcaggacaacgtgaaggcccgcagcctcacgagcgacggcacctgggtccccgtggagtgtgcagagggtgagaaacccttcaactcgcaggaagctctactggagcgtgcctatcgcaacgccgaggccgccgcgcagcagcgcgcacaggagaaggaacgtgtggccgaagaagctattcaggccgaggttgaacatggggcagccgccaaaccggaagcggttgccgctcccccggtgaatgagcccgaggctgccgcagagcccgccatggagaaagcgcccgagcccgctaccgcgactccggagcccgccgccgaggcaaagcccgccccagctcctgatccgcagccgaccacgcccaaggtccaagaggtccaggcgaccgtcattgagcccgagcctgcacctgcacctcagcccgagccgcaggtcaccaagtccgcacccgggacgagtgcccgtcgcgataagcccgccggcaagaccaaggccatcgagcgccatcgccccggtcgcgtgcgcatgggcctgggtctgatcggcctgggtcttaagacgctcattaccggcaagacgaaatagtcgtttgtagaagcagtttgtagaagcgccccgcatttgaggaaagcctcggatgcggggcgcttttccctgctaccatggtgcgagcaacaacgcgaatgacaggcaggaatatgaagctcactatagaatcgatgacctacggcgccgacgggctggcgcacgccgacaacggcaaggccgtctttgtgcagggtgccgtggcaggcgacaccgtcgaggccgaggtcgtacaggacggcaagtcgttcatgcgcgcccgcaccaccgagattctggagccaagccccgatcgcattcagcctccctgccccttcgtgggcatctgcggcggctgctcgtggggcaatctctcacgcacggcacagctcgccgccaaggagcaaaacctgcgctccacgctcgagcgcatcggcaagttcgcgcctgagcaggtcgatgagttggtacagcccatctgccacaccaaggacgactggggctaccgcaataaaatcgagctcgaaccgaccgtcgtcaacggtcgcgtgcgccttggcatgcatggtgtcgaccccagcaaaatcgtgaccgtcgatacgtgcccgctgttcgataagcgcttcccgaaggcgctcaaatcggtcgtcggcgcactcaactatctaagcggcagccatgacttggggctcgaacgcgtgggcattcgcgcatcgcgccgcaccaaggcactcgaggtcgctctctggacgcccacaggctcttttccgcgctcgcaggtctcccgcgtgctggcggacgccgctcatcccacgagcatcgtgcgcgtgatgagcaagggcgaaaagaaggcccgccgtgtctccaaggtcgaaatgctcgccggagagggctcatggaccgagaatatcgccgagggtcagatgcgcttgtctgccccgtcttttttccaggtcaacaccaagggtgccgagattttgatcgagcttgtcatggaagcgctcgacccgcaggaagacgagcttgccgtggacctgtactgcggtgccggcacctttaccctgccgctcgcccgccgctgcgactttgtcgctgccgtcgaggcctacggccccgccgtgcgcgatctacgccgtaacctggaaatcaacaagcttgataacgtcgacgtcattggcggagacgcggtgcgcgagttccccgaccaggatgccgacgtcttggtggtcgacccgccgcgtgcgggcctcgcccccgaagccatcgatcttatcgccagcacgagcgctcgcgatgtcgcctacgtgagctgcgatccggccaccctggcgcgcgacctcaagcgctttgtcgaggaaggcaccttctcccccgtaaagatcacgccagttgacctgttcccgcaaaccttccactgcgagactgtcgtccaccttaggcgcaactagccacttaatcattgctcagaaaaatcattgggaaatcgagcgtggcaagcggaggtcttcggggtataagacggctaattgtatgccgcctatgaaaggaacccccatgcccagcgttgccgttctcgccgccgatggctttgaaactattgaatgcttgaccatggtcgatgtcatgcgtcgcggcggcgtgcgcgccacgctcgtctcgatcatgcccacgcgtgaggtcgtaagctcgctgcagatccccgtgacctgcgatgcgctctttgatgagatcgactttgacgagtacgactgcgtcgtgctgcccggcggcctacccggtgctaccaacctgcgcgccgatcagcgcgtctgcgacgtggtccgcgagttcgccgcaaccaagcacgtcgccgccatctgcgccgccccgtttatcctgggcgagctcgacctgctcgaggggcgccacgccacgtgcttccctggctttgagaaaagcttccccgaaggcgcctataccggcgagaaggtcacgcaagacggcaacatcatcaccgccagcggcatggcccagtcgctcccctttgcgcttgagctgctgcgcacgctcgccggcgacaaggccgtcgataaggtcgccgagggcattcagctatgattttggcttcgcaatcaccgcgccgcatcgagttgatgcgcgaggcgggctatgacattcgcatcattcctgccgatatcgacgaaacgccgtttgatggcgaggccccgcttacgctcgttgaacgcttagcacgcgccaaagccgccgccgttgccgccgaacatgccgagcccaatgagctgacggtcgcggccgacaccatcgtcacctttgacggcaagattctgggcaagccggcaaccgaggacgaagcgcgcaccatgctccgtgagctttcgggccgcacgcaccaggtcgcaaccggcgtctgcatcgttaaggcaggcgacacggccgccccgcatgccgccgagagcctgtcctttgtcgatgtgaccgacgtgacgttctacgagctcaccgacgagcagatcgagcactacgtcgcctcgggtgagcccatggacaaggccggcgcctacggcattcagggcacaggaggacgcatgctcgtgcacgatatttcgggcgacttctataacgtggtgggcctacccatcgcccgcgtcgcgcgcgcgattcaaaaactctcgtaattgcatctggcgctgggtatcccccggcgcctacaattttggcgtaccgtacggatcccgaccgggcacaaggcgcggcggaaaaccgataggagttaaacatggatacactgctcaaagccattgacgtttgcgatgtcgatggcttttgctttggcaactatacggacgatgaggcaggcaccggctgcaccgtaatcgtggcacccgagggcgccaccggcggcgttgacgtacgcggtggcgctcccgcttcgcgcgagaccgacctgctgcgtcccgaaaacaccgtcgataaggtccacgccgtctgcctttcgggcggatcggcctttggcctcgaagccgcaagcggcgtggcccgcgaactcgagagccgcggtatcggtctgcctgtcggccccacgcaggtgcctatcgtgtgctccagctgtatcttcgatctcgcctttggtaaccccaccgttcgccccgacattgaggccggcatcgccgccgtgcgcgaagcactcgacaacacccccaccaagctcgaacagggcaacgtgggcgccggcacgggcgctaccgtgggtaagctcatgggccccgctacctgcatgaaggccggccttggcgctgccgccgtggcgctcggccccatcaaggtgggcgccgtggtctcagtcaacgcctgcggcaacgttgtcgaccccttcaccggcgagtgggtcgccggtatgcgcgccgcagccgatagcgaccagatcgtcgacatggaactcgcagcctttgctgccgccggatccatgcagatgccgctcgaccgcaccaacaccaccatcagctgcatcgtcaccaacgtcgaactcactaaggcacaagccaccaaggtctcccagatggccgcagacgcctacgcacacgccatccgtcccacgcacaccaccaacgacggcgacaccatctacaccctcgccagcggcaaactagacgctcagacaagcgccgccgttcccctagacctactgggcatgctcgccgtaagggccctacagaccgccatcgtaaacggagccaaaaccgccaaaacctcccacggcatccccggcgccgcgaagtagcctaacctgaccggttgcccggtggggcttggttatgtttgctgctctacagtcctggctcgcacgaagagcacattaagtgctcttcggctcgtgcggaactcgcgacaaacataaccaagccccaccgggcaacctaccaaccagattcttttcagcccaggcccctgtgtaccgcgcgtcgaagatcttcaaattcaaataaactgacaatcgattcttatagcagaggccccttggcctttagtttgatacaagttccgcacgagccggaaagcacttaatgtgctttccgtgcgagcaggactgttcgcagtagcaaactaaaggccaaggggcccagtcaacctatcaacagcgattactcagcagctagttgaatttgaagatctttgaggcaagacggtataggccaagcgtggttttgtctccggcccgtccgcgcagattggtgaagaacccgaccacgccgtagcgggcacgacgatacatgcgctcgtcgtaggccttcaaatcattccacagcgtctttaggcgctcgtcggcgcaatcttcctcggaaagcttggtgagcaccgagcagatcgccatcatcatggtgaagtagcccatcatgtacgaacgtaggcgtgacgactcgacatcgctgtacaggtggtacgactccatcatgatacgcgtaacacggaactgctggtccagacgcttgaccatcgtggcctcgttgacactctggccctcgcgaccgataaagtagcggtagaggtcgatgtcggcgtagtacatggtcttgcaacgcggcagcggcacgtaggcgtagatgttgtccacatagaacgtgtgcggcggcatgggaaggttggactcgcgcagcacatccgtgcgatagcacaggctgtgcatgagtaggttctggtccaggcggaaatgaccgatctgatcccaagaaaagatctttttgcgcggcagggcaaatttgtagccaatagcggtatgcgtgccctcgtaaaccttctcgtacacgtagttcgagataaacaggtcaacgcgctggtcgcgctcttcaaagccacgcagaatcgacagcatggtcgaaagggcagcaccgtcaagccagtcgtccgaatcaacaaccttgtagtaggtgccctgcgcctcgcgcagacccgaaaggacggcaataccgtgaccgccgttctcctggtgcaccgcgcggatgattccagggtaacgggcctcccactcgtcggccttggcggccgtctcgtccttggagccgtcgtccaccacgataatctcgatatcggtggcgtaattgctcccctccaagatagaggtgatgcaatggtccatgtccttggcggcgttatacgagggaataccgaatgttatgactttatgcatggcaggcgataatctcatccgaaagatcgagggcggaattggtcacagcgtccatatcgtagtaacgatactcggccagacgacccaccgggtggaagttcgtcaggttctggacgcgctcaagatagcgctcatagagctcacggttctcgggctcaagaatggcgtagtacggcgtctcacccgagccgggcgtataggccttggagtattccttcatgatggtggtcttgccgggcaggacctggccagtcatattcttgaactcagtgatgcgcgtgtaatcctcgctcgtggtgtagttgacggtgcccacgggctggaactgatccatatcgagcgtctcgaacttcatgtcgagcgtacggtacggcagggcgcccaggtcgagattgaacagctcgtcgagcggaccggtgtagacgatctcgccgccatagaccttaccgtcgatcttgacggtggtctcgtcgatctcgaagaggtcgcgggcgtccacgtcgcagaacacatcaatcagatcgtggtcgagcatatgctcaaacagcgcggtatagccgtcctgcggcatgccctggaagggagcctgcgggaagtagcggtcatcatcgcccacaaagacgggaacacggccggtgatcgagggatcaatctggtcgggcgtctggccccactgcttcatggtgtaatgcaaaaagacgttctcgtagacgtaatcagcgacctcggccaagtcggggtcgttcttcttacgcagctccataatgggcaccttgacatccttgccaaaggtctccacgagcttctgatacagctcctcgccgcgctcgtcaccaaaggcgagcttgagactcgcgtggttgaagggcacgggcataagggtgccgttgatgttggcgagcaccttgtgctgataatccgtccacttggtaaagcgcgacaggaaattgtgcacgcgctcgttaaaggtgtgatagatatgcggaccgtactcgtggatcaggattccggcctcgtcagtgcagtcataggcattgcccgcaatgtggctacggcgctccaaaacggcaacacgatagccgatggtctcggcaagacggcgggcgcaaacggcaccggcatatccagcaccgacgacaatcatgtcgtacgcgccggcgttaaagccttcaggcaggcctgaggtaatctgcatcgatactccttgtcaaaagccacgggctcgttagctgggcttttctcgaacattcttcgagacatatttatcagagcgattatagcgctaatgcgtcctataatgagcttgccacacaaggaaagctcaagcaccgcggcgtacaaatttgaaaggtaaacccgctagcagcgggtttattcgtgaacagccgggcgcctggagcttagtgaaacgcttgtaaggagtaacatgagcgatttccttaaccgtatgaagtctgccgccaaggccgaccttaagacgatcgtcctgcccgagggcgaggatccgcgcaccatcgtcgcggccaccaagatcatcgaggagggcctggcaaagatcgtcatcctgggcaaccccgacgagatcaacgttcccggcgccaccgtcatcgatccgcgcaatgccgagaagcacgaggagtacgcgcagaagtttgccgagctccgcgccaagaagggcgtcaccatcgagcaggctcgcgcccaggtgatggacgccacctactttggcaccatgatggtcaagatgggtgacgccgacggcctggtctccggcgcctgccactccaccgccgacaccctgcgccccgcgctgcagatccttaagaccgccccgggtaccaagctggtctcggccttcttcgtgatgtgcaccgacaccccgcagttcggcaccgacggtacgctgatcttcgccgactgcggcctcaacatcaacccgtcctccgacgagctctccgagatcgccatcgcctccgctcactcctggtccacctttatgggcagcgtcgagccgcacgtggccatgctctcctactccaccatgggctccgccggcggcgaggtcgccaagaaggtccaggaggccgttaagttctgcaaggagaaggctcccgagctcgccatcgatggcgacctgcagctcgacgccgccatcgttcccaccgtcgcccagctcaaggcccccggctcctccgttgccggcaaggccaacgtgcttgtgttccccgatctcgaggccggcaacatcggctacaagctggtccagcgcttcgccggcgccgacgcttacggccccatcctgcagggcatcgccaagccggtcaacgacctgtcgcgcggctgctctgccgacgacatcgtgggtgtcgtggccatcaccgccgtccaggctcagatggctgagtagcggacatatcccctcgggaccctacagggtaaagctctgaaaacgtcctcggatatgcatgaaacccccgctgcgaacttcgtgcggcgggggtttcttgcgtcagtgcggaatattttcagagctttaccctgtagggtccctgccgccacgtagcaatcagggaatccggggtggacggcggcttggctacgagctggagctgaaaatctgaatggatgggtgccgttgctgggagcgcaggcgttgctgatgatgatcactttggagattgaaaggccggtgggcttcggcggttgttgtgccggaaactacatcccagtttggaggcggattgtgggatgtggcttccgcttggggcctgtttgggaaactttgggacggaattttgctttattgtgggtcgcactttccgcaacgtgcctcaaccggaaagcgtgtcccagtatttgcgctcgaaatgggatggagtttccgtcgtccgcctgctagcaaaaaggcctccggagctgctgctctggaggcctttcgtttacttgcaaatgcgcacgttagttgttcttggtcagacgctcgacgtcgtgggcgatcatgtattcctcgtcggtggggatgaccatgaccgtgacggcggagccggcagcgctgatgacctgcgggccgttgcccacggcctcgcggttcttattgttgtcgatgcgcacgcccagccactcaaagcagtcgcagaaggccttgcggatcgaccagtcgttctcgccgatgccggcggtaaaggtgatggtgtccacgcccgccatggaagcgatcatggagccggcctgctgcatggccttgtaggcgaacatatcgaaggcgagcaggcagcgctcgtcgccctcagaggcgcgtgtacggatgtcgcgggcgtcgttggagatgcccgagatggcaagcagaccagactgcttgttcatcatgtcatcgacttcctgatagctgtatccgccctcgcgctgaagatagcacacggtggccgggtcgatggaaccgcaacgggtacccatcatcagaccgtcaagcggcgtgaggcccatcgtggtgtcgcggcacacgccgtcctcgatagcagcaagcgaagcaccgttacccaaatggcacgaaagcagacggtggcagcgcgaacccaggatctccttggccatcatccactcatagcggtggctcgtgccgtgagcgccgtacttgcgcacgtggtacttgtcgcacacgtccttgggcagcgcgtaggtataggcgacctcgggcatggtcatgtggaacgaggtgtcgaagaccgccacgttgggcagctccggatacttctcacggcaatactcaatcgccgcggcctcgccgtagttgtgcagcggggcgagcggggccacctcgagaatcttggccataacctcgtcgtcgacaactgcggaatcatcgaagtgccagccgccctgaacgatgcgatgcccaatgccatcaatcgtaaagtcggtcttctcgagctcctcgagcacgcgagcgatagcagagcgatgatcggggaaggggacctcctcggtctgcttggcgccaccgttctcggagtggccgaagatgcccatgcccgatccgatacgctcgcagttgcccttggcgaaaacctcgcgggtatcggtatccaaaagctgatatttaaggcttgagctgccggcgttgacaacaagtacgttcatgagactcctttgcagtgcaatacggtcgacgcagaccccttaaggcggccgcattttaataagaagttatcacaacttaataaatagctatcaggcatatcgcccaacgagcataaaaggggggccgaacggcgctcggtcgtccagcccctcccctcttgcaattacttgccgttgacgatgcgctcgacgtcggaagcgatcatgaactcctcgtccgtggggatgacgaaaatcttgaccttggaatccttggcggacaggcaccaagcgccgtcgccacgcagggcgttgcgggcatgatccatcttgacgcccataaaggccagacggtcggccacgccagcgcggacagccggagcgtgctcgccgatgccggcagtaaagaccagggtgtccataccgcacatagaagtagccatctcggcaaccttggcggcaatcttgtagacaaacatgtcgaaggcgagctgagcatcggggtcaccagcggcggcgagctcctcgacgttgcggcagtcgttggtcttgccgccggtcacagccaaaaggccggacttcttgttcatcatctcgtcgacctcgtcgaaggtgtagccaccctcgcgctgcaggtagcacacggtagccgggtcgatggagccgcagcgggtgcccatcatgacgccgtcgagtggcgtcaagcccatggtggtgtccatgcacttgccgtcctcgatggcgcacagggaagcgccggagccgatatggcacacgacgaccttgcgggcctcgccgttggtcatctcggcgatcttcttggagatgtagcgatagctggtgccgtgagcgccgtacttacggatgtgcagcttgtcgcaaacatccttgggaagggcgtaggtcttggcaacctcgggcatgttgaagtggaaagcggtgtcgtagaccgtaacgttgggcaggtcgggatactgctccaggcagtactcgataacgttggcctcggggttgttgtgcagcggcgccagcggagcgacctcgcggatcttggcgagaacgtcctcgtcgacgagggaggagtcgccaaagtaccagccgccctgaacgatacggtgaccaatgccctcgatcttgacgccgttggcctcgaggtccttcagaacgacctcgatggcgaccttgtggtcggggaactcgatgttctcggtcaccttcttggaaccgttggcagcgtgggtgaaggtaccgccggtaaagcagacgcgctcgcaggagccctttgcggacaccttgtgggacttggtatcgatgacctgatacttaagggtcgaagatcctgcgttgacgaccagaacgttcatgtgtctccctactaacaggcggtgtggcgccgccaggttacatacgcttcaataataaacccaaacgccctcgcgctcgggtttattgcgttgatatataagttatcgatgtccaaatactcacggcctttgacttgtaagacaaaagagcgcggggatatacaccaaggaagaaatcccgagcgcaacaagcaatacgactcgaatgcctgcaacgctactcaacacagcgttgagcagatagaaaagaacggcacccaccgccaccatctggctttgaaccgaaatcagtgaacagcgcatcgaagaatcggcagcattttggaaaactgagtatttgattggggcaaacaacgagtacgcaaccgtctgcagcacatagaacacgggcagcaaattagccggagtaagggggatcagaaacaaagctgtcaatactaagcgaatgatgccgcaaatacgcgcaaaacggcccttgtcgacatgagcaatcacactgggcacaataagccccatggaggctgaggcaaggagctggaccgcaatgatcacacccgaagcgacggcattcattccgcgacccgcaagcaacagtgagaaaaagtcttcctgggcgacaaaagcaaatgcttgagaacagtccatgatgaacgctgaacgaagaatgccgttacacgcaatagcggcaccgatcatcttcgggctaattccacgctcaggtgtccccgcagtgccccctcttcgcatctcaggaatgcagacaacgacaaccaacgtcaacaccattgcgatgatatctgccgaaagaccaatgagatatgcaccgacagacgaaatgaaaccgcccacgcaagcggagatggcaaaagaggcatagaaaacaaatcgctcaacgacattaagtcttacgagctggtcctgagaaacgctgtcaatgtaaatcgcttctatggatccgctcacacatgcagcggcaaaacctttgagagcaaacgcgccgattaaaagcagaggagaacggacgaggagtagggcagcgtagtatccaagcatccccacgacgccaacgagaccacttgtctttcgtccaaacctatcggcaatatagccagtgggaacttcaaggatgaacttgctcacttgatatgcaatcatcatgctagaaatcgccaccatcgagaatccgacgaattcaaggtaaaccgtcagaaaatacaaaatggtgctgaagttcgacagaaaaacaaacgtcatataaagcaaaaccgtacggtttttcatgctccgccctccaagagtcaacaatctaaatcggaatcttggaaaagcatgagggcaaagccgtcagtcatgtgttacaaggcgtcaacattcacttgacgacacgaggccaaatggcctcacgaagcaagatgacgcaataggtgaagaaataccgtctggtgtcgatcggtccaggcattttgtcgatagcaaaagtagatggtcaaggctacgtcatgcgagccttcaatagagcactcgctcacttccgacccatctgatgcgagagaagagccagaaaaacccaatatcaatcccccggcttgaagaaactcagcctgcgctctgtttccgtattcgacgtcgcggaagcggaaattaaccagctgagcttcggggcattgattgatcgcattgagacagggcgacaaattaataggaacagctaacctgccgcccagtaactcacgaacggtcatagcacccacagattgatgacccgctgggcacgaaagaaccttgagctccttttcacccaagtatttcgaagagaggacactgtcccttggttcctcaaatgagatggccgcatccgaaatgccaagcacaagtgattcaaagcatgtagccgttggctgatgccaaacatcaaggtgaatctgagggtgcgagctttcaaacgagtcgtaccagttttcggaaaaaagacgcccccgcccgtgaagatgaactgcctcccatttcttggacacgagaaatgggaggctttttatgcgtgtcgcgcgattggcgaaaatgcgttggtggaaatggtgaaaattatattgacgctaacacgagggaggggtgaactcgcagctgagggccgtcctgcgcaaccaccgggggctgacgtcggtcaagcgcgtgaaggcggtgttctggtggtgccacgcgcactcgggggacgcgaggacggcgcgcgagaagctcgccgcgatgccgaccgacgcggacatcgacttcctgttcagcgtctactccgcctcgccgtcgcgcgaggacggagggccggagtggggcgacagggcagtgtgggaggacctccaccacagggacccgtacccgttctggcttgattaatggatggaaacggatgttctatcgggacacacattttgtcctataagccccgatttatcgcacaatgccaatccaagcacaacgccgccggcaactcccctactcaacaaaaagccccgccagccgcaatccccaaaggaaccgcgatcagcggggcctaagcgcgctcctccaaaggaaaacgctcacaacacgaacagctcagccgagcagcgcgttactcttcccagtaagcatctgcaagcagcttaaagcagatcttcttgaccggctgcgcgccatcgcccgggaactcgagcgtgggcatatgaggctcgccggcaacgaacagtgcaaacttatcgtcagcaagatcgccggcgatcgaggcgtcggaatcgaccagatcgtagtcgtccttctcgtcaaactcctggaccagcgtcaagctgcccgtagcgaccttaaaggcctcgcgaccctcgacatcgatctgcaggtcgtgatagcgctgatgcgtctcatagtgagcctcggcctcgggacgcgtcgtgggagccatgacgttcgcatagaccttgtcgcccagaatcggatggctgccgacctcgagctccgccgggtcgttctcctcgagccagtcgatcaacacgtcgaggcccttgagcattccgcgatactcctcgatatcgcccaatgcaccgtaaatcatctaaatcccctctcggatcgcttctttggcggctactcggcaaacgcgttaccgacgctgttgccacccacatacgcctcgaccagggtaaggtcgggattgaacacgacaaactcggcgtcgcgccccggcataatgctaccgcacttgtcgtcgacatgagctagcaagcgatgccggggccgtcacccaagctcttacagctcggtcacgacaacgccgttgtagacctcgtcccaacggtccatgaccagatggccggtcatgggatccatggcattgagcttgccgcaggtgttggcggtacgcagtaccgtctcgtcgtctgcgccagcagcgatggcatgcgcgaagcctgcgatagtggagtcgccagagcccgtagcgttaacggcggggatatcgggagtcttggcgcggaacgcacggccattgtggaagcccacggaaccggcggcacccatggacacgacgacccaggggatatcggagaagcgggcgtcagaggcaagtgcggcgcggagctcgtccacatcgtcggtggtaaagctcgtgcccagaaggccgttaatctcggtcagattaggcttgaccagctcgggcttaatttcggacttaagggcggcctcgagcgaagcacccgaggtatcgagcagcaccttggcgccggcgttctcggcaatgcccgtgatcttggcatagtagtccgcctcgacgccgcggggcagcgaacccgagatggtgacgacatcggccttgcctgcaagctcggcgaactttgcagtaaaggcatcgagctcctcgggggcaattgtcgggccactctcgagcagctcagtctggttgccggcgtggaggatgttgaggcaaatgcgagtctcgcccttgatgggcacaaagtcgtttttaataccgttggcgtccatgagctcagccatgtaggcgcccatgtggccgccgagcagacctgttgccacaacgtcgtcgcccagctgacccagcacacgggccacgttgaggcccttgccgccagcggtcttttcgggcgtcacacggttgacgtcgtcgataacgagctcatcgagctgatagcgcgtatcgacagacgggttcatcgtaacggtgaggatcatttttagctccttatctcgcaggctccttgtgcctcgcgatacgagtcgacaaaacggaattacagaatctcgattgtgaacgagcgcacgatggtttctttgggcttggcgataaggcagccgcgcttgtgctcaagcacgtcatcctcatcggaacaggtcgagaggccgccccagggttcaactgccacaaaatcaccctcgggcttgctccacacaatgaggtacgggaagccctcaaagctcaggcgaacgcccttgtcctcgccctttttggaaagcgtgacctgacggctctcgagcacgtcaaagatggtctccgcaaaatcgaagagctcatgcgacaaaggcagcgtctttcccaccatggggttcttggaacgcctgtccacatcaatcaatccggtcgagggaacggcggtgcagagctccgcagcctcgtctttctcaaaacgcaactcgtagtccgtataggactcaccctcgtcgagcggacacctaaagccggggtgtccaccgataaagaaaggcatgtcctcggtgccctcgttggtaacctcataggagacacgcacggcggcgtcctcgagcgtatagcgggcgacaagtttaaacggatacggataatcgctcagcagcgcagcgttatcctcggatgccaggcacatagccaactcgtttgtgctttggctcaacagcttccactcctgcttacgcgcaaagccgtggcgggcgagcttcacatgatgtccggcaaacgtcatggcgctgttatcgcgcaaacctccgcaaatcgggaagcaaatcggtgcctggccggaccacacggcgggatcgccctgccacaagtactcgcgacctccagcctcaatcgaggtaaacgagccgccggccgtggagaccttgatagaaatcgaatcgttggagagagcgtattccattgtccatcctttcgaacaactgctttttgctcgcaagaacccgtctcggccctgaccaaaggacaaacccgcacgttcatcgatgcgtccggtttcccaggcatgcaacggggtaccatacagacattgatgcaattacagctgaaaggccttcttatgcgaaccatcatcctttatgcctcacgccaccacggcaatacgaaaaagctcgtggacgccatcgtcgaggcgcaccccgaaatcgataccctcgacgtgaagtcactcggtaaaaacgagtaccccgacctgcacgaataccatctgatcggtgtcgccacgggcatctattactccgagatcgacaaagatatggcgcgcgtgctcacgaacgtgctgcagccgcaggacaaggtgtttggccttatgacctacggtggcaaaaacaagtggtacggcaaggatatcgatggcatctgccgcatgaggcaggccatctttatgggtgtctacggctgccccggatttgacacgtggggtccgttcaagattaccggcggcgtccagaagggacacccgaccgctgaggaaattaagggcgccgtcgacttcttcgacaagatcgaagacgagtatggcgacatcatcgtcgaagagtacgccaagcgcgagaagcgtctagcatacgaaaaggagcatcccgcggggggtcttgtggccggcgtcaagcgcacggcaaagaagatcgctaacaagctgtaactgttaaggtgcttttgagcgtttaacccatacggcgggtccgagcagattcgggcccgccgtctttttctatcgttactcggtaaaggcgttgccgacgctctggccgccaacatacgtctcgacgagggtgagctcatggtcgaacacgacaaagtcggcgtcgcgacccggcatgatgctgccgcacttatcctcgatgtgtgcagagcgagccggcacctcggttgccatgcggatggcgatatcggcgctggcgatgccccagtcgacgatgttcttgacgccctgggcaagcgtgagcaccgagccggcaatgctcttgccgtcggcgagccagcacaggttgtccttcatgatgacgtccatgccgccgctggtgtagctgccctcgggcatgccgccgcagccaaggcagtcggtgatgagcaccgtgtgctgccagccctttgcctgcagcagcgccttgatggcggcagggttcacgtgcttgccgtcacagatgatctcggcataggtctcgggcgtggacatggcggcacccacgacaccgggctcacggtgatgcagcccgcgctggccgttataggtatgcgtaaagcagctggcaccggcgttgatggcggcgatgcactcatcgtaggtggcgtcggagtgaccgatgctggtcaccacacccttggcgttcagagcagccgcataagcagcggcaccgtcgcgctcggccgccatggcgctcttaacgatgcgaccgcccgcagcctcctgccactgatcgaagacctcctcggagggatcgataagataagcggggttctgcgcgcccacgtgcttcatggtaaagaaggggccctccagatagatgccctgaatgcgagcaccgcagaagtcggggccgcggccctcgtccgcctgggcgatggcggcgcaggcatccttgatctgctcgacgccatcggtgaacgtcgtgggcagccagctggtggtaccgcgacgggcgagctcggtcgagctgatatcgataccctcggggtcgttgtcggtagtcgagtggttatagaagccatggatgtgagtatcgaccatacccggtgcgatccacgatcccgtgtagtccttgatctcgcaagagggctcgtcggcctgccaggcgccaaaaacgccatcctcgaccataagatagccgcccagttgcgggcctgccggcaagaagaacttgtcagccttaattgcgtacgtgctcatatgcactccttgcttctaaagcagttgactgtggtaatgcttatacccggtccatgtaaaaacaaaaagcgcccgcccgccgttatgagcggacgggcgcccttacagggggacgcgattaagcggtgaaggggtgaatcgtcacgcccttaaccacgcggttgaccgtgccggtggggctcggcgtatcgggcgtgttgcccacgcgcacggagttgagcaggctgatagcctgggcaaacatcacgaacggcagggcaaggtagccctcgggaagcgcctcgtagcccttaaaggtgaaggactcgccctcgtagacggtagcgccatcctgctgaacggcaacggtgtgctgagcaatcttgtcgccaccgatctcgttgaggatgtcgatgtcgtactgacgggtgtaggcgtcgttgttgacgaacacgaagacgagcgtcttatcgtcgacgaaggacttaggtccgtgacgatagcccatggaggtgtcgtaggaagtagcaaccagaccgtgagcgagctcgaggatcttgagctggctctcctgggcaaggccaccgaaggagccagaacccaagtaggtcacgcggttgaagtcgccagccaggtaatcggcgatctcaggctcacgggagatgacctcctcgcccatcttggcaatcgtctcgacccactcggccttctgctcgtcagaggcagtgtcgaaaataagggtggagagcagggtcatgcaggtgtaggaaccggtcatggcgaagcccttgtcgttggcgcgcgggatgagtagcgtcagcgcattgggatcatcggcggactcgacggcgagcttgccctcgggagcgcaggtgatgttgaggaacttgacgttgtggacgagctccttggcaacggcaacggcggcaaggctctcggggctgttgccagagcgggcaaaggaaaccacgagcgtgggatcctcggcgcgcaggaagtcgcgcggggcgctcacgatgtcggtcgtggcgatgggcttaaagtcgtagagatcagtgttgccagcgtgacgcaggtacggggcgcaggtatcgccaacgtagtcggacgtaccggcaccggtgaagacaacggacagacgaccctcgcccatagcgcgagcctcggccaggaaggcctcgatggcctccttgttctcgcgatagatgttgagcgtatcgcgccaaagctcgggctgctgagcaatctcggccgtggtgatctgggcgccgagctcggtgagctcctcgacactcttctcgaacatttctaatacctctctctagaagtaatcctctgacgtgcaattatacacttcggttggttatctggtagtaaccagttaaatgcaaagaatcaccatatggaaacgatgcgagcactagttactgcgctggtggtaaaccttgtatttaaactgatcggcacgagcaaccgagagtgtatactccacaacctcgtttgactcgttatacgtagtcctgaccaagtcgagcacaggcgagccctcgacaattcccaaaaggtgagcatcggtgggacgggctatgctcgcatagaactcctcttcggccacgcgtatcttttgctgaaagtcttgctcaatcacatcgtaaagcggcttacgctctagcagtggtcgctttagggatagaaattgacgaaccggtagatagctgcgttcgaccatcatgggcatgttgtcggcagaacgaagacgcttgagcttaaaaatgcgatcaccgatacgcaatcccatatgctcagccagattcttatcggcctccatctcgcaaaaatcgagaatcgtggtctcggggtcgcgacccatcgcgcgcatctgctcggtaaagctgtaggactgcataagattggttgcctttgccgagcggtcggtcacaaaggtaccgcgaccgtgctgccgaaccaccagtcctaaacgctccagttcctgcagagccaggcgtaccgtagtgcgcgagagaccatagcgctccgaaagttcgcgctcggaaggaatcatgtcaccggcgcgatattcatggtcaatcttttcggtcagaatatcgaccagctgatcgtacagcggttgcttatgcgctccgatcgccatcctatcctcccttttgctcgaattcggctaactacctagggtgttatgcattatctgtctgccacacccgaatcattaagaaaacaaaagccgcgcgctctttcgagcacgcggcttttaacatacacatggcttaaggggtcggggtgtgagccgcgtagggacacacccctcaagctagagccttaccagatgctcggccagagaccaagcgggccagcgcccaggatgccaaggacgaagagcaggagaatgcccttggtcggggtccagctgtgcttagcgaacatgtagtaaagcagcagcgtaagcataagcgggacgagcttcgggacgatggtgttgagggtgtcggcaacagagaagttgaccggatcctcggtaacggtgccgtaggtcacggactccatgccgttgcccagatcggtgacgccgcactcgacagcgttgccgtcggcatcggaagcggtaagggcgttgccgtccttatcggtcatggcgatggtaccggcctcagcggtctcggtatcgatgccctccataccggtgaagttctcggcctccttctcggagacgatcacggtagtagcggagagaccacgggtggtgccattggggatctggaggttgatctgggtgccacccatggtgacgaccaggcaaccgacgacgaagacgcccatgatggaagcggcacgcgtgaaggcctgcatgttggcggtcagagcgtcaatagcgctggtgccaagcttgtaggaccagttcatgagccagaagcgcagagcgaactggacagcgttgaagatcaccaggaagatgatcggcgcagcagcgttgccgttgatggccatgttggaggtgatgccggccgtgataggcacgagcgtcagccagaacagggcgtcaccgataccaccgagcgggcccattgcggcgacgcggacggcgcggatcgtggggatgtcaaccttgttctgctcgagcgaaagcacgatgcccataacaaaggtgacgaggaacgggtgggtgttgaagaactccaggttgtggctcatggaagccgcgaggtcgttcttgttggtgtggatcttctccagaccgggaatgatggagtagagccagccagcggcctgcatacgctcgtagttgaacgaggcctgcaggaagcaggagcgccaagccatcttgttgagggtcttctggtcgagctgcggagcaggagtgagatcctcgtagtgctccgggatcacatactcattagatgccatcttcgaagtcacctccgtcagaaacagctgcacccttcagctcggtctgctgctggaagtcccagaaagcgatgccgaagccgatgagagcgaggatgagcagagcaggagttgccagagaatcgttggcaacggtgatgagcgcgaggccaaagcccatgaggaagaagccccacatatcgcggttcatcataaccttgagcaggacggcgaagccgacgaagcgcatcatgccgcctgcagcggacagaccggtctgcagccaagtcgggatggcggaagcgatggtctgaccaatggtagcgccagcgatgaagaacagggtgacgacgacagcgaagatcaggccgagcagagccatggcgaagtagttcaggcgctcgatgcccttggtgtccgcgttgtgagccatgttatcggccgtggacataagcggggacataagcgtgaagaccagggtaacgccgagctggccaagcagagcgaacggaatggcgaggccgactgccgcgttgggctcgaggcccgtggcgatagcgagaatggctgccatgatgccgccgatgacggcgttaggcggctgagcgcctccgatcggcatgttgccgatcgtcatgagctgataggtaccacccacgagaagaccggtgttgaggtcgccaaggataagaccgatgacggcgccggtgacgatgggctgatagagagactcgaggaagtcaaactggtcgattgccgcgatgaacgtgacgacgaagaccagagcgatctggatgatcgagtattccatcttgctcctcctttcaaaatgaatgtacgcactttggatttcacgtacagaatgtcagggtttcattcctgacaacgtggatcatgaggattacgagaagagcttgctcgtgtcctcaacaggcgtgctcggaacgcgcctgatctccaactccacccccaattcctgcagctctttaaacgcagcgacatcctcgtcgttaactgcgacggaggtggcgacttggcgctttccttccgacatgtgcatgttgccgatgtttaccttctttataggcacaccgcccttgacgagcgtaagcacgtcttccggtgtttcggccacgatgaagatcttctggcgcgggctcgccttgccaatgacgtcgatggtcttctgcagagagaagaaacgcgtagcgacgccggcgggagcggccatcttcatgaggttctggcgcatggtgttggacgccacgtcgtcgttggcgacgaggatgaggttggagcccagggtggagttccactgggtggcaacctgaccatgaaccagtcggttatcgatgcgggtaagaagaatgttgggttctgccatgttgatcagcttcctttcgttatttgctgacgacagttacttgatctcctgaatcgcgtaacgcgaaacatctacgacggctccggatcggactttgatctggaccttctcgccttcgatgcctttgacggttccgtagataccgccggcgaaaagaacctcttgacccggcttgagctcggtgtgcagctccttgaagtacttctgcttcttcttcatgttgatttgcgaccagatggtgtaaatcaagcccatgatgacaagcaggcctaaaagagcgaccgaggagctcaggacgttggctccgaaatcggccattagatgccgtcctcgtcgccgaagatatcctcttcgtcggagccggcaacggatgcgaccgtctgggcggtgatgcccgtctggccaacggtcacggcctgctcgccaagctcggcgagcgtggcattgccgcggaggaacagaagctcaataaccatgggaaggttggtgccagtcagaacctcgacgttgtcgacatcctgggcaatcatcatcgactggttgaacggggtgccgccaagcaggtcggtaaagacgagcacgccatcgcactcctcgcgcatggcggtaatagcggcgcggagatcctcaccgtaggaagcagcctggtcgccctcaaaaggaacgacggtaaaagcaggctggtcgccggcaaccatagcgatagcgcttgcaaggccgggtgcgaactgtccatgaccggtaagaataaagccaaccattcaaatttcccttccgaaggtgcgtacgatctgtgtccgatgattttcggaagccagcgggcgctcgcccttaaagcttcttagaaagcgttctttgaagaccagtggtttctaaactggtagtaaccacgtgacgtgttgttgtcactatatcaccccagaagaggtcgctttcgttgattcatacggtaaaacgtttttgcaccgctcacggtgatatttcgaccgtttaccggtcgttaacacttctacctgcggttttgaaaccgtttcgaaatgctttggcaaaagatcggatcttttcctgtgtctaaacaacgcagggcggctaaaaatagcgtgtagaaaaattgcaggtcattgtgaagatatgtgaattggtctttttgacttaataccagttagaaccagttttgagattatcggtgaacggtagttttcgaccgttcaccggttacttgcaatcgtttgcagttgttttcccagatgaattaggggaacccgatggagcattgtgcgggctcgaggcctaccccagtggtttcggtaacaaaaagcccgctagaacgttgtccgttctagcgggcttaatcaggtagatcggttagcgcgcagtagttcaggcaaaccttacgcaaacaggccgtagatgctgatgttggccttggcgtacaggccgttagcgtactcggtccacttggagctggcgctcgaagcctgcgaagagtactgctggtaagcagtgtagtaggcggtcatagcctgcttataggtagcgctatcggccgtaaaggcatcgtcggcaaaggccttagcgtaggtgccgttctcgtccttccaggtacccttcgagctatcccactcgtcgccggcaaggttgatgatgtagtcggcgtaatccttgctcgcggtgtcctcattgccgtcagaaggctcggtcggagcggtcggcatgcttgcggagctatcgcccaccttcttcttgtagagcttctgcagcgtcgcggactggcggacgatctgcttggcctggtccttggacacgccatactgcgtggccatggtcttgtagtccgaagtgccgatggaatcctcggcgtatttcttcatctccttagaagagacggtgatgccctcgtcctcggcagcatcgagcaggatcttgttgcgcacgtaggacaggatgacgtcggcagacggagcggtatagttgccgtcgtcgtccttgacggtgtcgaggctgtactggctctcgatggcctcgcgtgcggtgatgtcactcttcttgccgttgtagctgtagcttgccacggtcgaatcgagctggtcctcggtcagggtcgacgagccgacacccttgccgccaaaaccaccattgccaataaagaagccaatcacggcagcaatcacgactgcaaccacaaaggcggcaatcatcgtcttcttgtgcttgcaagtgtggtcatccacgtcggagtcgtcgtcctcgtcctgctcctcgggcatcagatcctcgtcagcggcatccgcggcaatctgagcctccagacgggcgtcctcctcctcggccgtcgtaccggcagcaatgtgctcggcagacgtaccggtgaccaggtcgatcttctcgtcctcgtcaccgtcggggccttcgccgcgctcgatgatctggatgccgtcgatctcgtccttctcgtccttcttttgaatcagacccatatcggttactccttgttaggaaacatagtcttcaatagaatacgcccgacagagtgccgggcgtattgattcttaggttatacgcaaacacttaagtactatttaggcgtttgcagcgtgcataccttaggccaggtgcgcgataacggcatcggcaaaggcctgtgtgcccacggcgccctcgacggagccggtctgggcacgacgcacgtcaccggtaacctgctcgccctcgtcgagcgtggcagatacggcggcacggatacgattggcagcgtcgttctcgcccaggtgatcgagcatcatcgcagcagagaggatctcggccgtggggttggcgatatcctgaccggcgatatcgggcgcggagccgtgcgttgcctcgaagatggcgcagtcggcaccgatgttggagccgggggccatccctaagccgcccaccaggccggcgcacaggtcgctcacgatgtcaccgtacaggttgggcagcaccaggacatcgaagtcgttggggttttggaccaggcccatgcaggtggcgtcgacgatcttgtcgttgaactcgatatcgggatagttggcggccacctcgcgcgcaacgcgcaggaacaggccatcggtcgccttcatgatgttggccttatgcacggccgtcacctttttgcggccgcagcggcgggcgtactcaaaggcgtactccacaatgcggcggctcttggcgatggagatgggcttgatcgagatagcggaatcggcggcgaaggccttctgacccgagcgctcgacaagctgcgagagctcctcgacctcggcagccccctcatcgaactcgatgccggcatagaggtcctcggtgttctcgcgcacgatgaccaggtcgacgtcgcggaagcgcgagccgtcgcccggctgcgacaggcaggggcgcacgcaggcgtacaggtcaaagtgcttgcgcagggccacgttgacgctgcggaaacccgtgccgaccggcgtggtgatgggacccttgatggcaaccttggtctcggcgaccgcatcgagcacatgttggggcagcggcgtgccaaactcgtccatgacgccggcaccggcctcctggacgttccaattgatctggacaccggcagcctcgaccacgcggcgcatggcctgcgtaatctcgggaccgataccgtcaccgggaatcaggactacatcgtgcgccataatctgttactcctcgtcttcggcgtcgtcagattttttaacggtagcacgcttcttctttttggagagatccaggccaaaacgtttaacaagcatttcgcaaatctcgctcgaacgggccttgagatagctgcccttgccgttctcggcgtcgaacttaaggcgcagcgcgagcttctcggcgacctcggcgtcaatctcgccctggccaaactcgtacaggcaaccgagcatgtcgcgatactcaaggtcgccgtggtagcactggatagcctcgtccaggatgggccaagcctcgcgcgaacgctcgacactcgcggcgccccatacgcacagcaggcggaaggcggcatagcgcagcgtggaggagatctcgtcgaacagcgcggtctcggcgccctcaaaggcatcgcccagctgctcggggcaggtggtggcgagcgccgtcagggcatcgagggcctcccagcgggtctgcgcctcggggcggtcgagcgcctcgatcagcgcgggcacgcagggcacgacgcgctgcggatcgcgctcggcaagcaggtgcagcacgcgggcggcaaactggcggatgcggcgcgtggggcagccgagctccttgaccagacggtcgacggcgttctcgttctcctctgccagctgaagctgtgccagctcctcgtcggtgagctgttcgtctttgttttctgccatagttacctcttcttactatttcttagcgtgcttgccagcacccttgctgtcatcggtgaccgagatgagctgtcggtcggccgcgccattgcgacgcgcacggcggcgttcctcagcgtcgcccgcgtcggcggcggcgcgatgagccttgttgacgttaaagacctcgtcgtgcttgcgccacggaccgacggactcgccaaagctcatcttaagaccggcgataaagccgccgagccagccgatcggcgcaaactgcaccagcgggaacagcgagaacacccaggtcagtaggacgactgccgccgctcctgcaaaattggcaatccagtagtcgcgcttggtgatcacgcgcttttcgcacgcccactggccgcacaaaaagccaatatagatcgcaaagataaagagcaccagcgcgagcaccacgaacgtccagctcatgggcgctactccccgtgatggtggccgcagcagcactcatggccgtcgtcatggccgtggccgccgcagcactcgtggtcctcgccatggtggtggccacaaccgcactcatggtcgtcgccgtgctcgccgcaaccgcagccgtcctcgtgagcgccatgctcctcgggacgatactgcgaccagtccagaccggcggcgatggcgtcggcctcctccttatagaggaccgtgatggcctgggtgcccagcttggcgccaccgatggcgtcgagcatgtcgtagagcgtaaaggccacgtcggcgccgggcagcgcaagctcgcggtcgtcggcataggcgagtgccaagcgcaggtccttgatgaagtgctcaaccataaagccgggcttgtagtcgccgtcgagcgccttgggcgccaggctctccatggcgccggacttgccggtaccgcccaggatcatctggcgggtcttctccaggtcaaggccgctcagctcggcaaatgccatggcgtctgccatgccgaccatgcaggcgcccagcgacacctggttggcgagcttggcagcctggcccttgccggcgccgtcgaagcagcagatgttggccgcaaaggtggcaaggatgtcgcggaccggcgcgatgtcgttctcggtagcgcccacgatagccgtgagcgtgccggcgatagctcccgactcaccgccggtgacggggcagtcaaacgccatgcggccggaaacctgggcggcctcggcaatgtcgcgcgccagctcgggcgagctcgtggtgaggtcgatcaggaccgcgccgggcttagtgcacgcgagcaggctgtcgcccgccaggtagagctcctcgacctcggagggatagcccaccatggtaaagacgacatcggcgttagccacggcatcggccggcgtatcggcccaggcggcaccgcgctcgataagcgcgacagccttggacttggtgcggttgttgaccgtgacgggatagccggcatccaggatgtgaccggcgatgggggcacccatgattccggtgccgataaatgcgacggagagcttgtttgccatgaaacctttccttttgggttgggtgttgttaccaggttgaatactcgatgccagcgtttgggcagtgagttgggatcgattacggccgcgttacttgcctactggccgcgcacgcggcaggcgatgcggtcggaaagcgacgccttgtcggcgcggttcttaccccaaaacgcgcaggccaccatgccggggcccacgtgcgagccgatggtggggcccacggagctgcgaatgatcgtgacgtcggcgcaaccctcctccttgcggatggcggcttcgagccagtcgccgtccttttcggcatcggccgtcatgattgcgatgggcatggtgcggtcgggcacgtagttctcgcggaacgacttgagaatggacttgagcgccttcttgcggccgcggttgacaccgatcagcgacagcgagccggcaaggtcgtaggagagctcgggcttgacatcgagctttgccgtgagctgcgccgccgcgggcggaatgcggccgccggcagccagcgcgtcaaagctctcgagcgtaaagtagccgtggacgtaggtctttgcctcgtttgcccaatcgaccagctgcttggcggtcagtcccgccgaacgctggcgcacggcctcgagcgccaagagcgcgccggtcgcgcagggcagagcgttgtcgaccacgtagagctcaaagttgggatactcggcgcgcacggcgtccgccgcctggcacgcggagttgtagctcgacgacagcgccgaggtaaagcacaggtagaccgtgggagtaccttctttggcacactcggtaaagaactcgatatagcgaccgagcgacacggcggaggtagacacgcgagcgccggcgcgcatgcggtcgtagaactccttagggctcatgctcgaccagatatcgtccgtgcgctcctcgccatcgatgataaaggggaagcccaagatatcgacatcgaggttcgcggcgacctcggggctaaagtcgcagcaggtatcgacgacgatgcggcaacggttcgaatgaccggcggatgcggccttgtccatcaaagcgactccttacgtaaaaaaggcgaccacccgcatgggatggccgccaaccgttaactcatgcaagttaacgtattttactcgtcaagtgtttcgatacggggcttgatgatgccatatccaccattcttacggtgatataccacattgatgagaccagtcgtcgcgttctcgaacacgtagaagtcgtggcccagcagatcggtctgcaccagcgcctgctcctcagtcatcggggtgacgtcgataaccttctcgcggacgagcaggtcatcctcctcctcgggcagcagcaggtcggccagatcctcgacgcgctcgaccggtgcgacatccgctgcactggcaccgccctggcggttgtccacgaccttggtcttgaacttgcgcagctggcgggtgaccttatcggctgagaggtcgatggcggcgtacatatctgcaccgtgctcggcaacgcgaatcaccgaaccgcgggcacgaaccgtaacctcgacgattgccgggttggggttcgaggggttcttctcatagcgaagtacaacgtcgaccgtcatgggctcgatatcgaaaaccttgagcgcctcgccgatcttctcatccacatgcgcacgcagagcatcggttaccgtcgtcttgcgtccagaaaccttgatatccatacgtggctccaatctgcctcggggacttactgtactggctatgtacccattgccgtgcatttaatcacgcggattcctaaagacccgaataacgattgcttgataccgcataccgaagtctcgcacttttccatggcaaagtgcgctataggagggggccggcggctttgtatttggtcccgaaaattggctttgacctgctagttttattgggatgaaaaagccggactcccccatcggggaagcccggcagtgcgtgttgaaaccgtgaagaagtgtcctttccaacgtataggagacaccacccctagcaataactagctattgagtttgttaatgtcgtcgtcggtgatggcgccttcctggctggacgatttgtcctcggaggatgcggtctcattgttggaatcggaggactcgctgccggaggacgtggtctcactggactcagagtcgcccggctgcacgttagcgcccgaaaccgtcttagtggtgaggtcgtagggcatcgtgccataccagacagagtggaccgcctcgagcgtaccgtcgaccgtgatgtcgtcgagggcatcgctcacggcacggcacagttcgtcattggacgagaggcccgcaacaccaagcgtcgagggcgcctcgagcgcaccgacataggagacctcgctcatcagacgtgcaaggtagccgccggccgtggagtcgcagattacatagtcgacctcgccggactcgagcgcctcaaagcactcgttgatgttggagtaggtcttttggttggcggtaatgctctgcttagcaagcgcctcctgcgaggccgaggacatctgaacgcccagggtggacgtgttaagggtatcggtggaaacgcttagcgacccaccatcgctagttttaccaaacacggaagtggcatcgtacaggcaggtgccgagcgagctaatgtccccgtccgtggaattaatctcgccgataaagatatcggcctttttgtcgccgagcgcggaacctgccgaggacgcatcgacaaaggcgaccttaaggcccatgcggcttgcgagggcgcgggcggcgtcaaccgcataccccgtgagctcgccgtcggcgtcctgcatggcctgcggcgcatcggaagtatcgagggcgactgtcagggttccgggagtgaccagggcatcgtccgacaccgccggcgtgacggtctcgtactcgatctggtcgatcgtgggagtcgtgaacgtagacagcgggttgaacgcgcatccgctcaggcccaaaacggcgatgaccgctgcggtcccagcacctaaccgagccgcgtgcatcaagctgcccctcaccatgtccactaccctgccttctgtgtcgtatacgatccgtgcgttgcgcggaatatcaggttgttcccaccagctgacctggtatttgaccccacacttgcgcaccggggtgtttgctcgggaggccgcagccaccttcacgactgacccgctcgcccgcgaggcggtattgccccaaagaaagtagaacggacggtgcggcttacatctaggacgcgccatgatcgcgccgcgcgcacgcggtcgcttacgtggatccctttgaccgcgtctgtcttggactaggacgggcatttcgtccgtccgcaaccacagcctggtaggaacgaagcgcattatagctaagttcaagctaaagtttaaggttaggggcgtcattcgcatctcgagtacagattttgcgggtcggagcggaccattcgtgcccctatgaagcccggagctcccctacggggagctccggggcacccgtctcagggtgccgtgtgcaaaaaacggcaaatatgagtactgttaccaatttagtagcagcgtattaccgcctcacgagccctttttgagttccgcacagcctgcttggcgccaagatattccacattcgtttattatctcttcgctgaatccagattatcggcccaagtttctttgtttttgctgtcactaatctagtaacagtactcatatttgccgttttttgcacagagcatataaacagaccccctataaagccatagttttacgctggtttgagcccaaagcacgctcggagcgtattcagcagagcatcttgcctctttcgacgagcctctacgcgattctgatatcgcttacccatacgctggtggatgcgccatgcgagtgcttccatcgcttccatgtcacagagcatttcgttgttgaccgtcgcgacctcgattcccatagtaatcaagcccgtgttgcgcttttcatcatggatacgtcccctccgagaagaatggcccagctcaccgttgtattccaagtcaaaccgggctgcttcctgaaaggcatcgcaaaccgcatgcggcatccccgagatcgcctgtgcacggtcgttgaactcgatcttgtagtcggtcttaaagggaccacaggcaaatccgccataggaaaacggaagcgaaaacatggcaagcatgatgcactccatgggtgaacgcaggttttccgacagatagggacacagccgccgcagctgcttggccgcgctccccttgcatgccgcgaggtaatctaccaggcaatcgggtgtcagcacggactcgacctcaaagtaaccgacatctggcggctggtctttgtcctttgccaatttgttcacgacaggcgaggtgtagggaggcagatacttcccgcggtcactcagtgaaatcttagagcacagctcctgggccagggcaaacgcctggatacagccgacctcgcgggcgacgacaacacaaagggcctcgggagatagactgtacacccccggttccacctctagaatcgagccggcgggcaacccggagcatacggaccagctcacgccaagaatgcggcggcgctgcgctgcagaccctaccagcaagcacagatcctcttgtacctcgctgcttgcggccccaatccgcaccaagtcgggaagatagatgtcctcggtcgagggcgacgacgtgcgcagcacacggcgctcttcatcgggactgaggtccctccagccgatatagcccatctgccggcgctcggcgcgcatcatgcgcagcgccgaggcgccggtcaggattatggaagccgctagctgttcgcctgtcggctcgttgcgccgctcaatctttactgacacaaaaccacccctaccaaacgcgtgcgatagcgaggccaccgaccgctgcggcgccggcgcgcttgagttccgccgaagccgcggccatcgtcgcgcccgtggtgataacgtcatcgataagcagcaggcggcggccatgcacatcctcaaccgtctcgtacatgcctcgggcacgctcgcggcgctcctcacgaccgagttcgcgctggtcgccatgcccgtacttgacgagagcatcgagcaggggaacacccgacagctcgcaaaatgggcgcgcaatggcctccatatgatcaaaaccacgccgccgaaacgctgccgccgtcgcaggcacaaacaccaccgcatccgcaccggacagcacacctccgtagcgatcgggcgctacgacctgggcatgcagggcggtgtcgtagagcagctctgccagatacggagccagacgtcgctcgcccgcatccttgtacgctttaatgatgcgcggcagcggatgcgcatagacggcgcacgccaggcagcggtcgagcgcctccgccattgccgaggacgtgccctcgaccgaacactcagtgcacagcaaatccccaaacggggcgccgcatcgggtgcagctatgacgtgggtcgatgagcgtgagcgcagccaggcagtcttggcaaataagcgtaccggcgcgctcgcagccggcacatcgtgttggcgacaatgcctcgagcgtctcgcgtgccacccgctcggcaaacggtagcaattcgtccgcaaacggtagggcaccggcaccctgcagacggctcaatatgttcagatggctcttcaagacacaaccctccctacgctcggtcgcagggagggttgttgattcggcgctatgataccccgatgcgctcggggcaaggcgggctaaatccgctcgcgggcgttattcgccggcgggcggttgcggtgcgggcgaagacggggtcgagccctcgccaccatcctggcgaggcttgcgggaacggcgacggcgacggcgcttttgaccctggtcggccgagccctcgccaccgcgatcctcgcgcggctcgcgctcgtcgcgagcggcgccacgcgaagccttggcagccgctcccccgccatctccgggacgacggcgcgtgaccttgacctcgccatccgagacctgatcggccacggagggcactgagggcttctgctgcgcgcccgaggaatggcgacggcgcggacgcggcgcgcgctcctcctcgccacgtgacttgccgctcttgtcgacaggcgcatcggaggccgaggcgcccttggaagcggcaccagcctcgcgagcagctgcggcgcggaaggcgtcctcgcgctcctcgctcgacagatgacggcggcggcgacgtgtggggttcatgccaccgccgcgattctgctgctggggctgctgaacctcgcgctcgcgagaggcgttcttgcccgcggctgcagcctcggtagcatcgcccgagcccgcacgcttgcggcggcgacggccaccggcggcctcctcggcctcgggcgcctcggccttgccgcggccctttccgcggccacggccctcgccctgaccctgaccggcgcgagcatcggattcagcatcgcgacgacggcgcttaggcatcgacgtgccggccaggcggtcggcactcgacaggccatcgcccacgtcgacgccattctcgcgatcgagttccatgagcgccaggcgcatctcgggcgactcgatgcgctcgagcacgtcgcgcgtcacgcagtcggggcggcagctgcagccctgctcggcggccttctttttgcagccctccgagcacgtcatatcggccaggttgaccttaaagactttaccgttctccaagcgcagcaccagctgctcacgcggcgtgtcatactcctgaatacgcgccttgccaagcggcgtatcgatgagcgtcttctttttgggcgcacggctcttaaagtccttgtacgcctcgaactcataacgcaggcagcacatcagacgaccgcacacgccgctgatcttggaggaattgagcggcaggtcttgctcttttgccatgcgaatcgagacgggttcaaactgtccgccaaagcgcgtgcagcagagctcctgtccgcactgggcatagccgcccaccaggcgggtctcgtcgcgcacgccgatctggcgcatatcgacgcgaatgtgcagcgtcgaggacagatccttgacgagctggcgaaaatcgacgcgctcctcggccgcaaagtagaacacggccttctcgccgccaaacaggtactcgacgcccaccggcttcatctcgaggtcgagctccttgaccaggcggcggaagtcgaccatggcctcgtcgccctggatggccaggtcgtcggcaagctggaggtcgatgtcgctcgccacgcgcagcacgggcttgagcggctgaccgatctcgtcttgcggcacctcaaagggatcggccgtgaccaggccaatctcggttccgcgctcggtggagcaaatggcataatcggcctcgaggatatccagatcctgcggatcgaaccacaggtcgcgcgaggcgtaggtaaacttaacgggtacgactaacggcatttcagtgccttcctgatatcgagcagcatgacctcgatggccagctgaggagtaacgtttctggcgatgttgcgctcggcggttgcgaccgcctcgagcgcccgcgtggcacccgcaacattcgtcgcggcggcaagccgcccgatcgtgtcgcgcacgtcctcgttcacaacgtctgccgcctcgtcctgaagcgtcagcagcacgtcgcgcatgagcgtccgcgcgctcgccagcgcttccataatacccgaacgctcgcgcgcgttgagttcgcgcttgttgcggtcctcaagctgcttcaatgctccacgcgacaggtagtcggcgttttgctcgagcaccttttcctgcgtggacttgacctcggcgagcggcgccttaacggcgacgatgagcgacttggcgcggctgagcacgtcggcctcgtcggcggcaatgagtgagtcgatggcacggaccatctgacggcgggcgtcctggcgctcggcactcttaaggaactcgatgccgcgcgtggggctgcccgccacggcgacggccatgcgacaacgcgcgatatcctgaccagtggcacggctcacggcgtgcgcggcgacggcgggcgacaccagccgaaacggcacgcactggcagcggctcacgatggtgggcaacatcacgtctgccgaggtgcccagcaagataaacataacgccctcgggcggctcctcgagtgttttgagcagtgcgttggcggtgttggcgcgcagctgctcggcacggtcaatgatgtagaccttggccttggcgcggatgggcgccaggggtacgtcgtcgagtagctcgcgcgtctgggcgatgaggtagcccgtggcgctctcgggcgtgtaatagtgcacgtcggggtgcgtatgacgggcgacgcgcacgcagctatcgcatgagccgcagccatcctgctcgcacaggaatgcctgggcaagcgcccatgcggcgtcgagcttaccggcaccgggcgcgcccaaaaacaggtaggcgtgcgatgcgcggccgtttgcgatggcgttggtcaaaaagtcgcgcacgcgctgttgggtgtcgagcttggcgagcaggcttgcctgagcgggggccatgttactcggcctccttggcaagcgcggaggcgacggcgtcttggggaatgtcgagaccgtacgcgcgaacctgttcggccgtcttctcgaagacttcctcgacggtcgcagtggcgtcgatgagctttacgcggtttggctcctcggcagcaattgcgcaaaaaccctggtagacacgatcttggaaggccatgcccttagcctccatgcgatctgccgcgccacgggctgccatgcgcagcgccgcctgctcgggcgtgatgtgatagacgagtgtgagcgccgggtgcgtccccgcgacggccaggttgttggcatcgcgcactatctggcgatcgaggccatcggcaaacgcctggtagcaggtcgtggaatcgtagaagcggtcgcacaggaccaccttgccggcagcgagggcgggcgcgatggcctcgtgcaccagctgggcacgggcggcctcatacagcagcagctcgcaagtgtcgcccatcgccgtattggcggggtcgagcagcagagcacggatcttttcgctgatggcggtaccgcccggctcgcgcaggctcacaacctggtagccggcaaggtcgagcgcgcgggcaagcaagcgcgcctgcgtggacttgccggcgccatcgacgccctcgagcgtaatgaagctatgttgagcgggctcaaaagccatgggcgcagccccttcctacaaggcgcgtaaatgcagatatatcaaccaaaccatgataccccagtgctcggcgcgtcccaaatccaacctagccatcgaggcatccccgaagttgcggtgaaatagggactgattaaagctctgagaccgccaaacagtccctatttcaccgcaacttatgaaggggaattttggacgctgggtataatcgtcgtattgcattgaaatgtggcgaaaggagtggcaatgtctcggtattgcgcctcgtgcggcaagcttcttgcagataatgccaagttctgcacctcgtgcggtgcacccgttgagcaaacaaccgcgagcgatagccagcccgcttttgagcagaccggctcccttgatacgccgcaagccaaggcggacgaccccctcgtctatcgccacgaccccgccgcaagccctgcggccgtcgagaccacgcagcgcatacccgtcgcgagcggctcgccccaacaggagccggctcccgcatacacgcccgcttcgccacagacccccgctcccaaaaagagcggcaccgggccgcttatcgccgttattgttgtgctggtggcgatcatcatcgccctggtcgttttctttgtgatcaagcctttcgacaacgccgccacgcagacgactgccgaggtagctaagctgcaccatgacgtcgacgacgatgacctaaagcctctcggcgatcccaacagcctgtacgacgatgacgacgatgacgacgaggatggcagcgaagcaacgctctccgagcagaacctctaccgccgactgagcgaatactacgacttgctcgaagacctcgacaactacgtccgtggctgcgcgcagaacttcaacggcagctatctggaagaggatcgaaccacccgccaaaatctcgccgacgtcgccgagcgcacagaggacaccatcgagcagtattacgacatcgtcgaggacctggacgtcccgacgagctccaagaactacagctcctggaaggacatcatcgccctgtacgacgacctggatcaccgcattgacgcaatctgtgatgcctgggagatcagcctgaaatacgccaagcctgcggaccacaagaatgagatcgtggcgccgctgtcgcgcgacaacgtggcgggcaccaatgacaataagtaccgcctagactttgaggaacgctatcccggcgccaagcctgtcgaggtgaagtaatcccaacaactgatcaaatcttgcggtgaaatagggattaattaggccttttgccagcaaaaacagtccctatttcaccgcaacttagaagtggggccgggcgcgcatttgcatttgcgcgcccggccccgccgcgtctatatgtgctcggttacttgtcggcggccttcttggtggtcgtcttttttgcggtcgtcttcttggcggcagttgctttcttagccgtggtcttctttgccgccgtcgtcttctttgccgcgctcgccttggtcgtggtcttgcggccgcgggccggctttttctccttggtcgggcagtccatgttcacgcagatgcgccacggaccgcgcgccgtgttgaccaccacgatgggggcgccgcactcggggcatgtctcacccgtcgcctcgagcttaccgcgcgccggcagaggatagctcacgccgcagtcatcgtagttggtgcagcggataaagcgcttgccgctcttctcgctcttgtgcgcgatcaggtcgccatggcgtccggcctcggcgcacaccttgcactcgcccaccttaaggtcaggctcgtagttggtggggcacgtggggttcacgcaaatctcgaaggccttctggcggaacggctggcacttaatgcgcggcgcgccgcactcggggcacacggctgcctcgccctcgagcgggcttaccttgacgccgctcggcaccggataggtcacatcgcagtcgggccagcccatgcagccaatgaagctgccacgggtcttggcgctcgtcttcataaccaggtccttgccgcacttggggcaagcgcccacgcgcgcatcggccgtgacggcgtcgctgatggcgtcgcccaactcctgcgtgtgcttgagcagctcgtcgagcacaccagccagcagcgcgcgcgagtgcgtcactacatgctcttcggtatcctcgccgcgctccacacgggtcatgtcgccatcgagctcgctggtcatatcggggctcgtgatgcgcggggcaaactgcgtcagtgcatcgatgatggcgatgcccagctgactcggctccacgggatcgtttttgaggtagcgcacggcgtacaggcgctcaatgatgctcgcgcgcgtggacttggtgcccaggccgcgcttttccatctcctgcacgagcttgccctggctgtagcgcgcgggcggctcggtctgcttggcctcgagtttaatgtcgaacacgtcgaccgtatcgccctgctccagcggcggcatctgctcgtcgcgcttgagtccgtacgggtacgcctcgcggaaacccggggtcacgagcacatcgcccgaagccacgaacggctcaccgttcacgtcgagctcgagcttagtgttttcgatggtcgcgggacccataagcgtcgctaggaagcggcgggcgatgaggtcgtagagcttgcgttggccgccgtcgagcgtggacggatcgccctcgcccgtgggatagataggcgggtggtcggtggtctcgactttgccgcgcgtgggcttcatagggccggcgagcacctttttgcacacgggcgccagcgccgggttgatctttgccaggtcgctcaccacggcgcccagatcgagcgtcgcggggtacacggtgttgtcgacacgcgggtagctgatgaggcccgccatgtagagggactcggcgatgcgcatggtacgcgcaggcgagatgccctcggctgcggcggcagcctgcagcgaggtggtcgcaaacggcgtgggcggctgctgcttgcgcgagcgcttggtcaccgcggcgacggttgccgtcttggcaccgtcaacgtgaccgtacgccgtctcagcagcatccttgtcggtaaagcgcgccgtcttgtgcgcgatcttaaagcgatcgtcctcggcagcgccttgcgcggcgcccatgccgcgaatctgccaatagtcctcgggcacaaacgccatgcgctcgcgttcgcgctcgaccaccagggcaagcgtcggcgtctgcacgcggccggcggaacgcacgttgccaaagccgccaaacttggcgagcgtcaggtagcgcgtgagcaccgcaccccaaatgaggtcgatgtgctgacggctctcgccggcgtcggccaggttctggtcgagcgagacgaggttatcgaaggcctgcgtgatctcggccttggtaaacgaagaatactgggcgcgggcgaccggcaagtcgggcgccacctcgcgcaccttgttgagggcgtccgaaccgatcagctcgccctcgcgatcgaagtccgtggcaatgatgacgctgtcggactttttggcgaggttcttaagcgagcgaatgagctctttctcagccggcaacttaatgacgggcgcccaggtgaggtaaggcagactctcgagcttccagcccttaatggagatgccatcggcaaggaacggcttacgcttggtgtcgtaaggcggacgcgccaggccatcgggcatgtcggccggcagtatctcgccgtcctcggtgaccgaataccagcccagctttttatcgaacagcacgctgtcgcaaaaatcaggcgcaaggatgtgaccggcaaggccgatcgtcacgcactcctcgcccttccactcaaagcggtagatggcggtgttgtacaccttgtcctttttgggtttgcccgtggacagacgctcggcgatctgacgcgcggcgtcatttttctcggcgatgatgagcttcaaaagaggctcctatctcgtgtctctgcggctacgcccgcccgtatggcggccgatttacgcccttgcttgctcgatctgcccgatgagccaatcgcaccaggcatccatgccctcgcccttgcgcgcgctcacggcaaaccgcggcgcctgcggattgaggtcatcgagtgtcttagtatacctatccatgtcaaaatcgaaagccggagccacgtcaaccttgttgagcagctgtgcgccggcgtgctggaagatgcccgggtacttgataggcttgtcgtcgccctcgggcaccgagagaatcatgatggacaggttctcgcccaggtcaaagtcgaccgggcagaccaggttgcccacgttttcgataaagatgacgtcgatgttctccagaccgacggcctggtcgaacgcgtcaacggcctccatgatcatgttgccctcgaggtggcacaggccacccgtgttgatctggatggcgggcatgccggcttccttcatggtgatggcgtcgacatccgaggcaatatcgccctcgatgacggcacagcgcaggccagccttgtcgcgcaggcgctcgttggtgcccaggatcgtggtggtcttgcccgaaccggggctcgacagcacattgatcacataggtgtttgtctctttaaatcgctgtcgcagctgatctgccaggcgctcgttgcgcgacaggatcggcgacgcgatatcaatcgttttctcagccatactcagcgctccttacttttgcccctttataccccgtccccaggtggctgatgggctaatcgtcgggggtttcgatttcgatacttgcgatgtcgagttcgcggccgtgcagcaggcgcacgttggcgccgccacattggggacagcggcaatggaagcgatcgtgctcaaagacctccccgcagtccagacactcgctttgtggatggacttcctccacggcaagctcgcagcctcgcgtgagcgagtcctcatcgcgaaatgtctcccacgcaaagtcgagcgcctcgcgcacaacttcggtcatatccccgatacgcagcgttaccaaaacggcgcgcgaggcccccgccccacgcgccgcgcgaatcactgtatcgagtatgccgttgacaatgccaacctcgtgcataccgatttactcctcgtcgtcctcatcgtccgagaacaggtccagacggctcacaaacaagccctccttgccctcgcgcgcggtaatgaccacgcgggcaatggcgagcgaaatctcgtagagcgagagcagggcaccatacatgaggcccagcgtaacgggcgagccgtcgggcgtaatcacagccgagcccacaagcaggcccacgtacacgtagcgccaggcgccgcggaaggccgcgtaggacacgatgtggaagacggacaggtagaagatgataagcggcagctcaaacgccacgccaaagccgatcataaagagcagctccatgttgacgtagttctccaggtcgggcagcgccgtggcgacggccgaggtctcgccgataagccactcaaagcccgccgggatgatgatgaaatagcagaagatggcgcccaggaagaacagcaccgtcgaggcgagcaccgtgggcacgacccatttgcgctcgttgggacgcagtgccggcaggaaaaatgccagaatctgccagatgatcatgggcgtgcacatgaccacggccatcttgatggccagcgagaagcgcaggccaaagccgccgagcgtggtggtgatgtagaacttaccgtccggcacaaaggagcggatggggtcttccaggatgtcgagcaccacgggcgtggcgaaatacagcacgatggcggcggcaaacaccgacacgaccacgatagtcaggcggcgacggagctctcccaggtgatcgaagagcggcatgcgcgcaggtccgataggcattactcatcgcctcccttcgaggcgtcggcggcagcggcgtcgtcctcggcctcgagctcgcgggcgagctggtcgacgacggccttgcgcttgcggggacgacgggcgtagaggtcggccgtcgtgggctctaccggctcgggctcgggctccggttctgcagcaggctcgggctcgacgacaggctcggcggcagcggcaggctcggcctcggcgggctcggcgccctcgccctcagcagcagcctcgctcgcggccttctcggcagcaaggcgggcacggcgctcggcaaaggtctccttcttggcgggcgctgccgcctcggcggcatcctcgtccgcatcggaatcgtcatcgacggcagccttcttgggcttgaccggagccgaagcggcctcactcaccggatcgataatctcggactgaacaacggccgtcatcttttcctgcgtctcgcggaactgacggatggcacggccgatcgtgcggcccatctgcgggagcttatccgggccaaacagcaaaaagccgaagaccacgatgatcgcgagctcaccctctccaataccaaacacacatacctccaaggctcgatgtgagtcgagcccgcaccgcgccattcggccggaactcgtctattcattcggtcaagtatagcgcccggacgccaaaacgtccgagcgcatcacaaacatatgccaaacggcacgcccttttgggggcaaagattatgcagcggtgatcgaaatctcctggtcgacacccaacagctgaaccacgcgcattaccgggggctgcacattggtgcagctaaaacgcttgccgtggtcgaccgcgtggtgcgcggcgcccacgagcacgccaatgcccgttgaatcgatgtagctcacctgggcaaaatcgagctcaacggcctcagtgggctgctcgagcgccaggtcgatggcattgcgcaggctatcggcgttagagatgtcgatctcgccggttaccttaatggtgtagagctctggcgtggggttggtggaaatacccaaatccatgtatatgctcctttacgtatcgaaggtgcggatagtacgggaagccgcgcgttaggcgcgctcggcacgcgcgagctcggcagcgacaagcttaacggccagcaccagcacatcgagcgcggcctccaggtcctcgaccgtgggatagctcggcgcgatgcggatgttggtatcgcgcgggtccttgccatagggccaggtagcaccggccggcgtgagcttgacgcccaggtcagcacaaagcgcagcgaccttttgggccgagccctcgggaccatcaaagctcacaaagtagccgccgcggggatgcgtccaagtggcgcaacccgtatcgcccaggacctcggtgagcttgcgctcaacggcctcaaagcgcgggcgcaagaactcggcgtgctttttcatgtgctccctgaccgcctcgatggtgggaaggaaacgcacgtggcgcagctggttgagcttgtcggcgctgataaggcctgccttcaggcgcttggagaactcggcgatgaccgcggggctcgcaccgataaagccgataccggcgcccgggaaggtgatcttggacgtcgaggcgaaggccaccacgcgatcctcggtgcccgccgcgcgagcgaggtcgaagatattggcgagctcgtcggtctcgtcgtacaggtcgtgcacgcagtaggcgttgtcccagaagatgcggaaatcgggcgcggccgtgggcatctcgaccaggcgacgcacggtgtcctcgctaaaggtaatgcccgtggggttggaatacttgggcacgcaccagatacccttgatggagtcgtcggcggcaaccaggcgctcgacctcgtccatgtcggggccgttgtcggtcatcgcgacggggacgttctcgatacccagatcggcggtgatgccaaagtggcggtcgtagccgggaacggggcacaggaacttgaccttcttgccgtcgtgcgcggcctcataagcctcccagggctcgctgccgcacgagccgcaacgccagaacataccggcaatatcgtgctcgatcagcaagctcgacgaacccagcacgagcgtctgctcggcggggcaacccaggaactcccccgccagcttgcgtgccgagggaatgccctcaaagcagccgtagttggagcagtcgacattgccgtcgtgcagatcggcatcggcattgaggatatcgagcatgggtcgagagatgtccacctgggagggcgacggcttgccgcgggccatgtcgagcgccaggcccttggccttgacctcggcgacctcggctttgagcgcctcgatggcggcatcgagttcggtggtttccatcttctggtagatcgtctgcatgggtgcgacctttcacgaagcggtacgttgcaattcttctaagtatagaccgccaccgtcgcaacgttatgaagccgtgatagattaagtccatcgcaatgaattacgaatcgccgcgcatgccggcatgaagcgcccaaggaggcactatggagtacggatcgttccaggccgaggaattcggcgacctgcagcgcctggtcgacggactgttttatgaccgccgcgccatcgaccgcctggatctcatcgtgcaggccgagatcttggacctcgcgcccgacctcatggaaatcgtcaaccttttgccgcccggctactacgaccgccaatcgctttgcgaccagctcaactccgccttggccgcccacggctggggcgccgtctacggcaccgtggaataaacctagtcatttaagaacgtccccaatgactaaaacgccgcttgtgacggtgttcacgggcggcgttttcaaacttgtttgtgcttttactcgttcttgggcgcggggtgtttgcagaccacactcatgtagatcatgccgagcacggccgcggtgaccgaaccggcaagaatggcagccttggcggcaagaacctcaaactcggccgtcgggaaagcgaggccgctgatgaggatcgacatcgtaaagccgatgccgcccagaatgcccacaccggcgatcatgtgccagttgacgttgtgcggcagctcgcaggccttgagcttaaccagggcgaacgtcatgccaaagatgccgatcggcttgcccagcagcatgccaaagtacacgccgagcgtcaccgggtcggtgagcaacgtgctcatatccacgcccaccaggcgaacctgtgcgttgacgaacgcgaagatcggcaggatcacaaagttgaccggcgtggaaatcagacgctccatgcggatgagcggcggggtcacgcggtgcatgacgcgctcgaccttagtggtcgagacggtaaagtcatgctggcccaggatgtgcgcctcgtcatcgtagcggtcgtcgagcaacggcaggcattcgcccagccaatcggtaaggctatcgagcttaacaccgcacttggccggaatggtgaaggccaggatgacgccggcgagcgtggcatgcacgccgctcttgaacatgcagaaccacagcagcaagcccagcaccgagtacggggcgaggcggtagtgctgcgtcttgttgagccacacgagtgcgcaggtcacaaccgcggcggcacccagccaaaacggattggggctctgaccgtagaagatggcgatggcggcgatagagatcaggtcgtcggcgatggcgagcgtcgagaagaacacgcgcacgccgttgggcacgcgattgcccaaaagcgacagcacgcccagcgcaaaggcaatatcggttgccatggggatagcccaaccgttgtgcgcgccggcatggttaaagatgaggtagatgcacgcaggaacgacgacgccgcccacggccgccagcatgggaagcatggcctgacgcgggttcttgagctcgccgaccgtcatctcatacttaagctcaatgcccacgagcaaaaagaaaatcgccatgaggaagtcgttgacgaaaagctcaacggtgagaccggccgtaaggttgcccaggcccacatacagcggggtctccaaaaagtgatggatggcctcgtaggcatcggtgttggcacagataacggcggcgatggcagcgatcaccatgacggcggcggaaatcgtgccattctcggcaatgcgcccccaaatgtcgtgacgctcaaaacgcttgcgttcacgaacgttaaacagctgctcgggtgctgccatgggcggctcctttcacgggaaggttcccgtcttaaaaaagcacggcccgcccagatggcggcgccgcgctccgacgtattacgcttgcatctagcctaccctgcgcgacaagcgcgcgagcgcggccgaaaagcggaaccacaggttgaacattatttgctcaacggcacaggagcccctgtccaagaaaagacgcggctccatgcacaaaaaacgaccggaccgcggggcttccgcgatccggtcgtggcgtttggtcaactaaacctagcaggcggccatgatgggggcagcgacctgcttcttacgggagaggacgcccggcatccagacgccgtcgtgctcgtcggcgatgcccaggcccttctgagcggcctcggtctcgccctcgagcaggacctgcgagccctcctccatgatgtcggtaatgcacaggacaatgccgtcggcacccttctcggcggcgtaggcgcgcatggcctcgcggatctcgtcgatcatgccgagcgcacggctcttgtcgacggtctcgtactggccgatgagcagcttcttgccggcgggctcgaacatcttgatgtcgttgccgaccatctcggctgcggtgaaggagccggacggacgggtaaggaagacctccatgccaaacttgaccggatcgacgcccacctgctcgccgagcttagcagcgacggcgcggtcgacatcggtggtggtggggctcttgagcatgagcgtgtcggtcatcatggccgagagcagcagcttggcctggacgtcggaaagctcaacgccgagcacgtcggcgagcttagtgacgatggtgcagctggagccccagggcaggcagatgtagtgcagcgggccggcggtctcgaagtcgccgatgcgatgatggtcgacgacgccaaagaccgtggcgtccttaaggccggcgacggactgggcggactcgttgtggtcggtgagaacgacgagctggccggcctcgacggactcgatcacgcggggctcggcgatgccggcgtcggcgagcagcttggcggactcagccggaagctgaccaagggcgcaggcctcgtaggtgttgccagcatactcaacctgattgagcagctgggacaggacgacggcgctcatgatggcgtcgttatcggggttctggtgaccaaagacaagaacgtttgccatggatatcctccacttgatatgtgtacttggacgtagctatggtagcacgctggcgccgagccttctgagacggaagggccgcggcacaatttggggcaagtgccggggcgaagtctgcccccttgcactatgttggcgcaaactaacctgtcccccttgcaccagctatttgccggcggcgcgcagggctacgtaggcggcaccgatgatgcctgcgtcattgccgagcgaagcgaccttaatgggcgtctcgcgcgaggcagaaagcgcgtagcgctggaagtactcgcgagccttgtcgaggtagacatcggccgaggcggaggcgccgccgccgatcaggaacatctcgggatcgaccacgttggcaataagcgccagggcgcggccgagatagtcggccatggtatcggccgcggccagcgcgagcttgtcgccctcgcggcaggcctggaacacgtccttggaatcggaggggccggtgagctcgatgggctcgacgcccgctttctcgcactcggcaaggtagttgctcaccacgccggtggcgctggaatactgctccaggtggccatggccgccgcagccgcaggtgcgctcctcagccgggttcaggcacatgtggccaatctcgccgccagcacccacaacgcccgataccacgtcgccgttgacgataacgccgccgcccacgccggtaccgatggtgaccatcaccacgttttgcacgcccttggcagaaccgagccaggcctcgcccatggcggcggcgttggcgtcgttctcgtactttacgaccgcgtcggggcagtgctcctgaatggcaatcttaagctcgggcaggttgatggagatgttcgccttgaccttggcatcgcccgcagccggaatggggcacggaacggccaggccgatgcccgccacaaaggcgcgcggaatctgagccttggcgaccacctggtcgatagcctcggttaccgcggcaaagcccgcagcgtcgacgatgggaggcgtgggcacgctggccttggcaagcaggttgccgtcctcgtcgaacaggccctccttaaccgaagtgccgccgacgtcaatgccgatgtagtactgcttaggttccatgagagcccacctttctcgtttaaacattgcctgtatggtaccgctctcaagacaaaaacccgccaaaaagggacaggtttgttttggcaggttttatctggggaaacgtccgcccgctcaacgagcaatgacgctcagcaactcgccaaacaaaaagcgccgggagagggagactcccggcgcctgcaaaagggactggattgtatgcgaaccgcacgatccgtcgcggcgaaaacgccagctaggccttgagtgcctgtagctgtttgtggacctcaatgagctccgtggccatgacgcgcatggtctcggtgccggccatctggtcctcggcgtgcagcagaatcagcggggcctcgccgttgcgctcgccattggcctccttcttaagaagtcccatgtgaacatcgtggccgccgttataggcctcgtcgccctgcttaatgagctcctcggcggcgtcgaaatcgccctccttggccttctgcacggcgttgatgtacatgctcttggcggtaccgacgtagctgatgatctcgaagcaggtcatctgcagttcgttcatatcctccatgcgctgcacctagcccatcacgctgacgcagtggtcgatgatgccggcggcgttcatgcggccatagtcgaccatgttgatgacctcgaccgggaaacggccggcggcctccttctcaaagtcgcccttggtgtagccgatctgcgggccgagcagcaggatgtcgcactcgtccaggtgatcgtgggcctcattcataggacgggcttcgacctcgatgtccagaccacggctcgcgacctcggactgcatcttctggaccagcagactcgtggacatgccggcattgcagcaaagcatgatcttcttcatggtttcctccttataactgcgcggcgcgcagacgacaaactggataaatccttgtggttatctttcccctgttttgcacgtttaggcaaaaaaggagatacgggtaccggtaccaagcatcggtacccgcaagggtggaatggacaaacgctaggcgttctgctcggcgagggcctcctgcttagcaatggccttctcggagatcctcataaagggcaggtagacagccatgccgatgaccagctccagagcctgccacacgccggcgcgccagtcaaagcccgtagcaagcagggcgttgatgacgggcggcatggtccaaggcacctgagcgatgcaggggctgatgatgccagcgcaggtcaggccataggtgacaccgatgaacaggtcgggaagaagcacgaacggaatcatgagcggcaggttgtacacgatggggtaaccgtagatgaccggctcgttgatgttgaacaggccaggcagaatggccatcttggcaacggtcttggaggccttgttcttggagaacaggaaggtgtcgagcagcagcatgagggtgcagcccgagccgccgatgagggcgaagctgttgacgatctgcatgttcatgtagtgatcgggctggatggtaccgccggcggcaaaggtagccatgttgtcgacgatgagcatggtcaggatcggctcgacggtagcgcccgagatggtggactggtgaataccaacgcagaacagcaggttggcgagggtgtagatgaggatgacagcccacggaccggcgttcatgatgctcttgagcgggttggagatgcaggtggagatgatggtgcacaggtcggtgccggcgcagacggcgagcagggccgaggcgatagcgaagatcgagaggttgagcagcattgggatcatgacgttgaaggagttggagaccgcaggaggtacgccctcgcccagcttgaccttgagcttctcgacgcccgagatcttgatgaagagcgtcgtggagagcagggcgatgatgatggccgagaacaggccgttggtaccggtgttggcggtcgaaagggcaccggtgacctcggcggaggtgatcttgtcggtgagaagcgggctcgtggcggcaagggtggcggtgatctgctgcggcatcatgatgacgaaggcagagatagcgacaaccacgcaggcaagcgggttatcgaaacgctcgttcttggcgaggctgtagccaatcagaccggccaggataatggcggacacgttaagggtgcccagggtgattgccgagccccaggtctggaggttggcgaggcccgccgcatcgagcgggaacagagggaacacgacgttgttgataagaaccgcgatacccgcaaggatatagagcggcgtgatggtcgcgaaggcatcgcgcagggaacgcagatgaacctggtttcccaccttcgcagagacctcggcaaatttgtcgaggaagctctttccgttgtcactggccatgattgctcctaactttcaaatccggccttttcctatgcgcacggtggtctgtcgccctctgccaccagatgtgccaatgttattgcgcgtttgcgcaggggctgagcgcccgttttggggctgagcgcccgatcgctaatccaccacgtgggtcgtggcgacctgcttgagccaagctgccgatttcttaagacggcgctgatagccgtccatgaggtcgacctcgacaaagccataacggttcttgaaggcatttgcccaggaccagttgtcaatgacggcccagtagtggtagccgcggcacttggccccttcgtcaatggccttggcgacccactcaaggtgctggcgcacaaagtcgacgcgatagtcgtcctgaatggttccctcggcgtcacgattcttgtactcgtccatgatgccgatgccgttctcggagacgaaccactcaagatcgggatagttcttggcgcagtccatgccaaagtcgtagaggcccttcgggtaaatctcccagccgcggctcttgttcatgacggcatcgggccacacgtactcgtcggcaaagtgcggcagaccgtactggtcgatcttgctcgccggcgcctggacgcgcgtgggatggtagtagttgcagccaagccagtcaacgacgccctgcttgaggatctcctggtcaccggcgcggaacggaagcttgacgccgccctcggccaggctgtcgagcacgtcggcgggaagctcgcccttggtgataaggtcgagccaccagcgattgttgatgccgctggtcatacgcacggcctcgaggtctgcctcgctggggttctccttggtgtagaccggggtgaagcagttgatcatgccgatcttggcatcggcgcgaacggcgcccttgtcataggccttgcgatagttggcaacagccagcgcgtgcgccagcgaaatgtggtactgcacggtgcgagcacggttgaagtcgtggagctgcgggaaccacacgccctcctggtagcgctgctcgggctcgacgatgggctcgttaaaggtaaaccagtacttgatctcttgaccgaactcgcggaaggcgacgtcggcgtaatgcgcgtaggcctcgacgacctcgcggctctcccaaccgccacggtcaaagagataggtgggcatatcgaagtggtaaaggttgacgaacggctccaggcctgcctcgcgggaagcgcggaacagctcgtggtaccacgcagcaccctcctcgttgaggttgccgtcggcatcgagcaggcggctccactggatggaggtgcgataggtatccaggcccaggtccttcatgatgcgaaggtcgtccttgtacttggccataaagtcgttaccggcataggaacccacgcggttatagaacgagcccagatcctgcatggaccaggtgtcccacaggttctcgagcttgccgccctggttccactggccctcggtctgcggaccggacatggccgcgccaaagaaaaagtcgctgggcagctgatactgtgccatcgaagtcctcgctttcgtgtctttgagcctccgattggaggcgggtttgctttggcgggtaatccggcgcgggcgcgcaccggttatccggatatccgacccaccaaaacaaatccgtctccaagcggtacaggcgatgctcatgcatctcgcttgttatctataactatagcgctctaattttttatgtaaagcgtcttttttgtttttctttctcgaacttctttgattaaagccatatagatgcttttatagtaggtatactttcttttacaggcattcatgttagaaagggggttccatgattcccaaatatgagtcaatagctgcggatattcgtcgcagtatcgaggatggcgcccttaagcccggcgacaagctacccactgtcgttgagttctgcgagctgtatggcgtttccaagatcaccgtcaaacgagcaattgagcaaattaccgaggaaggcttggtcacgagccgtcgcggatcgggcacctacgtcaaggacaccgcggggcttcccggcaaagcgtttttccaaggcagaaacgaccgcgcgcagggctttacctacgagcatcgcggtgagaaggttgcctcggtggtctacgatttctcgatcgtcaatccgccggcagaggttgcctcccagctgggaatggccgaagacgactttgcctatcacatcgtgcgcgtacgcgaggtcgatggcctgcccatcgttatcgagtacacctatatgccgctcgagctgatcccgggcctgaagaaaaaggacctgtacgcgtcggtctacagctatatccgcgagcaatgcgggcttaagatctcgagcttccaccgcaccattcgtgccgtggcggcaaccgaggaagaggccaagcgcctgaacaccaagcccggctctcccctgctcgagctcaaccagattggctttttggacagcggcgccgcgtttgagtactcgatttcgcgcaacgtgggcgaccgctttgagctgcacaacgtaacgttggcttaagtttgtaatccggcaggcgctcgctttgagccgtttttcgcgaggtgcctgcacaacctgatgggggtatgcacatgtccgatttgattaaactcacgccgatcttccacgagaagatttggggcggccgccagctggagaccgtctttggctatgacattcccgagggtcccatcggtgagtgctgggccatctcggcgcaccccaacggcgattgccagattgccgagggtccgtacgccggccacacgctgtcgtggctgtgggccgagcatcgcgagctctttggcaactgcgagggcaaggagttcccgctgctcattaagattctggacgccaaggacgacctgtcgatccagatccaccccaacgacgagtacgccgccgagcatgagaacggtagcctgggcaagaccgagtgctggtacgtgctggattgcgagcccggcgccacgatcatcgtcggccagcgcgcacatgaccgtgccgaggccgcgcagatgatcgaagagggtcgctgggacgacatgctcaacgtgctgccgatccacaagggcgactttttccaaatcgactccggcaccgttcacgccatcaagaccggcacgctgattctggagacgcagcagtcgagcgacgtgacgtatcgcctgtacgactacgaccgtcccggcaccgacggcaaactgcgcccgctgcacattgagcagagcctggactgtatcaactttaacgcgcaggccccgaccgacggcaccgtgaccgcacccgaagtcaatggcgtgaccgagctcgagtccaacccctgctacaccgtcgaccgcgttcgcgtggacggcagcaagaccctcgaccagcgctggcctttcatgtgcctgtcagtcatcgacggcgaaggcaccatctgcggcgaccccgtccacaagggaagccacctgctggccccgagcaccgtcagctccatcgacctcgaaggcaagatggaactgatcatcagccacctctagttcgcaccaacaacccaaacgcaacaaggggctcccccgttcaccaacgggggagccccttgtccatatatatcagcccacccggctctccagaccaaaaagcgaacgagcaaagcaacgctcgtctagcaacgttacccaaggacctgggcgggcgtatagggcaacatcgatcgcgagttccgcacgcaaaggaggccacttaatgtggcctccgtcttgcgcaggactgcccgagcaggcgatgttgccctatacgcccgcccaggtccgccgggatcactgcagcttgacgattggcgcaaaacctttcatcagctttttggtctggccggtcttttcgaattgaacctcgatcatgtctccggcgaccgagatcacggtacccgtaccaaaggtcttgtggctcacggtatcgcccgcggcaaagtcctgcgatgcgctggcgcgatcgaccttgcgctccaccgtcggcgacaccttggacgacggctttttggctcgcggcgcgcccgaaccaaaggtcgaggcaacacggccggcatcgggcgagaccccacgatggcgttcggccccgtagctgctgccgccaaagaaatcgtcaaagctcgatccgccgcgcgaaccggaaccgccggtcgagcgcgtatgcgagccgaacaccttgccgccatacatatccgagcccatgcccgagccaaaggtgccgtgacggtcgccgcgcttctcccagcccgtgccttcaaagccggcagaaccgataccgctaaactcgatatcctcaaacggaatctcgttgaggaagcgcgaacgcgggttggcagaggtcgagccgtaggtgcgacgcgtggccgcataggtcaagaacaggcgcttacgggcgcgcgtgatggcgacgtaggccaggcgacgctcctcctcgagcttacccgggtcatcgctgccgccaaagtcgtgcacgtgcgggaagataccctcctccatgccggccacgaacaccgccgggaactccaggcccttggcggagtggatggtcatcatggtaatggcatgcgtctcgccggctagggaatccaagtcggagcgcagggccagccactccatgagcgccggcagcgccttacaggtgagcggaccgtaggtgcgctcgatctcgtcggcatgcacggcacccgccggcatctccgtcgacgcggcatatgcgttgcccgcgatggcggcggccagagcatcctgcggcgagagcgccggggcggctaggctatcgagcggattggaacctgcggcatcgcgcgcgccgaccagcgcctcaaacgaggacgcgggcgcggacggtcccggctcgggcgcaggcgcgctcaccacaacgggctcgggctcagcgtcggcaggcacatcggcaacgccagccgcgcgcagctcttccaagctctcaagcgtaccctcgatatcctcgtgtgtctcttcaaattcggccgcaacgcccaggaattcctggatgttctcggcgcggctctcggactccatggtgccctcggcgcggaatgcctgcagcaggcccgtcttgtcgacaatcatctcgacgacgtccttgagctcgccatccatgcgacggccctcgcgcaccagcgacacaaagctcgacaggccattgcgcaccttggcgctaaacatgccggtttcggcgcacgcgatctcacaagcctggaagaacgagcaacggttgtcgcgcgccagctgttcgatcttttggatcgaggtggaaccgatgccgcggcgcggtgtgttgatgacgcgcttgacgctcatctcgtcggccgggttcacgatcatcttgaggtaagccatgacgtcgcggatctcggcgcggtcgaagaatcgcgtgccacccacgatcttgtagggcacgcccgcacgcaggaacatatcttcgagaatacgcgactgggcgttggtacgatagaacacggcgatatcgtcgtagctcgtgcccttggagtgcagcttctcgatctcgccggcaatccagcggccctcgtcgcgctcgtcgctcgcctggaaggcctggatcttctcgccatcgccctcggccgtaaacaggcgcttgtccttgcgctgcgagttatggcgcaccacggcgttggcggcactcaggatatgaccagtagagcggtagttctgctccagcttaacggtcttgcagtctttaaagtccttctcaaagtccaggatattggtgatgtcggcaccacgccagctataaatggactggtcgtcgtcgcccacgaccatgaggttttggtacttggcggccagcaggttggcgatctcgtactggacgtggttggtgtcctgatactcgtcgacgctaatgtagcggaagcgctcttggtacttatcgagcacctcggggcgggtgcgcagcagctcgagcgtgcgcacgagcaggtcatcaaagtccatcgcattggcagcgcgtaggcggcgctccagctccaagtagacctgcgcggcctttttgtcgttggggctatcggcactcttgagcatgtcctcggggccgatcatggcgtttttggccgagctgatcttgctgcggatcatgttgatggggaactgcttttgctcaatgccgagcgcctgcataatgtcacgcaccatgcgctttgagtcatcgtcgtcgtagatggtgaactgaccggtgtagcccagcaggtcggcgtcctcgcgcagcatgcgcacacacatggcatggaaggtgcacacccacatgccgcgggtaccgctgggaatgagcgccgccaaacgctcgcgcatctcggccgcggccttgttggtaaacgtaatggcaagaacctgccaaggcttaacgcccaggtcgccgagcatatgtgcgatgcggaaggtcaggacgcgggtcttgcccgagccggcgccggcgagcaccagcaacgggccctcggtggtcagaaccgcctcgcgctgggcgggattcaggctgtcgatgtcgacgagcggcttggcgggtttgggtgccagcgcaggagcgtcgtagatgtcgagcgggacgagctcgggctccggcgctgcaggggcggtgtatgcatcgagcggcacgggttccggcgcgggcggcacggataccgtggcgttcttttcccagggcaagggctgggtcatgggcgactcctcatctgacggacggcgcgcctgcgggcggcgccatagtttgagccgtaccagtataccgagccgcgcggacaccgacgcaaatcacaccacgactccgtgcgccaccgtcaggcccaccccagcggattaggcgcaatggggtcagatttgtctgcaccaagctggtgcaaagtaacctgaccccattgcgccaatcacagagccaccgatgtcacggtagcagcagcgagcggcggccagagcgaacaaattggcatgaaaagagggcggcatagaccttttggtcatgccgccctctttgaatgacaagttgtcgctctggccgccgcgcagcgtcaaccaagttacaggccgagcataggctccagaacgaagaagtatgcgagcactacgacgcccaggatgatgcggtaaacaccgaagcacttgaagtcgtgacggcggacgaagcccatgagccacttgatggcgatgagcgaaaccacaaaggccacaacgcagcccacgcccaagatagcgacctcgttggcgccgaacgtgccgcccttgatgaagtatttgaccagcttgagtgcactcgcgccaaacatgacagggatggccaggaagaacgtaaacttggacgccaccgaacgcgtacagcccaaaagcaggccgccgatgatggtagaaccggagcgagacgtaccaggcaccagcgaaagcacctggaagcagccgatacccagcgcagtcttccagctcaggtcctcgagcgtggcgatggagccaaagtccagattctcgtcatcgtcctcatcctcagcggtagccgcggcgggcgccgcaaagtgcgcaccggcgggacgtccacccgacaccacagcacgcgagccaaacgaaccggcaacggccatttcctcgcgcttgctcgcgcgccagttctcgatcacgataaacagcacgccgtacacaatgagcgccagcgccacgacgggagcattgtagaaatgctcctccatccagtcgttaagcggcagaccgatcgccgcggcgggaatgcagccgagcacaatcttgccccacagcacccaggtgtcgcgacggccctccttgcccttgctgggcgagaacggattgagctcatggaagaacagcacacagacggccagaatggcgccgagctgaatcacgaccaggaacatattccagaacgtctcgctcacgttcatcttgacgaactcgtccaccaagatcatgtgaccggtcgacgaaacaggcagccattcggtgatgccctcgaccaggcccatgaaggcagattttagaagctcgataatatccaaagggaccccctcgttagacacccgccgatattgttctgcggacggtgcgggcgatgtcccattatcaaccgttcgggcgcgtctacgcctacccttaccaaaaaactcgcccgttcacagaattgcgagcggtcaaacccaaatccttgggtataactgcaacaagataaagtgtccggcggccaacgcgcccgcgcccgcccgatgcacgagccccgcgcccgtgcgatagaccaaggaggaaaccatgaacgagggctacaccaaggtatttgtttcactcgacggtactgagcagcaggattttgtgctcgcacgcgccatcaaggtcgccgcgaacaacggcgccaagctaatcatcggccacgttatcgattccacggcgctcgagagcgccggttcctatccggtcgatctggtcaacggcctagaggaggcatttaagaactccatcgccaagcagctcgaagaggccaaggccaatcccgatattcccgaggtcgaggtcatgattcgcgccggccgtattcgcgagacgctcaaggacgagatgctcgacgtggttaagcccgacctggtgctctgcggcgcccgcggcctgtcctcgatcaagtatgcgctgctgggttcgatttcgacgttcctgctgcgcaatacggactgcgacatcttggtcgtgaagtagcaaacgtacgcctaacgcatcgcggagcgcaagcccacgtgcccaagtcttccaagagcgggaccaccattacggtggccccgctttgctttaggctgagaattgctccagaaccctcattctctcaacggaatccgtctgaattttcagagcgacccgacccaaatctccggttgcagaggcaagttctgcaagctgggcagacacctcttcagccacttccgccgcgatgttcttgatcatcttgagtggcagatgcaaatcttgagacatgaattcgaaatcttcaggagtcaccccatcgatcacccggtgatccccaatatcaatcccaagattatggtcgtatcccattatcgtcgtgcaaacaatatcgtatgcaggggccaacctcttttcccgccaactcggactataaagaaacgaatggttcttgagatgcgagtcgcaattccccaacgcataatcgaccattacctgacgagcgaacatttgagtatcagcaattacgttagacgattgctctcttatcaatcggccgcaaagagccatatagcagctatcgggacgtgtctcgtatttcatatacgaaggccagccaaccgcttggcaaaaatcctcctgatgcagcctcagaggcacatcgaatccgctcatcgacggcggctcattgctccagattctgtcataacgctcggaaaagaacgcaccaggaatcgtatccgaagcttctgaacgggcaatttcaagcccagcagcagacgctgccgtcatgcaaattaattcgttgaacggcaaatccggatgtttagttgaagcaatcttgactatgtgagtcgagggggcagagccgagcggcagcatccaatcccccgacccggccttttttgcatctttaccgcgcggtaaaaaccaaccggttttagactgagcgcccgccaacgacagcctcgaatcctgcatatcatttgcaatctcaaacacttccgccttagaaagtgcctcaaaatcctcgtcttgcagaggacgatagcccggatcgtagctcgatttctcatcgccgagaaacctcaaggcaccaacgcactcatcgcccaaacgctcgagcatcgataaatagtctgactgggggatttgaaaacgcatcgacagctcatgccgaaccgggccctcgggaagcatgcccgaaaaaaaggccgaaaactcattgctggcatatggctcatgtcgcaagggaagagaagctgagagtgcggcagcatcgtcgcgttcaagatatccctcatcatatgcaaacgtctcgtttacggggtcggccctctcaaattctccgaccagctcaaacgttccccgatactcacgataaacctttaatgccatgagccgtcgcccctctccctcaggatcaaatcgacccccaagctgttagcgatttgaagggtttggcgaagattggcacccgcctttccacgctcaagctcgctcacaaagcgcaaactgcactggttgaaatcagccacatcgcgttgggtataaccgagcttcttccggcgctcacgcaaatatgcaccgagttcagctgggtcaaaaatcgttcgctcattccagtcttgcatgctaatcccctatgattatcccaaacgggataatcatagcacatcatgatggaattatcccgtttgggataattgtcttaacgtgaatgacgctccgggacgttacaccgcgacgactactcaaagtattggaatttgttggtcgagaaggcaaacgtgacgacgaagccttcgccgggctcggatgccgcggtgacatcgatacccatcttggagcacagacgcgccaccaggtagaggccaatgcccgttgcgcgcttggtggtgcggccgttatcgccggtaaagcccttctcgaacacgcgcggcaggtcggccgcgctcacgccgcagccgttgtccgcgacggtgagctcgatgcgttcgctcgccaggccctcgtccagcaacgcgcccgaaaacacgatctttgcgccgtcctcgcgcgcatatttaatgctgttctgaatgagctggcccagaataaactcgagccacttctcgtcggtaaagacctcaaagtcgaggttctcgcacaccggggccacgtgcgccgcgatgagctcgcgcgcgttggccttaatcgcgcccgtcaccaaggtcttgagatcccagcggcgaatcaggtagtcgcgctccacgacttccgaacgcgcgtagtacagcgcctggtcgatatagcgctccacgcgagccaactcacggcccaggtcatccacacgagacaggtcgtcttcgctgccatccaggttttccaaaattagatgagccgccgccaggggcagtttggcctcgtggacccagctctcgatatagtcgcgatagtcatcggtctgacgccggccttcggcaacctcgtcgcaagcggctttgcccacccggcgcaagacctcgtactcgagctcgccctcggcataggtcgggcattgcaccatctcctgcacccatgcggggctctcgagctcctcggccgcgcgctccagctgacgcagaaaacggcggcgacgcgcgtactcgaccacgatgccgagcataccaaagataaaggacacgccgaccgccacgaccacgatagagacgggtgcaccggcaaccgtcagcacaaagcagctcagcagcacaccgcacgtccacacggcgacgggaagcagcgcatctttaaagaacttgccaaacgacatagccggcccctagaccgaatagccttggccgcgatgcgtggtcaaataccccttgatgccgattttttcgagcgtggtgcgcaggcggttgatgttgacggtgagcgtattgtcgtccacgaaggcgtcggagtcccacaggtcctgcatgatggccgagcgcgaaacgatcttgcccgcgcggctcagaagcagcgagaggatacgcagctcgtttttggtgagctcggtgctggtgcccgtttgcgtgttggtgaccattgagcgggcgaggtcgagctccagccccttgtggacaagtgtgctgcgctcgcctgacgccgcggtgcgacgcagcagtgcgttgatgcgcgccacaagcacacgggcgctgtaaggcttgggaacaaagtcgtccgcgccgagcgtcatggccataacctcgtcgatctcggtcgtgcgcgacgtgagaacgatgatgggaacctcggattcgcggcgaacctcgtggcagatatgctggccgtccttgacgggaagcgtgaggtcgagcagcaccaggtcgggcacggcggcgagaatatcgcgcgagacatgctcaaacgattcgcaggcctcgacttcaaacccggcgcgggcaaggatgtcgacaagctcacgacgaatgggctcgtcgtcctcaacgatatagatcagcgccattgattccgctcccctcttggttgtcttgtcccattatgaccgcaaagctgcaggtacacgcctcgcgcggtgccaggtgacagaactgttcgcgagcgggggcgttttgtccgcctcgcactcgcagcggtggcggggaccaaaatgattctttaatccccgtcccagaaaaatcatttagcggcgggcgcggagcttttcgtagccttcggcgaagaaggcgaccgtggcggcgtcggcctcggcggcgtccgtctcggttgcggggaccacgccgtgctcgtcactcaccaggaacagcgcgcccttgagctgcgcgggaatgtccacgcgcgtgaccgggatgcccttggtctgggccagctgctcaatgagcgtcgccgtgccgcacagacactcgtccgctggcgccacaaaggccagctcgccgttatcgacggcggcgagcagctcgggcgccacgccggtttcgtcggcctcggagcgggcctcggcggagcgggcacgtagcgccttggccgacgtatcggccagcggctcgtactcgcccaccgtcatggcggcgttgccgttgatgtcgatcaccagcatgagcacgccgtcgtgtgcggtgtaatcaccctcggcaagcgaccactcaacgtgttgtttggcccagctgagcatgttgtgggtaagcggctcgccctgcaccaggcgctcggacagcgcgcgaatgtggcggttgagcatgggcacctttttgttggacatgcgccaacggcagacaagcgcgggcttgtcgagcgtaaacttctcgaccgcctcctgattggcgcaaaagtcctcgtacgcacgctgatcctcggcattgccaaacagctcggcatcatcaatctggggcatggtcatacctttcgtgttagtcattccgtcctcttataccaaaaagacggccctccaaacggagcagccgtcttttgcagagattattttgacgatacggtcaggcgaccgatcggcttaatgggatagaacaacatcccattaagggttttccaagtgcccgagattgccccgaaagaggagcgccgcgtactaaatgtacgcaagcgacggtttgaggggcaaggtcgggtgcttgggaaagcctctagtgcctaaaatgcctggcccctgtgaagaccatcgcaataccatgctcgttgcaggcctggacgctctcgtcgtcgcgcttggagccgccgggctggatgatgcaggtcacgccgtgcgcggcgagcacgtcgacgttgtcgcggaacgggaagaacgcgtcgcttgcacaggcaaagccgcccttctccacgccctcgcgctcgcagaagtcctcggcgcgctcgcaggcaagcagcgcagagtcaacgcggttgggctgacccgggcccatgccaatgccggccttacccttggaaaccaggatggcgttggacttgacgcccttgcagaccttccaggcaaactcgagctcggccatctcggcgtcggtgggcttgcggtcggtggggaacgtaaaggtcgcaggatcctcggtcacgtggtcgacctcctgcaccagcatgccgccgtcgacggagcgcagctccacctgggcgccgtggtccacgccgccggtggccagcacgcgcaggttggggcgcttggccatgcgctcgagcgcctcggcagtgtagctcggagcgatgataacctcgacgaactgcttgttctgatcggcaaagtgctcaaccagctcatagggaacctcgcggttgcaggcgatgatgccgccgaaggcgctcttgggatcgcaggcgaaggcgcggtcgtaggcggccgtgatgtcctcggccacggcggagccgcaggggttctgatgcttgaggatcacgcaggccggctcgtcgaactcgcggactaggttccaagcggcgtcggcatccagatagttgttgtagctgagcggcttgccctggatctgctcggagcccacgagcgggaactgcgagctcgcggtattctcgcagccctcggcaaagcgatagaccgtggccttctgctgaggattctcgccatagcgcaggtcgtcgaccttctccagcgagatctcgagcttggcagaggtgtccgccacgtcgcttgcgtgggcggcgagccaacgggagatagccgtgtcgtaggcggcggtggtctggtagaccttcacctgcaggcgacgacgggtggaaagcgtggtgcagccaccggtctcgcgcatctcggccaggacggcatcatagtcggccgggtcggagatgacggtaacgctcgcggcgttcttggcggcagagcgcagcatggaaggaccgccgatgtcgatgtgctcgatggcatccgcgaaggtgacctcggggttggcgacggtcttctcgaactcgtacaggttgacgacgaccaggtcgatcagcttaatgccgtgctgtgccgcctcctgcatgtgctgctcggaatcgcggcgggccagcagcgcgccgtgaaccttggggtgcagggtcttaacgcggccgtccatcatctcgggatagcccgtgaactcctcgatgggggttacggggacgcccgcgtcctcgatggcacgagccgtgccgcccgtagagatgatctcgacgccaaagtcatcgaccagcgtccgtgcgaaatcgacgacgcccgtcttatcggtaaccgaaatcaacgcgcgtgcgatcttcacatcagatcccatgcagtcctcctgtctggtacgccgccgtgctctgtgagtcggtgatacgtcgatctgcagcgctcgcgcagcggcattgaaaatactgattcaatgtagcgcatcgagcgcatcgatgcaccccgcaacgggcgcatatgcagaaaaagtttgcgagcggaggggatgggcacggcaccgggcacggtgagttcatggaacacaggggcaccataattagatgccaatagcgtggtagaactgtgctcgatatgcatccgcaaaagaaagaggcaccatggtctcgcgggttctctaccgaccgtttgataccgaagacttcgacgccatcgcgttgattctgcagcagctttggcataacaattcggataacgatgagtacaaccgcctcgaggccgcatgcgacctcgcctattgcctttcgtcttcgacgttttcgcaggttgccgtaatcgacggccatgcacgcggcattgcgcttgcacgcgcaggacagagctccggcgccaccgttaaggaacattggatggataccgaacgcgcgctgctatcgcagatgcgtgagctggagcccgatgcctgcgccgagtatctctcgtttgtgcgcgcaaccatccggaccaacaaccgcctgctcgagagcagcccgttgccgcacgacaacgaggtcacgctgcttgccgtggatcgcgatgtccatggcctgggcgttggcacggttctgctcgatgccgcggtctcacacctatcctcgcttggagcgacgagggcgcacctgtacaccgactccaactgctcgtggaagttctacgagctgcacggctttaagcgcacggccacgcaccgcgccaaccgcgaagagcgtcgccacgacatgccgcgcgaaagcttcctctacgaactcgatctaacagcctaaacccagcagccatacctagtcatttagggatgttcccagtgattagtcgttggggacagccttcgtaggtagcgcatgaaaatgggatggatccgtcggcagtcgccggagaagatccatcccaaaaatcagagcgcgctagaacgttccgccgccgcctccgccgacgccgccaccaccgccgccagagaagccgccgccgctgccgccgctcgagctatcggagctcgaagccagctcgcggatggtctcgtgatacacatcgttgaacgaatcgagcggagactcgttgccgtagtgatggtaataccaccagtagcaggggtagttgtcgtagaaatcgtcgctgttgcgcaggtccgcaggcacggcctcggccagctgtcgcagcacttctttcgaaacgcccagggcaacgcccatcaccagcagcttgttccacagcaccaaatcgcccgggacggcttcctttaggcgtgtgaaatcctcgagccaatgcttgagtgccttgcagcgagccgccacctcggcgccctccggcgtaaagcggcggaacgtaaggcccacgccgatacccaccagcacaatcggcaccgagataaccgcggcggtaatgttcgcctgtgcgccatcggtaaagaagatggatcccacgggaacaaaggcaatcaggataccaagaaccaggcaaaacaccattgcaacaatgccgtctgaggcaacgtactcgctatcggccagcttgcccttaacggtgttctgatagtcctcgagcttgtcgcccacgggtgtagcgtgctgcttgacgtagtgctgcagctcgtcgaacgtgcgcgagcgatcgccgttctcgtcaggcttagtaccggcaaagaagaccttgagcaccatgtggtcaatgcccttggccgacttccagcccgcatcactcaccgtcacgcgatacgtctgctcttctttttcacgccccaacagacccttcttggccttggtcacggtcgcctgctccagcttgatcacacggtcgtcagtgagcttcatgagcgtggcgatatatgcctgatcgggcacctcgttccagctcatgagggccgaaagcacggcgggatggtcggccgaaggcacatcgcggaaatattcgtcctggaaaagcggcttgggcttgcgcttgcgcagcttgagcataacgattgtgccggtaaaggccaccgccgcaacaacacttagcacggcaagtgcattggcaatcatgcgagcgtgagcgcggcgggcgttagcttcgtcggcccattccttctcttcgctcaggatcgttgacatgcgctcttcgcccgaagcggcaagctgcggcacccagtcgctagggaaggcgatgcgtgcctcggcgaattcgccctggtgcacgcagggaatggtataggtgaccatgggctcgtcctcatcgagcgacacgtcgcccgtcagcggaccatggccccatgcgcggaagttatcgcccttgacggccgccgtcccggcagcggcattcgcgaagcacacttccatctcgacgtcatcggaatccgcagaccagccgtcacctacgaacttccagtagagctcggcggtatcggcccagttcataaccgcaccggtcatggtgtagctcacgtagtagattgcgctgtcgccgctctcgtgagggctgaacaccttaatccttacgccgtcaccggtctgctcgaccgtgtagacgccagagtcgcccttgttcgcgctatcgactttgttaaacgcggtgtcctcttcctcgacactcagcacgtcgacgcccgccgtgccgccctgctggttggagcccgtattgatctcccaaaacacgccgttgatgtcgtcgtcgaaatcaaactggcgtccctcgacaacggtcagcgatccatcggcctcgaccgtggcactgatataggtctgggtcatggagtagccgtcggcgtgcgcggcgacaggcagcagcaacaacgcaagcgcgacgagcacgcagacggaagcgaatcgcgcaaacaggtggcgctgccggctgactttggcggcgagggtgttcataggcacatcctttgtctgtaaaaccaacagcgccattgtcccacgtttgcgggtacgcatgacgaacatctaggcgaccggagcgccaaacgggatgaaagtcacacccgcaccccaacagccagtcattggggacgttcttaaatgaccagtcattagggacacccttggcatggcctgcgccagcaatagataccacttcacagctccgtcacaggtgtagcggctttgtgtgggcgcggcatgcgctgactgagccgccagccgaggggcataaagtagttgagcgaaaacggtttgcccctttgccgttcgctcgaggaccatgtcccccttttccgcggaaaccccggcagttgcgaagagctgccggggtttctgtcgtttgtgaggctaagtcggtacgcagcgatcgagaccttgagccgcaaacccaccgtgcgcaatgcgcaccgccgccaacttgtgagcgcggcaacgccttccctgccaagccccgcgctatactcatccgcatggatatcaaaacacgcaacatagcaacgcccgccgcggacgcaccagcaacggcagtgcccacccccgtcgtgggccgctttgccccgtcgccctcgggccgcatgcacttgggcaacgtgttcagctgcctgtgcgcatggctttcggcccgcagccagggcggcagcatcgtgttgcgtatcgaggacctggacgatcgctgcaagcgcccggaacttgccgctcaactgattgacgatctgacctggctggggctcgagtgggacgaaggcccctactaccagcacgatcgcctggatctgtacgaggacgccctgcgccagctgcaagacgccggcctcacctatccctgtttttgcacgcgtgccgaactccacgccgcgagcgcgccgcacgccagcgacggcacgcccatctaccgcggcgcctgcagaggtctttctgctgatgaaatcacccgccgcagtgccctgcgtgctccggccacgcgcctgcgcgtgcccaccgtcgacgacctcgccagcgacgtgatcgaattcgtggaccgcacgtacggagcccaatgcgaagcactcgccaccgagtgcggtgactttttggtgcgccgcagcgacggcgtgtttgcctatcagctggccgtggtggtcgacgacgctgccatgggcgtcaccgagatcgtacgcggatgcgacctgcttggttccacgccgcgccagatctatctgcaacatctgctgggactgcccacgccgcactacgcgcacattccgctgctcatgtcaccggacggccgccgcctttccaagcgcgatcgcgatctggacctgggcgagctccgcacccgctttggcacacccgaggcactgttgggatggctcgccgggcaaacaggcatcgcgccggacaccacgccgcgtaccgccgagcagctggtcgagcactttagctgggacgtcatccgcgcgcatcgggagaacatcactgtaacggtcgagtagccagccaccccgcctctacgcaacatcccagggctggagttcgtcgcccaagcgaacgatgcagtcgtagagcacggtgtgacgctcggccgggttggtatcccgatgaaaatgcccgtagtaccagcgcttgtagtccaagcggtcttccagctcatcgaaaaatgccgtaagccgatcaacggaggggcaattccagccggacgctggataaagcgtggacgaaagcatgcgcgtagagcaggtgtgagtgatcacgtagtcgaccgtccagcccacgctgtcgagctttgcccgcgcctcctcaaagttgcgctcgtccggcagctcctgcggccaccagctggaatacggaatgcggtattccttgtccacgctcgtggcgccgcccatggtaaagaccgttgagccgtcgagctcaaaaacctcgccgcgcgtcaggcgccgtatgggcgaggtatccgacaggcgctgcgtcagcccaccgtgccacaactccatggggcgttccgcccagtgatcgaaacgctcgtggttgccgtcgacaaacagcacggtgtaggggcgcgactccagccaagcaatatcggcacattcctcggtagaaaagtcccagggaaagccaaagtcgcccgcgatgatgagatagtcgtcgctcgccaggctatccccaagctcccaatcgcggagcttttgcatgtcagcgccgccatgaatatcgcctgttacatagaccgtcatcggattaccacttccctgtaagtcgctagcccacattctgcacgatcactaagtcaaccgttccagcccttccatcctttgggacctacccctcgctcttccatccaaacgggtcaaacacccaaaagatcagatcgagcacgccgccggtcatcgtggcgccggcaagagccatgcaaacatgcagaaagctggcacttcggagcacgtcgaacggccccagaacagccaacagcgcgaccgctgcgccggctacgcacagcgcgaggcacggccccgcgtccttaacgcacttctttgcgagatgctttgcgttgtcactcatcggtatcgaactccttagagggtcgttgttcagacgcatgccgccgcggcagagcggggcggcagggtaagtgtcacatgctgtgcggacatcaatggagaaaccgcctgctcgaccaacctttgacgccgttttgcaccggcaccacatcccccgctatcgaggtctaatacttttcccaccgccacccaaaaactcatccaacgttaatcttggctcaagaatcgcttaatctataacctgcactatagagttcgaccaagggcggggcggcgccgcgcaacgcagaccgccgaacgcaacgctcgcgcccgggcaaatcgtccggcgtcgcgcccatcgaacgaaaggacaggtcatggacgacctcgaaaaagttgaaaccatccgcaccaagtgcaacgtgagctacaccgatgccaaggccgcgctcgacgccgccgacggcaacgttttggacgccatcatttggctcgagtcgcagggcaagacgcagaccacgtcggcgcacgccgccaccgagtccgcgccagtcgatgagccctcagccgagatggtcgccgcgcaggccgcctacgagaagtcgagcgaaaagaccgacttctccaagaagatggacagcgtatgggagtacctcaaaaagctcttccgcctgagcctggacaccaagtttatcgccacgcgccgcgatgcgatcatcctcaacatccccatcctgatccccatcatcgccctgtttgcctggggcgctacgatttggctgatgctgattggcctgttctttggcatgcgctaccgcatcgacagcgacggcgacgtgcccggcagcatcaacaaccttatgaatcacgccgctgatgccgcggacgacatcaagcaaaatctgaacgacgacaagtaatcgcagacgggggcacgcatggcacggatcctgatcgtagaggacgaggagaaaatcgcccgctttgtgacgctcgagctggagcacgagggctaccaggtggagcacgccgccgacggccgcaccgccgtggacctggcgctggagcgcgactacgatctgattctgctcgacgtgttgttgccgcagctcaacggcatggaggtcctgcggcgcgtacgcaagcacaaggatgtgccggtgattatggtcaccgcgcgagatgccgtgatggacaaggtggccgggctcgatgccggcgccgacgattacctgaccaagccgtttgcgattgaggagttgttcgcacggatccgcgttgcgctgaagcgctcggaggccgtgcgggcggcttcgggcgttggcggcgttggggccggggagggcgctacgggtgccgctgcgatacccccggctggagactcggccaagacctcagccgcgccctcccccgccacactcaccgtgggctcggttgcgctcgaccctgaccgccgcgaagtcacggtcgatggctcgcccatcgcactcacggctcgcgagttcgacgtcctcgccctgcttatggcgcatgccgagaccgtgctcacgcgcgagcgcatcgcgcacgaagcgctgggctacgaatacgtgggcgacaccaacaacgtcgacgtgcacattgcgcacctgcgcgccaagatcgaggacgccggcagcgcccgcatcatccagaccgtgcgcggggtgggctatgtctgccgcgcgtaacgccgaagccaagcgcgtcacctccatcgcccgcgccatcaactggagctacatgtggcgccgcctgatgagctacgtctggctcgatctgttgctgctggtgattgcggcggcgatcctcgtctatggatacaaccagacgctgcccgacggcgcgtttaccgcaggatggatccccaacgccaccgttcgcggcatgtcgctgacgcccgcacgcggctgggacctgacaacgctcacctataccgttgagcttgcgcgtaccagcaagaccttcccccttgcacaggatctcgtcacgctatggcctctctaccttgtcgttgtgggatggcaggtcatcagcgtgctcaacatgctcggcggtgcccgccgcgtacgccgtactatggcgccgctcaacgacctggccttgcgcgtggacgagctcggccgcatgcagctctccggcggcaagatggaaacactggagcaggccatcgagcgcgcaagcgtcgactcgccgagcgtcaccaccggcgacgccgacctggcgagcatcgaggtcgcgctcaaccgcctgctgcgccagatgcaagaggccaagttgcagcagatgcgctttgtcaacgatgcaagtcacgagctgcgcacgcccatcgcggtgattcagggctacgtaaacatgctcgaccgctggggcaaagacgacccagacgtgctggcagaatccatcgcgtccctcaaggccgaaagcgagcacatgcaagagctcgtggagcagctgctgtttttggcgcgcggcgatgccgggcgcacggtcctgcggcgtgcgcataccaacctggccgcactggtcggcgaggtatgcgaggaatcgcagatgatcgataccgagcacacgtatcggctggtgtacgacaccacgcttgccagcgacccgcgctgcgacgcgcccgtcgacgtggcgctcgtgaagcaggctctgcgcgtgatcgtgcaaaacgccgccaagtattcggacgcgggaacgaccgtcacatttggcataacgcccgatgcgggcatgggcacgatcgacataagtgttgaggacgagggcatcggcatgaaccaggaatccgcagctcacgcgttcgagcggttctaccgtgccgacaacgcgcgcgatgccggcgcgcagggctcgggtctggggctcgccatcgccaagtggatcgtcgacagccacggcggcgtcatcggtgtgacctcggtcgaaggggtcggcagccgctttacgattcgcctgccacggtaggaagccccctcgtgaatcgaaggtgaatgcttttccgcgaagtgaacgacctattttggacccccgaagcatccgcactttttggcgccaaacccgcaggaaatacctgacaaaaccgcaggaaagagcgacgtaaaagtgtcgatgctccaggggttcgatttcactcgttcacttcgcggaaaaccattcaccttcgttttacggcagcccgtcagtcaccctctcggcattaaaaatggggcaaggccacgcgccttaccccatttttcgttagccatagcagcttgtgcgctactcgcggcacaggtgcacggcgaagccggcgaactcgcgcttaaagtacacgagcttggtgccgccgtcgggcagcagcacgcgcgactcctcgttgacctcgagcccgcgctcggcaaaccacttctcggccgcatcaatgtcgttgacggcaaagccaatgtggcccttggcgccacgaccgttctgcttcatgatctcgaccagcgaatcgttaaagtacgaaacgggggtctcgatgacgggcaggcccatcatcgtcgagaacagctccgcgatctccagggcgtctgccgggtcggtggcgttaatgcccacatgggcaacgcgcatgccaaagagctcgaccggattggcgttctgctcactcatacaggcagagcctactgagccatgacgtcgagaacggccttctcggcagcgacgcggttcatgccggtcatgaagggcacgccgctcacgtacgggcaggtgaggccctcgggggcaacggtggtggcgatcagcaggtcagcaccctcgtcgcagtagtccttggcctcggagatggcgcactgcacgatctcatacttgccggcataaccgttggcgtcgagcagggtggcgaccttctgggcaacgagcgtggaagtagcagcgccagcaccgcaagccaaaacgatcttcttcataggtaatgtctcccttcatggtttactttaggtaagtgtaccgcagcgagcgatgtcactcggcctcgatgagcttttatgccagtttgcttgcgcgctgcgtataatacatccagtacgtgttgtcataccgctcgctttatgagcgactaaggaccctaatatgcccgattcccgcacactctggaccgccgtcgttatcatctgcatcgccgtgtcggtgttctttagcgtcaaaaaacgcaccacgtttaagcgcctgcagcagctcatggccgccaagcagtgggacgagttcgatcgtttgctcgacggcaaactcaccagcatgctgtacccgcgctacaaccgcgactacctgcgcctgaactcctatctgctgcgcgaggaccacgagcgcgccagcgagatgttcgatctgctgctgggactcaacctgcccaagatgcagcgcgtcgacctggtcattaaggcctttaactactacgttggccaggaggaccgcaaaaagtccaaggagttgctgcacgagatcaagggctttgagggcggtcaggccgaggcagtcgcgcacgagtgccagctgatgtacgacacgatgatcctcaagcgccacaacgacattcccgagctggagcgcatgctcgaggatgtcggcgacgacccggtcaagcgctgccgcctggagtacctgctggccctgcagtaccaaaacaagggcgacgaggcaaagttccaagagttcctcgagaagtcgggccaacactcgatggccgtcaacgcgtaacggacggcttgtgctagacttctagtctcacgggggcgtggcggaattggcatacgcaggagacttaaaatctctcgccgcaaggattgtgggttcgagtcccaccgcccctaccacgtattgtttacgagcccgtgtcccccagggatgcgggctcgtttcttttagatgccggtgggactcgaacccgcgagggggcgagcgccaaacggacgcgcagcgtccgcagcgagccgacgagggcgccggcaggcggccgaagccggtgcggatttgcgcagcaaatacgcggacgtcccaccgcccctaccacgcattgtttacgagcccgtgtcccccagggatgcgggctcgtttcttttggatgccgatggggctctatgttgcgatgggatagtttctgttttggcaggctaccagcccatttaggaactatttcaccgcaacttatgaggggatggttaaagggcgctgaggctgggggtccaggcgatggtgggggtcgcgccgtcgagaacctcgttgatggtggcggccatgccggcaagcaggctgttctcgcttacggtgagtgtatcgtagccgccggctcgcatgagctcgcgaatcacaacggcaccagccaaaatcacgcccgcgcgcttgggttgcacgcccggtaacgcggcgatgcccgcaacatccagcgcggacatgctctcgatagcggccgaaacctgctccagcgaaagctcgcgcaggtgcacaaagcttgaatcatacggctccagttcgtggacgagtgccacgagcgtagtgacggtaccacccaccgccaccaggcgctcggcgcgctcaaagtcgacaggcaggctctcaaaatagcccgcaaactgctcgtttgcccagccggcagcagccgcaagctcgtccgttgacggcggcagcgccgagaaaaaccgctcggtcacgcggcggcaaccgatatccagcgagcgcgtcccctccagcgcaaagacgccgcgctccggcgcatagacgcccgtcgcgagctctgtggatccgccgcccgaatcggcaacgatgatgcgctcgccggcaaagtcgtgtgccacgccaaaaaacgtcaggcgcgcctcgacctcgcccggaatcacttgcggctcgagccccagctcgcgcaggccgtccagcagtagcgcggcattggacgcatcgcgcgcggcgctcgtgcatgtggtgcagatgcacgcggccccaaaggcacgtgcctcatccacaaacatgcgacacgcagcgagcacgcgctcaacggccgcctcgcaaaagcgccccgtcgcgtccacaccctcgcccaagtcggtaatctcggtatgcttggacgattccacgatcgccccgtcctcgacctgggccaacaccagtcgcgacgacaccgttcccaggtcaatcgccgccaccttatatcgtttgtcgcaatgcgtcattgcaggctcccctccggacgctatttgccgttggacacgaccgtctggccctcgacgccgttaaatccaaacagcatatcgagcgtctggatgtaccacggcgcgtccttgccgacctcttcgatctctttggcgacttcgctggccttcttggcgttcgaggactttttgctcgacgacgagtccgaatcgtcgtccaggcccagcacgtcaatcttggtctcgccgggcatcaccaggcccaggtcctcggtcgccgcgtccttaatgccctcctctgagagcagcttgtcgacgcttttctgcagctcgtcgttgtactgctggcgaatctcgacctgcttggccaagatatcgctcgagcgtttggcaacgtagaggtcgcgcacgggaaagtacaggctcacgagcaccagggcgacgacaataccgataaacagccctcgctgaggaccgtgggtaaagtcgtaaattgccttgaccgctgcgttgtcgttggcgtagtgcataaagtccgagccggaaagacggcttgagggacggcgcggcttgtcggacgcctgggtcgaagggcgcgacgcatgcttggaacgcgatgggcgcaccggactatccgaggaactatttggctgagcattgggatgcgaagtcgccggcgagctatacctggagcgatcagcaccagcataaccagacccgccaagctgtgcggtacgcgcacgacgaggcgacggctcgcgcgaaccggcggaataatacctgttgtcgtaaatctgatccatgtgcgccttgtgcggttgaggtttgtttgcgctaagtcctttagttatagcacgagcgcccgcaccgccttcgccagcctttgctcgacataaaaaaggcgctgagccgtatggcccagcgcccatagttctttgcggcatccagccaagacggggaggaaccgagtcagcctccccctcgccaaattcgcccgtttagcgaatgttgtagaacgcggccttaccggcgtagcgcgcgctgccctcgagctcgtcctcgatgcggatgagctggttgtacttggcaatacggtcgctgcggcacggggcgcccgacttgatctggccggcgttaacacccacgaccaggtcggcgatggtggagtcctcggtctcgccggaacggtgactcacgatgcaagcgtagccggcctccttggcggtctcgatggcctcgagcgactcggtgagcgtaccgatctggttaaccttgaccaggatcgcgttggcggcacccagctcgatgcccttcttgaggcgctcggtgttggtgacgaacaggtcgtcgcctacgagctgcaccttattgccaatgcggcgggtgagctcaacccagccgtcccagtcctcctctgccatgccgtcctcgatggagatgatgggataggtgtcgacgagcttctcccagtaatcgaccatctgagcgctcgtgtactcaacgccctcgcccttgagctcgtacatgccggtctcggcgttgtagaactcggtcgatgccggatccatggcgtacatgaagtcaacgccgggcttaaagccagccttctcgacggccttggtaatgtactcgaacggctcggcattggtcttgaggttgggtgcgaagccgccctcgtcgcccacgccgccgccaaggccggcctcgtgcaacacgcccttgagggtgtggtagacctcggcgcaccagcgcaggccctcggcaaagctcggggcgcccaccggcataatcatgaactcctggaagtcaacgttgttgtcggcatgcacgccgccgttgaggatgttcatcatgggcgtgggcagcaggtgggcgttgacgccacccaggtactgatacagcgacaggcctgccgactcggcagcggcgcgggcaacggccagcgacacgcccaggatggcgttggcaccgagcttggtcttgttgggcgtaccgtccgcggcaatcagcgcggcatcgacggcgcgctggtcgaaggcgtcgaggcccacgacggcgttagcgcactcgttgttgacttgctcgacggcctgcgaaacgcccttgcccagatagcggcccttgtcgccgtcgcgcagctcgcaggcttcgaaagcgccggtcgaagcgcccgaaggcaccatcgcgcgaccgaagctgccgtcctcgagcacgacctcgacctcgacggtagggttgccgcggctgtcgagtacctcgcgaccgtagacatccaaaatatcgctcatgttgtctccctctcacttggaaacgtagttgatgcaagcgactggccgactgtgcaccatcggtgcacctccgtaagttagccatgtcgcactttttgcattatgccctaagttagccgagggatacatatgaattagagaaatcactttttgaggcgcttgtttttgcaccgagcattcatctctagaggtcgccccccattaaattcttctatcggcataccgtctttacctggcttacgaatgaaagagccaataatgtgcttttgcatcgtgcaaagttctggatatcgtgcaattctaagggtctgaagttctggatatcgtgcataatcaggttacaaaagttctggatatcgtgcacgaggtagccatgcttaaacgaaaagcctatgacaaactactaaaatggaagcatgaaagcgctggtaaaacagcacttcttattgaaggagcccgccgcgtcggcaagagcacgcttgcccgcacgtttggagaaaccgaatacaagtcctgccttgtcattgatttctttcaagcacctgccgaagttaagcaatattttgaggactatcgcactgacttcgactcgctcttcctctatctctcggttttctataacgtcaaactctatgaacacgagacgcttatcgtctttgacgaggtccagatgtacccgcaagcacgcggactcatcaagtatctcgttgcagacggacgttacgactacatcgaaactggatccctgctcagcatcaagcagaacattaaagatatcgtcatcccatccgaggaagagtctctggaacttgagcccctcgactttgaggagtttctttggggcatggacgaaaaggggctggccgatctcattcgcatgagttttaacaagatgaagccgctccccgatgccctacatcgcagagcgctctcccttatgcgcgaatacatgctcgtaggcggcatgcctgagccggtatccatctatgttgaacagcgcgcttttgcgcccgtcgacgcttcgaagcgccgaatcgtccagctctatcgcaacgatatctctcgttttgcaaccggttacgaattcaaagtcgtctccgtactcgatggcatcccaggtcagctctctaagcacgaaaaacgattcaagctttcctcacttgataaaaacgcacgcatgcgcacctacgaagaagccttcttttggctggcagacgcgcgaattgccaatatctgctatgccgcaagcgaaccgagtgtgggtctttcactcagcatggagcaaacggccctcaagtgctacatggcagacaccggcctgcttgtaacgcttgccttctctgacaacaacgataccgatgaagacgtttacagagccgtgcttcgcggcgacatcggattgaacgaaggaatgcttaccgaaaactacgttgcccaatctctaaaggccaatggacacaggctcttcttttatttccaaagcggaaagaaggagggggaggagcgcatggaaatcgacttcctcgttacccgaccctatgtcaatgccgccggaaagccgcgcatcagccccgtcgaagttaagtcgccacgcagatacggaaccatctccctcgaccgattccgcgcgcgctttaacaagaagattgggatggcttacgtgttgcaccctaaacaactcgagtgggatgccgaagcgcagctggcacatcttccgttgtatatggctttttgcttgtagagacctctctacgaatggatgccgtgagagacgcaggcctcactcgcttgcttttgcttggtcccacaggtcgttgagttgagcggttgagcaggcggcgaggtcatcgcccgcctcgtgcacggcggcctccatcgcagcccaacggcgacggaactttgccgtgctggcgcgaagggcgctctcggcgtcaatcccctctttgcgcgcaacgttgactagggcaaagagcaggtcgccaaactccatttcgcgctcgggcgagccgggctcctcggcctcaaactcggcacgctcctcggcgacctcatcccacacatcctggaccgtctcccattcaaagcccacggcagccgccttgcgcgacaccttctgcgcctgcatcagcgccggcagatgcgtgggcacgccgtcgagcaggccctcgggcgcagcctcgcctgctgccacggccttgtccttggcagccttctcggcaagcttaacctcgtcccagatcttgagcacctcgtcggagttatcggcgtccgcatcgccaaacacgtgtgggtggcggcgaatgagcttggcgtcgatatcgcgcgccacatcggccagcgtaaactcaccggcgtccgccgcaatctgcgcatgcagcaccacctgcatgagcacgtcgcccagctcctcgcgcagatgcgcggcatcatcggcctcgatgcaatcgagcgcctcgtaggcttcctcaatcatgttcttgccgatgctctgatgcgtctgttcgcggtcccacgggcagccgtcgggctgacgcaggcgccaaatggtctgcaccagatgctgcagctcggccgatgcatctaccagcgtggacagatcgcgcgagccctcggcattttgctgagccatgtgctgcgccatggttagtcctcctccatgatcacgtggcggaacgcgccgccctcgtagatgccgtagctgtgcgagccgtccttgggaatgctcacgctgccggggttgaagagccgcaggcccgggtgcgcggcgctctcctcgttgaccttgatgtgcgtgtggccgtagacgagcgcggagccctcgggcagcgcgggcgcgtggtcgacgctgttgtgcatgccggcgccaaagacgtggccgtgcgtcaggaacagctcgcggccggtctcgtcgaacaacgtggcgtagtcggccatgaccgggaagtcgagcaccatctggtcgacctcggcgtcgcagttgccgcgcaccgcgatgatgcggtcagccagggcgttgagcagcggaatcacacgcttgggggcatagtcgcgcggcagatcgttgcgcgggccgtggtagagcagatcgcccagcaggacgatgcggtcgggctgctcggactcgatggcggcgaccagacgctcggtccaatatgccgaaccgtggatgtcggaggcgatgaggtatttcatggggagatcctttcggatggggttgatatggctgggcgcgggatgtcgccggccgcgttattcaaatcgcagtgccgcgctctgggccgtctgcatcacgcgctggagcggcacgtcgtgctcacgggcaagacgggcgcagtcctcgtactcgggcgccgcgcgctcgctgccgtcgggcagggtggccaccttgacggacacctcgccccatggcgtcgttacgcgctcaaagcggcgtggcagacaaacgcgctccataacctggcggcggatgccattggtcgtggtttccaaaaagatgatcgtctgcaggcgctcgatatcctcgtgggtgcagattacctgcagctgccagccgggacggcccttcttgcaatagaggggcagccagtgcacctcgcgcgcaccggcctcgcgcaggcggtcggcggcgtaggcgagcacctcgggcgatgcgtcgtcgatatcgcattccagcttgacgatagtctcgggcgcatcggtctcgcgggacagcggagatttgctatcgcatggcatacggtccggctcctttccgcacgggctcgttttgttcacccaaacgctaacacatcgcgggcggcgtggatgtggcagagcgcgatgagcgcgattttccttgttcgcaagaaaccgacactccaccgcctcagccaaacatgtacatcagcctccaaacatgtcattttttgcagcttttggaggctgatgtacatgttttgacgcggggccgataccgtcgcggcgaccctcgcacgcaacccacctttccagtcaatttcggtccccggtgcgctcgtcgcatcggggaccgcgccgttacaatggagcggattcgcttgacgcaaaggagctgccatgtctgcttgcccgctggtcgattgccatactcatacctcgttctcggacgggcatgcctcgcttgaggacaacgtccgcgccgccgctacggccggctgccgcgtcatggtctcaaccgaccatctcaccctgcccgccagcatggatgccaattgcgaggtacaggttgtcgagggcgacctgccggcgcatcgtctggcttttgaggatgctcgcaaacttgccgcgcagatcgcgccggagctcgagcttatctatggctttgaatgcgattggtacgagagctgcgagcctttggttgagcgctggtcccagggcgccgtcgtacgcctgggcagcgtgcattggattggcaacccaggcgatatcatggccggtgccgcgggtacggcgggaacggaaaacgtcgctcgccccgatacacccgattccctttgcggttggatcgacgacgacaccgacctgcacgtttgggaaaacctgggcgtgcgcggtgtgtgggagcgctacgtcgacgactggtgtcgcgcctgcgaaagctcgcttaactttgatgtgatggctcatcccgacctggtcatgcgtttttcgaaggaaggctttgcgcccgattttgaccccgcgccattctggaagcagatggccgagtgcgcgcacgatacgggccgccgcgttgaggtctcgaccgccgcaccgcgcaagggactcgacgactactatcccgcgaccggccttttgcgttgcttcgcccatgccgaagtgccgatcacctttggctcggacgcgcaccgcgcctgcgatatttgctggaatatccgcgaggcccagggccacgcctacgactgcggctatcgaaccttcgacatcccccacctcaccggcgaatgggagcccacgcccctcgcctaagactagtcattgagggcactcttcacaaatgaccccttggggacggaggaaaacaggtcgtttcgctcaccaccgacgcccgtgcaacaccgcccgccaaaaagaacgcccgtttactacgatgaaccgcaaacctccgaccatcggcttaatgcggaaaataaaaccgcaggtagaagcgttgacgatttgttcaaaaccgacgtgtggtcagcagatccagtttcatcgtagtaattgggcatgttatttggcagcgccggcaaagactgccccaaacgactagtcgtttaagaacgtccccaatgactactgtcccccttgcaccaaaagcttgactagtggcggcgagcgttgagttcgccggccagttcgtcgagggtgatgccgtagcgctcaagcgtcacgagcaggtggtagaccagatcgccggcttcgtagcggatgtggtcgtggtcgttgtccttgcaggccatgatgacctcgctcgcctcctcggcaagcttcttgagcagttcgtcctcgacgtcggtcagcagacgagcggtgtagctctcctgtggcgacgcatcgcgacgcccgtgaatcacctcggccagtcccgtcagcgtctcgccgatatttcccggctgcacgttagctgttctgactcccatggttatttcctctcgttactgcagcgtaaagtaggtaccggtctcatcgaaccgaggctttgcgccctttttctcaaagaactcgacgatgacggcatgggcctcatcaagcctttccttctcggcctcgagccaaagcgactgcgccccgcaggcatcagtcaggtgcacgcggcatggcacgcccgcgcggaggagctcggtgttgcagtcggcgacctcgaacggcgtcacgactttcatcgcactcccccttccacgcgcttaaagaagcaggtacggttgccggtatggcaggccggacccggcgagtcaaccttgaccagcagcgtatcgctatcgcagtcggcccaaagctccttgacctcctgcatattgccgctcgtcgcgcccttgttccagagctcctggcgactgcggctccaaaaccacgtggtaccggtcttgagcgtcagccccaccgactcctcgttcatccaagcaaccataagcacctcgccggtgtcatactgctgaaccacacaaggaatcagccccttggcgtcgtatgtaagctttgaaggatcggttatctcttccatttctcttcccaaattcaaacttcgcaggtcggtgagggttgtccaggtgcccgagattccgagcgacaagcccgacgacgcgtacttaagtacgcgaggagggttggagccggaaggtcgggtgcctgggcaagccgcagcattagaagtccagcctcacaggaataccttgagaggccatatactctttgacttcgcgaatgctgaacgtcccaaagtgaaagacgctcgccgccagcacggcatcggcctcgccctcgatcacaccctcggcaaaatgctcgagtgtgcccacgccgccgctcgcgataacgggaatcggcaccgcgcgggccacggcgcgagtaagcgccagatcgaagccggccttggtaccgtcgcggtccatgctggtcagtaggatttcgccggcgccacgacgagccgcctcctcggcccacgccactgcgtcgatacccgtagcgttgcggccgcccgccgtaaagacctcccacttatcggcgcccggctccccgggcagccccacgcgcttggcatcgatcgccacgaccacggcttggctgccaaacgccgcggcggcctggctgatcaacgacggatcgcgcacggcggcagagttgagcgacaccttgtcagcaccggcggcaaccatggtgcgcatgcccgccaggtcgcgaaagccgccgcccacggtatagggaatggccagctcctcggccgcatgcgccgccatctcgatagtcgtcgcacggttatcgctcgtcgcggtaatgtccaaaaatacgacctcgtccgcaccctcgcggtcgtaggcgcgggccagctccaccggatcgccggcatcgcgcaagctcacaaagttgacgcccttgaccacacggccgtccttgacgtccaggcagggaattacgcgcttggtaagcatgggctactcctcccctcgagcggcggccagcgcctgggccagcgtaaagttgccctcgtagagcgcacgaccggtaatggcgccttcaatcgcgccctcgcccaccgcggccagcgcgcggatgtcgtcgagcgtcgagataccgcccgacgccacgacgggaaagcccgcgacctgcgccacatggcgatacgccgccacatcgatgcccgtctgcatgccatcacgcgcgatgtcggtatacaccagatgtttaaagcccagctcggtaagctgcgccacggcatcgtcgagtgccacgcccgcgccgtcgcgccagccgttcaccttaacctggccgtcgcgcgcggcaatgtcggcgaccaacagctcgccaaggccctgggctgccacctcagcaaaacccggctcggtcacgagcacggtgcccagcgcaatgcggcgagcaccatagcctgccagctcatcgatgcgtgcgagtgagcgaacgccgccgcccacgtccacggacagaccgtcgacgccgcagatggccttaatcgccgccgagttggcagcgcatgtgtcctcgtcctcgccaaaggcagcggacaggtcgacgacatgcacccagcttgcgccctgctcggcaaacgagcgggcgacggccacggggtcatcggaatataccttgcagcggttgcggtcgccgcgctccaggcgcacaaccttgccgccgatcagatcgattgcgggaaacaggatcatcggccaacctcctcgacgatgttgacgaagttcttaaggatgcgctgacccagcgcggaggatttctcgggatggaactggcagccccacacattgccgtggcgcacgatgcacgggaaactccgtgtatagtgcgtgcgcgccaacacatcggtggcatcgacgtcgccggccaccgcgtagctgtgggtgaagtacatattggcgccctcggcaaaaccggcgagcagcggatcggccgcgccggcaggcgtcatgtgcacctgatcccagcccacgtgcgggaccttcagacggctcgactccaggtgcgtgcacgagccacgcatgatgcccaggccatcgacccagggaccgccggcctgctcggaggcatcgtcgtccgcgtccacgccctcgtccgcaggcacgccctcgttgccacgctcaaaaaatagctgaagacccaggcagatgccgagcagcggagttccggcggcaacggcatcgagcacggccacctcctcgccgctctggcgcataaaggcgatcgcgtcatagaacgcgcccacacccgggatgaccaggccgtcggcgttgcggatctgttccggatcgtccgatgtgcaggcggcggcaccggcgcgcgcaagcccgcgcacgacgctcgacaagttgcccttgtggtagtcgaccaccacgatcttcggttcgcccacgcgacccctccacttctcatcatccaaaaccaccacaaaggtgcctgtccccttcgtggtggttttacccttgtgacggttatagcgagcccttggtgctggggatgccctgcacgcggggatcgagctcgcaggcgtggcgcatcgtgcggcccacggccttaaaggcggcctcgataatgtgatgcgagttgccgcccgccagctcgcgcacgtgcagcgtaagtttggcatcgcgcgcaaaggcatagaagaactcgacagccagctcggtatcgaagctgcccacgcgctcggtcggcacgggcagctcgcagtaggcctggccgcgacccgaaatgtccacggcggccatcacgagcgtctcgtccatggcgatcgccgcatcggcaaagcgcgtaatacccgctttgtcgcccagcgcccggcaaaacgcctcgcccagcacaatgcccgtgtcctcgacggtatggtgcgcatcgacttctacatcgcctaccgcatgcaccgtcaaatcgaacaggccatggcggccaaaggcgttgagcatgtggtcgaaaaacggcacgccggtcgagatatcgcacgtaccggttccatccaggtcgagtttgacgacaatgtcggtctcccccgtcttgcgggtcacctcggcataacggcccatctagatctcctccttcaccagcacggcaaacgcagccagtacctcatcgttttcctgcggcatgcccacggtaatgcgcagacagtccgaaagccccggcgcatagctaaagtcgcgcaccaaaatcgaatactcgtcgcgtaggcgctcgcgcacgcgcgtggcatgcggcgtacgcacgagcacaaagttcgccgcgctcggccatgcctccacgggcaggccctcggtagccatcgcgcgcagggcgcacagctcgcgctcgcgctcggatgcgacctgtgccaccacgggcgtgtacgcatcgcgggcacgcacgcaggcaagcgccgccgcctggctcagcacgttgaccgaatagatctggcgaatcgccgcgaacacgtcgatgacctcggacgccgcgatcacgtagcccagacgcgtaccggcagcgccaaacgccttggacaacgtatgcagaatcaccaggttgggatgctcggcgataagcccctgcgccgtggtggccgcgccaaacaaatcgtcggcaaactcaacgtaggcctcgtcgaccattaccatgccggggcacgcatcgcacagggccgcgacaaagtcgagcggcgtcacatcacccgtgggattgttgggcgaggtcacgattgccaggttgcactcgggcgccgccgcaagcacggctgtctgatcgagctcaaaggtcgcagggtcgcgccacacgtcgcgcacctcggtctggcagagcgacgcaaagaacgcgtactcgctaaagcacggtgggcagttgagcagggtccgtcccgcgccgccaaacgccaacaggaagttatagagcagctcgtcaccgccgttacccacgcagacattctcgcgcgccacaccatgccaagcggcaagctcgtcgcgcagatcgttggacatgggatcgggatagcggttgagcggtgtagcagccagggcggcgtcgaccgcctcgcgcacaccagccggcacgggataggtgttctcgttggccgaaaggttgatgcgtgtgggcgtaaagttgggatcgtagggctcaatgccggccaagtagggctggacgagctccttcatacggggcgtcagctcggccatattaggcctccttgccagttgtgccaacgccatccgcgcccgcagccgccaggtcaacgccctcggcaaccgtcgccacggggtcgcccggccaggcgaccttggtcaggtcggccgcggcgagcgactcgacgctcacggcatcctcgccctgctctagcacacggcgacgcagtgcggcggaaagcgcgtgtgcccacaggccctcggactcggctagacgctgcgtggcgggagcgtccgagagcaggccctcgggtgtatagcagataacactcgagcgcttgacgaactcctccaccgaaagcgggttggagaacatggccgtgccgccggtcggcagcgtgtgattggggccggcaacataatcgccgagcggctcggagctccaagcacccacaaagatggcgccggcgttgcgaatgccgccgagcaggcccatcgcgtccttgcagtgcagctcaaggtgctcgggcgccacggtgttcacggcctcgacggcggcagccatgtcggcggccaccacgatggtgccctcattgtcgagcgaggcgcgcgtaatctcggcgcgtggcgactgcgcgaccagaatatcgatacccgcctcgacctcacgcgcaaactgctcgtcgcaggtcaccagatagcaggctgccagtggatcgtgctcggcctgggccatcaggtcggccgcgaccaccatgggcttggccgtggcgtcggccagcacgcagacctcggaaggaccggcgaccatgtcgatacccacgtcacccgagacaatctgtttggcagcggcgacaaaggcgttgcccgggccggtgattttgtcgacgcgcggaatggtctcggtaccgtacgccagtgcggccacggcctgggcgccgcccaccatatagatctcgtccacgccgccgagctttgccgcggcgagcgtgtaggggcttatcaggccgtccttttgcggcggggtcaccatgaccacgcgtttgacgccggccaccttggcgggaatggcgttcataagcacggtggaagggtactgtgcacgaccgcccggcacgtagataccggccgcagcaagcggggtcaccttaacgccgagcatcgtgccgtccgggcgcgtggtaaaccagctctgctcgacctcgcgctggtggaactcgcgaatctggcgtgcagccttttcgagcgccgcgacaaaagcgggatcgaggccttcgagcgcggcatcgatctgctcttgcggtagacggaagctctgcagttcaacgccgtcaaagcgctggcaatagtcgcgcactgcggcatcgccgttggcacgcacgttggccacaatatcgcgggcggcgtcgacgatgttttgcggcagcacgcccttacggttgagctggttggtaacgaggcgctcgccgggagcaagcttgatggtcttcatatcggtatcccctatcggtcgaggttatgttcgaaaaacgagaggccgggcggcggcgccagtcgacccgcagcccagacgttggggcgcccgtgcgtgctcgcgctattgtgccgagcccgcaacgggctcaaaatgcctgtccttcacggctgccgccaagcgatctgccagattgcgtacgcgcggatccagacgtgcggcgcctggattgacaaagaagcgggccgtgcagtccatgatgcggccggtgatgaccaggtcattgtcacgcagcgtggcgcccgtggcggtaatgtccacgatgcgatcggtcatgccaacgatggggcccaactcaatattgccgtgcagcgagacgatgtcggcgttcacgccgcgctcggcataccaggcactcgcgatgcgcgggtacttggttgccacgcgaagcgacccacggcgggcatagttgcgctcggcctggccggcgcgccacgcgggctccgcctcgataaacgtgcacagaccgtagcccaggtcgaccagctgcagcaggttgaggtctgcctcgataagcgagtcccagccgcagatgccgcagtcggcaccgccgcagcccacaaaggcgggcgcgtcgctgggacgcacgatgacaaactcgatatcgccgaccgcaccctcaccggcctgtgtgtcgcggccgcgcacgatgaggtgacgaccggggtcacgcagctcagagacatccaagcccgcggcctcgagcacgtcgagcgtgtcagccttaagcgagcccttgggcacggcaatgcgcagcggaccctcggcaccgcgccccacggcgtgatcgccatcggaagcagcgtcctcggccgaggtgtgcgcggcctccagacgctcgagcgaaaaggcgaagcccgccgccggcacctcgatgccgtcgccaaatgcaccggtaaagatggagtcgtagcgtccgcccgaaccgaccggatcgggcagtccgccggcataggccttaaagaccaggcccgtgtagtaatcaaacgagttcatgatggagaagtcgaaggacagcacctgggcgtcctcgggagccaggccctcgaccagggcacgcagctcgcgcgtgagcggcgcgacaacgcccgccgccgtcagcagcgcgtcgacgcggtcgagcacctcggcaccaccgtgcaggcgcggcagctcgctaatggcgaccttaacggcctcggactcggtgcttttcgccacgcgggcatcgaggcccacgaagtcgttggcgtgcacacaacgcaatgcctcggcagccagttcgcgatcctcacaggccgcgagcagttccttaaacggacgcacgctgcccgcgataatgcgcgcaccgggaagtgccagcttgcgcacggcctccgccaccagcgagacgatctcgacatcgcccgcggtatcgcccacaccgataagctcaaaacccaactgcgtaaactgacgcgagccgccggcattgcgctggcactcgcgaaccaccggcgcctcgtagcgaaggcgcagcggcagatcggccgcgcgcatgcgggtcgaaaccaagcgcacgattggcagcgtgttgtcgggacggaccaccagcaggcggccgtcatcatcaaagagcttaaacggggtgtccgcaatgcggccaccctcctcgagagagcccttgtcctcgagcagcggcgtctcgaccggcaggtaatgatgctccctaaagcagcccttcaccgtcagcgcaatctcctcgcgcgcctgagcctcctcgggcaatatgtcccggaatccccacggtgtggccgtcatctggtgagcctcctcatgctgtgtttcatatagaacagaagaccggcatagctccgccggtcttctgggtactttagcatactagagtgcttgcggggaaaatccgtcgtagccgctcacaccgtattcatttggaaacatagggcagattgccgcaacccaaccccacctaggcgccaatcgcacgacgatactctgccattacctgcgcatcggcagctgcggggtcggcaaaatagcgccagtcataggtctcggccgaaacaactccgcgatagccgcgcgccaccagcctatccaggtcggcgcgcatatcgcggtcgccgtcaccccaggcaagatgcgtcgtgccatctgccgcaacatcgacaaaatgcacgtgggcgacatcatcgccaagcagatcgaaataatcgtcgatggtatcccccgccaccgccatagcgcctatatccagacacgccttaagtgccggatgatcaactgcctcgatcatgcgcttcgtgtcggccgccgagttcacgatcatcgactcaaccggctgtagggcctcgagcaccagtcgcacgccgcgctctcccgcatgctcggcaatcgcacgcagcatcgaggcacttcgaccccacgcgtcctcgattggctcgttcaaaaatgcccagccgctcgagaccatgacctgctcggctccaagttccgccgcgatatccacaacgttcttaaagtacgcgagcgtgcgggcacgtgcctcattcccgcgcgccgcgatattccacggcttggggttgttctgttcgggacaaagccccacaatccgaaccccataccgctgcgacagctcccgcacctgctcgagcgaatcgtatccatggcaatcgacatacagatgcatcgccccggtccaaagctcgcaacacgtgtagcccgaggccgctgccgaagaaaagaattcctcaaggtcaaaataacgatggctgatattcatgacggcaagctgcggatactccatcttgtccacctttcggcaaaagggcgccgcagcacagtgtgcgcgacgccccctcttacattgttctcattatgacggatactctactggacaccaagcactccaaagaacgcgccagcgatactcacgagcaggatcacgagcatgataagcagcggattcatcttcttcttgagcatgagatagacgattccaaacagccccatcgtgacaaagcccgggaagattccgttgagcagctcggccagcgtctgagcaccatcgcccgcaccgaccatgagcggaatgtccacggtgaccatctccatggtcatagcgccgatcaccatggcgcccatgatagaggccatcttgacgatcgtgtccataatgcccgattcctggaccttgctgatcatgtccgagccaaagcgatatcccacaaacgtcagcaggtaacggatgatgtagtgagggacgttgaacacgagcaggaacaaaatcgggccaagaatagagccctgcagcgccagcgacgtgccgacacccgttgccaaaaatcgcagcgtgccccagtagaaggcatcgcccacaccggacagcggtcccatcaaagcaagcttgacatttgagatcgcgctcgtgtcaaagctatcgtcagtagcgttgacctcttccattgcagcggcgatggacatggggagcgtcgagatgtacggcgtgacgttatagagctccatatggcgcttaagggcggccttaaagtccgcatcctgcggatacagcttgcgaagaatcggcataagggcccacataaagccgatatggcccatacgctcgtagttccaggaatgctcatagggaatcgagcgccagaacagcttcttaaggtctgcgcgggaaatcagcccgtcgtaagaagactcaaacttaaaactcatcgaacccactcccaatcgcaggatcctcggttgccactgcgggctgctccgcttttttcttatcacccaaaaccgtcatcgcgacgacgatgatcgcggcaaagatcgccacgcccgtcgtgctaatgccaaagtaggcgacgaggaagaagccagcgaagaagaacggcgccaccgttttgttcataatcatctgcgccagcatcgcaaagccgagtgcgggcaagaaggcggcggcgacatccatgccggcctgaacgaaatcggggatgatgttgagcaggctggcaacagcatcggcgccaaagaagaatgccaggggaataatcagcaggccgcaccagctctgcgcgtaaccggcgatgagcatgttgcgcgtgatggccttggtgtccccgtcctcgacgtttttgtcgatacggtgcaccagcagtagcatcaccggctggcccagggccgtatcaagcgccaggacgatcgttgcgatgggaatgcccagggtcagggccgccgaagcgtccgcgccggcctgcatggcaagcgacacacccaggatggttccggaaatcgtatcgggcgggttatacgcaccgaccgagatggcgccgaccatggcaagctccatcgtggcgcccatgatcgtgccggtcaccatgtcgcccatgacaaggccaaccagaggtccgagcacaatcgggcgctggaggtagctcgtaccggtcagccactcggaatagcccaaaagggcaataaggaaaatcaggattgtcttgataaccatgacagcccctaaccgatgaccttcgcggcgtcagtcttcgcatctgccggaatcatctgaatgaacagttcatagccctcgccgagcagctctttgacgtatgcctcgttttcgggcgtaaggaacacactcgtcgagacctggcgggcattctcgctaaaggcaacgttgccgaggttgatcttcttgactcccatcgccttggcgacggcaccggcctgctggatcgtctcgcaaaccacgaagagcttgtacttatcggtcactccgctctggagcgccttgacggcgtcctcggtgtttttgacgacgaccttgcagccctcaggctttgcaagggacagggcctgtagacgaagcttgtcattgaggaccgtgtcgctcaccaacaggatgcaatcggcacccagagccgaggtccagctaacggcaacctggccgtgaagcagtcgataatctacacgaatcatctgaatcatgatgtgctccctagtggttaaaactcatcgagctcggcctgccccagcaggtcgttgacgtacttgaccttggtgtcgtccgcctcgacgatctggcgaatggcctcatcgatcggggtggattcgggcacgaacagcagctgaataaggagcggcaggttcatattggtcaccagatgcgtgttgggacgcgtctggacgatcttggtgaactcgttgttgacactgccaccaaagaggtcggtgcaaacgacgacctcatcgtccgcggcaaagccgtccagaatcgctgcggcctccttggtcaggtcctcgtttccgtcgacatacatagagagcgcatggacgttttcgcgctcgccggaaagcaggccgatgctctcgacgattccagacgcaaaatgagcatgggacgccacgataaactgcctcattcgattccccttcctagcgaatttcggcataaaaatgcccggacgcatgcgcccgggcagggtgcttcttaaatgagtggtcaactattagtagtcgaactggtgatagtaacgacggtagttgaggttgtgcttggtgaccgtctcgtagtaagcggcaaggcgatcggtgatcagcgaggagaggatccacggagacacgatgacgcggaactcgtcgtcaaggccggggatcgcgaactcggcggtgtcgatgatgttgatgtcggtgtcgccggtcacgccgcggttgaggaaggcgcggacgcgctcgtcgagcttgcggttctcgtcctcgcccatgaacaggaacacggggacgccgggctccacgagctcgagggtgccgtgaaagaagtcggccgaggtgatgtagcgggtgcgcttccactgcatctcctccaggatgcacatcgagaacaggatcgtctcgccccacagggcgcccgagccgatgaacatggtgtagggggccagggcgtacttcttggcgagctcctcggcgcgcggctcgaagctcttgcggatgtcgaccaggtgggtccaaacgtccttggtctgctcgatgaacttatcgaactgcgggaagcagccgcggcggttgagcaggcgcaggccgaagcagtcggcgaggtagtagcccatctcgcagccaccgttaccatgatcggaagccatcttgacgcaattctcggcgccgacagcctggccgatgagaccctcgggcttggtcatggcgtagacacgaatgcccttttccttcatcttcttgacggcctcgaggacctcgggggtggtgccggactcggaggcggtgagcacgacggacttctcggtcatgcgcttgtggcccatgacgttccactcggcggcgtggatcaggtagacctcgaggtcgcggtcgccgaacttgttcatgaggtactcgagctgcatgagctcgtcccaggtgccgccgacgcccatcaggaacacggcgtcgtagccctcgtcggcgaccttgtcggcgagcgcggtcatcttcttgccggcctcgtagacgttcttgccgtcctcgacgtagccctcctggctaaagtgcatgatctcgatcttctcggtttccttcatggcttttcctttctgtcctgcacgcgaatctatacatcgcgtttcttttcgataccaattatagacatacacccaacgtgtttttaataccacttttcaatctgttccaatcctcggtgaacggtcgaaattctctggtgagtggtattaaattagaatttgatgtatagctaacgcccccggcgtctcccttgtgtgacaaagaacagcgttcctaccagcgcaataatggtcgatgctccaaacagtaccgtctggacgcccaaagcctccgccaaaaatggagccgccagcagcggcagcaccccggcgctcatcaggccaaaacgcacaaagccggtaatgcgccccaggtatttgatgtcggcacgctcctgaatcaagatcatctgcagcggctccaggaacccccaggccagaccgttaatcgcctgaccgataatcgcgacccccagcatatcggtgcccacgtacaccatggacccaatgcccacggccatgagcgcgccgagcagcaatcgcaggttgacatggcgagcagaaagcttggtcaggatgaacgcacccaccgaggaagtgaggcccacgaccgaggacagccagcccagccagacgatatccacgttgagcacatcgcggtagaacaacgactccagcgaatcgaacgcgccgaacgcaaagaaacccaaagagcccgatataaagatgaggcgcaagtcgtggtcgcgaaacgtaagtcgcgcaccctcggccatgccgcccaaaataccgcccttcggcttctccccttttgcgggagcaacacactcgtgacagcccaaggagagcacggccgccacacccatcatgcccgccatgagcagatagaccgattgcgtggcaaaacagctcacgatggcaccgccgagcagcgggccagcggtataggcgatattgctgtagaacaccatgaggccgttcacgcgggtacggccctcggtggtcgactccaggtatcccggaaacgcatgcgtgcaggtgttgataaagccgcccgcaagtcccaagacgcacgcggcaaacacaagcccagggacagacaacggcgccaaccccacgccaagcgatagcactgccgtaatcacgcacgtcacaaacgacgtccggcgcggtccaaagcgatcgatgaccgaacccgacaccatattgcccgccgacgtcataagattgcgcacgagcgtaatggcggcaaccaaaaaggccgtgccggccagatcatacgtggccgcaccgataagccccaaaaagtagaccgcgttgttggcgcaccactgcagggactcaataagaatcagcctgacctctgccggcgtcaggcgcattgcttcgcgatccttcgcgaacatacgaactccttctatacaaaaaggggatggagggcataggcctgctccatcccctttccaggttgcaacgaaaatctatgcagccggacccttacgccagcacgccgaagaacgcgccgatgatgcccacgaccatggtggccacgatcagcaccatggggttgatcttcttggacagcagccagtagtacagccagaaggcgatcatgccgagcatgccgggcatgatgccgtccaggatgtcctggagggtctgggcgtcctcgcccgagccgatggccaccgggatgctggcccagaacatgtccttgcacatggcgcccacgaccatgacgcccacgatgcccacgcaggtcatgatcttctgcatgaggccggtcctctgggcctcgtccaggaagcccacgcccagctcgtagcccttgacggcgccccagacgcgcagcgcgaagccggggacgttgtagatgagcaggaaggcgatggggccgaaggggttgccggcctggcacaggctgatgcccaccgcggcggcgaccacgcgcagagtcaacaggaagatggagacgccgataccggacagcgggcccatgagggcggccttgacgtcgttgacgctctcgggctcgatctcgccgcgggcgaccttctcctccatggccatcgcgatgccgccgacgaacggggcgaactggacggtgatgttgaagaacgcgcagtggcggtgcagggcctcggcgtagtcgtcggagcggccggcgtagatcttcttgagcatgttggcgaccatcaggcagaaggcgatgttcatctgcttgtagtaggtccaggagaactccatgcccagggcgccgacgttgacggcgctcttgacgaggtcggagcgcgtgatcttgttctcgggactagaagtcatcgtcctcatccccttccgcggagagctggggctgggctccgcccaggccgagcaggtcgaacttgtcgatgccgatgatgatggcgatcagggcgacgcccaggacgggcacgttggcgtaggagcacagcaggaagcccaggaagtagaagggcacgagctgcttggtgagcaccaggcggccgagcatggcgaagcccatggcaggcaggatgttggcggccacgccgcaaccatcgatcacaaaagacgggataaagtcgagtacgccctggatggcgtcggagcccaggtagaatgcgccgccgcacagcaggaagtactcaaggcagccaaagaggcccatgctccaatgtgccgcgtagatacccttgaggttgcccttggcagcgcacttgtcagcaatgtcaacaatgatcgagaatccagcatccgtaatgttgccgatcgtcagcgaaaggacggcgataggcatggcgagcgcgatggccgtctcggtaccctgaccgagctgaatggcaaacgcgcaggcgagcacgccgccgacggtttcgttaggcggtacgtaggcgccgatggagatcgagcccatgaacagcaactccaggctggcgccgacggcaaggccggtctgcaggtcccccagcaccaggcccacgagcgggcacaggacgatggggcggaacgcgtagagggtgccgagctggtagtcgaggcatccaaacgctccgactaagccgacgaggattgcttggacaagcataattcctcccaataaggaatctcgaaccgtcgtcactcccgtcgcgcgcgttgttgatatcaattccgggagttcgattccacggctcgaagcgtacctggtgtgctgctaacacccatgccaggcacaaatgatttgataccaattatagatatgcaggttcttactatttaataccactcgctcagcggggtgttttttaccgtaaacggcagacgcatcccatcaggcacgttccttgtttcgatggcggacaagcgccaccaaaaagccatcgccaaaggcatcgcatgccaagttgcctacaatcaccaaaacgataatcgccgcgcccaaaagctcgttccagcgaaagacctcgccaaagaggagcgccgaccagcagggagcgagcacgacctcactcatgcaaaccaagttggccgcaaacgcgttggtgcgcgcaatccccttggcatacagcacgctcgcaaggccactgcaaaaaaggccatgcaccagcatgagcccccactcaaatggtctcacggagtctagggcgccggcaaaatagacaatcggcagcatcgagataccgcaggagatgagcgaggacaccatgggcgacgcatcggggcgagagttcaaaaagaaacacagcccaaaggtggcgcccgaaatgacggcaagcaggttgccgagcatgccctcggcactcaaatcgcctaaaaagaaaagtcccatacccgtaaaagcaaccaccacggaggcaatcttcgcaggcgagggcaacgtgcgagttgcgagcgattgatacacgataacgaaaatcatcgaagtgtactgcagaacgatcgcgttgccgaccgtcgtgagctggtttgcaaagttaaacgtggtgcccgttacgaagttacagacggccacaaggacaataagacgactgacgcggaggacgggcctgccgacgagcaggataaagagcgccataaatattgccgtgacggcaccgatcaaaagagctgactgcgaattggcacgaacgaggatgccgataaaactccacaagagcgccgtgccaaatagatacatcgccccgctcacgctattatcgggtggattgtcagatcgaatcacgaagcacctccagctagctttcggtaataaaaaacggcgaccgcaatgggtcgccgtttcccttgggggcagaatagaacgaaggagtctacgccagcacgccgaagaacgcgccgatgatgcccacgaccatggtggccacgatcagcaccatggggttgatcttcttggacagcagccagtagtacagccagaaggcgatcatgccgagcatgccgggcatgatgccgtccaggatgtcctggagggtctgggcgtcctcgcccgagccgatggccaccgggatgctggcccagaacatgtccttgcacatggcgcccacgaccatgacgcccacgatgcccacgcaggtcatgatcttctgcatgaggccggtcctctgggcctcgtccaggaagcccacgcccagctcgtagcccttgacggcgccccagacgcgcagcgcgaagccggggacgttgtagatgagcaggaaggcgatggggccgaaggggttgccggcctggcacaggctgatgcccaccgcggcggcgaccacgcgcagcgtcgacaggaagatggagtcgccgatgccggacagcgggcccatgagggcggccttgacgtcgttgacgctctcgggctcgatctcgccgcgggcgaccttctcctccatggccatcgcgatgccgccgacgaacggggcgaactggacggtgatgttgaagaacgcgcagtggcggtgcagggcctcggcgtagtcgtcggagcggccggcgtagatcttcttgagcatgttggcgaccatcaggcagaaggcgatgttcatctgcttgtagtaggtccaggagaactccatgcccagggcgccgacgttgacggcgctcttgacgaggtcggagcgcgtgatcttgttctcgggactagaagtcatcgtcctcatccccttccgcggagagctggggctgggctccgcccaggccgagcaggtcgaacttgtcgatgccgatgatgatggcgatcagggcgacgcccaggacgggcacgttggcgtaggagcacagcaggaagcccaggaagtagaagggcacgagctgcttggtgagcaccaggcggccgagcatggcgaagcccatggcaggcaggatgttggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgagcaccaggcggccgagcatggcgaagcccatggcaggcaggatgttggctgcaacgccaaagccagcaaggacaaagggcgggatgaagtcgagcatgccctggatggcgtcagcacccagatagaacgacagcgagcacagcaggaacgccatgatgataccggtcaaaccgatcaggaagtgcatcgcatagacacccttaaggttgccctgggcagagaaaacatcagcgcggtcgaccaggatcggcagggcggcgttaaggatgttcttgatggcaaggcacagcgtggcgatgggcatggcaagcgcgatggctgcctcggtgctctggcccagctggatagcgaaggcgcaggcgagcacgccgccgatcgtctcatcaggcggcacgtaggcgccgatggagatcgagcccatgaacagcagctccagactcgcaccgatcgcgaggccggactgcaggtcccccagcaccaggcccacgagcgggcacagggcgatggggcggaacgcatagagcgtaccgagctggcagtcgaacttaccaaatgcggcgataagtccgatgaggattgcttgggtaagcatatatccccctttcctaataggacactacgaagagctcagactcttcgaaattgaacgcctagagcacgctggcgcagtcgaccttggggtcgtcggccaggggtcgaatctcgacctcgacgccacgatccagcatctcgcgcacatcggcttcctcggccgcagtcaggaagatctgacgagagacctgacgagcatcgggacgcttctcgtcctttggcttggtgttgcccaggttgaccgacttgatctgcgggcagccctcaacaagctgctttgcctcagcaatagtggcgacacagatgatcatcttgtacttgtcggtcacgcccgagttgatagcttcgattgcatgctccatatctttgatgacgagcttgcagccggcaggcttgcccatcttgagcgtcgtcttccacaccgggtcgttagcaaccttatcgcccacgcagaagatgcagttggagccaaggccctgaacccaggaaactgcgacctggccatgaagcaggcgatggtcaacgcgaagtagctgaatcataatgtgaccccccaaaggtcttgtgccgtcttacggcgtgtcagtaggtgctgcggattagaactcttcttcctcgtcgccatcgaccaaaagatcgttgacaaacttcacgcgcgtatcgtccgcagcgacgatggcgcgaatcgtctcctcaaccggcgccgactcgtcagagaacagcagctggatgagcagaggaaggttcatgttggtaacgaggtacgtgcggggacgcgtctggacaatcttggtgaactcgttgttgacgctgccgccaaagaggtcggtgcagacaacgacatcatcgtcagcagacatgcctgccagcagtttttgggcctcctcggccacgtccatgcggccatcgacgaacatcgaaagatcgtggacgttgtcgcgagcgcccgagagcagctcgacgctctccttgatgccggtagcgaagtgcgcatggctggcgatgatgtactgtctcattctgtgttcctctcaatagcccggcacgttcccgcacccgttttctttagtagtcgaactggtgatagtagcgacgatacttgaggttgtgcttggtgaccgtctcgtagtagcgagccaggcggtcggtcacgagcaccgtcagaatccacggggagacgatgacgcggaactcatcgtcaaggccggggatcgcgaactcggcggtgtcgatgatgttgatgtcggtgtcgccggtcacgccgcggttgaggaaggcgcggacgcgctcgtcgagcttgcggttctcgtcctcgcccatgaacaggaagaccgggacgccgggctccacgagctcgagggtgccgtggaagaagtcggccgaggtgatgtagcgggtgcgcttccactgcatctcctccaggatgcacatcgagaacaggatcgtctcgccccacagggcgcccgagccgatgaacatggtgtagggggccagggcgtacttcttggcgagctcctcggcgcgcggctcgaagcgcttgcggatgtcgagcatgtccttccagatgtccttggtctgctcgataaacagatcaaacttggggaagcagccacggcggttgagcaggcgcaggccgaagcagtcggcgaggtagtagcccttctcgcagccgcccgaaccatggtcagaagccatggcgacgcagttctcggcacccacagcctggccgatggggccctcgggcttggtcatggcgtagacgcgcacgcccatgtccttcatcttcttgacggcctcgaggacctcgggggtggtgccggactcggaggcggtgagcacgacggacttctcggtcatgcgcttgtggcccatggcgttccactcggcggcgtggatcaggtagacctcgaggtcgcggtcgccgaacttgttcatgaggtactcgagctgcatgagctcgtcccaggtgccgccgacgcccatcaggaacacggcgtcgtagccctcgtcggcgaccttgtcggcgagcgcggtcatcttcttgccggtctcgtagagcgccttaccgtcctcgagatagccctcctggtcgaaatgcatgatctcgatcttctcggtttccttcatttgtctctcctttctggggttgtttccacatcccccatgccaacgggcatcaaaacccgcttacattccgtaacactcggccgctttggccttaagcgcattgactgactcttcgtagccctctgccttgacctccatttgcttggagacggcatcgagatacgggtgcacgtcccatgacttcagacgctcggcgatcattgccgcaatcgtctggaagaacacaagattgggaattgcgctgagcagcggagccacctgaggcaccgcaacctcgtgagccctacccctgggatgggccgtgagcagcaccgtttttgtcgtaacgttcgatagcgcatcggcgatattcgcaagacgctccgacccctgcggatcgtcaacgataaacaccagatagcccggaacgatctgcatctcgggaccgtgaacgaactcctcgccctcgtgatgcatggcaggaatcttgatggtctcgctcagcttgagcgccgcctcctcggcaacgccgtagttggggccgttgccgacgaccatggcgggcatgtgctcagaaagctcgagcatgtggtcttggacatattcctcggcggtcttgcacatcacggcattggcctggatagcttcgcgcaggtcgtcaagacgctgggcaacgcctttggcgtcaaccgttccgcgcgcctgaccgccgtaaataccaaagagcaccagatactcaacgagaacctcgacgcccagagttacaaagtccaccgactcgacgcccacaccgtagtcaagaacgatgtcagcgtgttccttgatgggtgcctcgacgtttgccgtgagcgcaactgcagccatatcgtgtgcgcgcatgtaatcgagcgccgcaatcgtattggtcgaatagccactctgcgagacggcgatgttgagcgcatgctgcggataggtgtgttcaaaatcgacgaaggcctcgggcgtcacaacggacacctgcatctgcagcgcatcttgcaggtaatcgcgggcgcaatcggcggcatggcgcgacgaacccgaagcaacgatgcgcagtgcgttaaaagaaccggactggaaaatatcaacgagctgcgctaccagctcagacgaacgctcgaggttctcccccatacgcacatgggcaagctgaacgtaatcgagcatcttcatcgtctcacctcgttacaaatcattagtatttgataccaatcacagttacaggttacggctttttgatacctctctgtcgattaatttatccccttcggcgaacggtcgattttgggccctgtaaggttgtatatacagctgacccaacgatcaaaactagttagtttcccaggcgttattcacaaaacaccagctagtacgtataggtatatccacccgcatcaccgcggttaaacgatttgacgtactcgatcgcttggccgcccgcatcgaagcttacgcactccagcgtcaaggcaagatcgccctgctccagtccaagcaggccggcatctcgcgcgcccagcgcttcgatatcgagcttttcctgtgccataactggctttcggcccagcatctcataggtctcgtacaaactgaagaccgacacgtcaatatcttcgatggttggaaacagcaggcacgggatgaacgccatctcaatcgatacagggtcgccgttgacgcagttcaaacgccgaatcgaatacagcaaatcatcctcggcgatgccaaacaggtcggcgtagtatggccccgcataacgcttggaacgcgcgagaatacggacggacggctcgccgcccgaagcacggaccgattcacggaaaccgcccgtgcgttcaaaaaaagcaggtactttctgcgccacaaaggcaccttttccccgaacacggcgaatctgcccgcgccgaaccagctcatcgacagcgcttcggatggtcaagcgtgtcgtaccaaattcctcggcgaggtctttttcggacggaatcatggaacccgtgggatatataccgcgctcgatacgctcctcgatgcggcgtcgaatgcgcatatagaccggggtggcatctactgtttcagccattgttcacctgccacgctcctcatgccgttctcttcgccgttatcggcaaagcggaactttgtgggcaaaatcaccgatttgcaatgctccacaaaacgcatgtccttatccaattcgatcgtgctctcatagaacaccggcgttccctcttcttgctggagcagctcggcctcttcggcgttcaaacgcgagatggagatatgctcacgtccatgctcaacacgcacgccaccttctttgagcaagacatcgtaaaggctctcgcactcaaaatcgtgctcgataagcgatgggcacagggacaggttaacgtgagccgtctcgattgacgccggctcgccctcaataagtcgaacgcgctgcatgcgaagcaaaggagcgcctacagacaccccaagcttgtcggcaagtgcctcatccgcctcgatggtcccggtggaaaccagacgagaagaggggtgcaggccggcagtccgcacagcatcggagaagttatacgtttcctggaagatgttcagcggcttgggagggcacacatacgtacccgatccgcgacggctctcgagcgttccacacgagatgagccgcgtgataccggcgcgcaacgccgtgcgcgaaacgccgatctcttcgcacagcacgcgctcggccggcaggcgatcgccgccggcaagctggtggtgctggatataccaaagaattccctcaacagcacgatctttggggggaattgcataagattcgcctgccattgcacagactcctcattcagaaacgtatgccgccaaaattagaccagccctcccatggcatcaaattcggccttgatcttctcggcaacattccgatacgacttatatagacttgaatcgcgtttgacttcgtcggtcataacgggaatctctaatttggaaacctcgtcttttcccgtctgaaccgccacaacaacgcccataccaagacacatattacgcttggcagcgtttattttcgccgccttggcaggatttgccaggatacgctgggcaaattcctgttttgagaccacttcctcggcctccggatcgcccgcctcggccacttcgcactgcaacacgtccgcatagtcaaaaatcttcggctcgccgccgcgctgatgcacggcccacttgcgacgcgtggcatcctggtagatagccggcaaaaacgtaaaccgcggcgggtccaaaatcgtatccgtgatggtaaacacatcgggatcaaaggcatcctgcgggtttttcttcttgaacagccccatatcagcctcccgtactagcattaaacaactcaagccgaatatagcaccaatttcaagctcatgctttagtagatcggtgcgcggcgtctatggctcgcccagcggaagagcttacggacgagggccggggcgcctgctttgttttgagaggtgggcttcgcgaacttctcaaaacaaagcaggcgccccggccccgccggcaaatagcggacgctccgcatgcaatctatgcaaacaaacaagtacgtttagctacattcggtaagttcgagcacgctgcccttaacgataagcgccggctccaggacgacctcttcggcacgcctgccgcccctaccggcaagacgcttggacatgcagccaaaagcatgctccgcaaggacaccaggatcctgctcaatcgcggtcagcgccggctcaaagagaacgtcggccgccgagttgtcatagctcaccaccgagatatcgcccgggatgctcttccccatctcgtgcaagcgcttgagcagaccgagggcgatgttatccgaacttgcgaacacagcggtggcatcagttgcgagcaccgcctccgaggcctcataggcactcggaatgtagtactcgctctcaaactccaaacgtgcgtcgataggcaggccaacctcgcgcagcgcgcgctcatagccggcaagtcgcttacgccccgtattggaacggcgcgcgttaaccaagcaggcaatgcgacggtggccctgctcgatcagatagcgagtggccatgtagccacccatctcgtggtcgaacatcaccttgtcgcactcgagcccctcaatggcacgatcgaccatcacggcagggataggcagatggctgacttcttcgcgcagggcgcggtcgtcggagaactcgtcgcctacgaccaggaagacgccatcaacgccgcgcgtcaccagctggcgcagcagctccagatcgtcatcggcgcttccgcccgagctggtaatgaagagcgcatagccgtcctcgcggcagcgcttttccaggctaccggcgagcgaggcaaaaaagcggctctcgatgttagggacgataaggcccagggtgcgcgactcgcgcatgaccaggctgcgcgcgatctggttgggaacatagtggttgcgcgccgcgacctctttgatgagcttgcggttttcttccgagatgcgacagggccgattattgagcacaagcgagaccgacgagggggaaagccccacctcctgggcgatctgcttgagggtgactttgttggccatctcgctccttccgggtttacgcgcaatctcttgaaagtatagcgactacccctctacctcgatgataaacactttaccaatccggtagacggctgttttatcgccgccagcgcaccaaatccgtccgggtggggtatattgcaatcgattgatgacaacgaccaccaaaaggcggatattcgtatgcacgagaacgacttttttaacgaggacctgctgtgcgcgcttgctggcgttgccggcgaggacaacgtactgatgagcgagcccatgcgcgagcacaccacgtttaagatcggcggcccggccgacgtctttgtcacgcccgataccgagcagggcctcgtcgccacgctcgatacctgctatcgctgcgatctgcccctcaccatcgtgggcaacggctccgacctactcgtcggcgacaagggtatccgcggcgtcgtcgtggcgttgggcgaaggcctctccgacattacgatcgacggcacgcacgtcacggcggcagccggcgcgctgctttccgatgtcgcagccgcggcagccgaggcctgcctcaccggcatggagcccatctcgggcatccccggatcggtcggcggcgcctgctacatgaacgccggtgcctacggtgcctgcatggccgatgtgctggagtccgtgcgcgtctacaaacccgctcgccagctcgacgacggcacccgcggcagcggcaatatcatcgagttcgatgtcgacgagctcaacctgggttatcgaaagagccgcatcgccgatgacggctttatcgtgctttcggccaccttcaatctcgccccgggcaacgccgcgatgatcaaggccgacatggacgactaccgccagcgccgcgaggacaagcagccgctcgacatgccgagtgccggctccactttcaagcgccccgagggttactttgccggcaaactcatcatggatgccggcctgcgaggacacgccgttggcggcgcgcaggtgagcgagaagcactgcggcttcatcgtcaacgccgaccacgccaccgccgccgatgtcgacgaactcatccgccacatccaggcaaccgtcaaagaccaattcaacgtagacctaaaacccgaagtccaccgagtaggcgaatttttataaaaagaaggccccgaaaggggccttcactttctttaattcagacaaccagtccggtgtgccgcgccccgaaggcttataggacaaaatgtgtgtcccgatagaacatccgtttccatccattaatccagccagaacgggtacgggtccctgtggtggaggtcctcccacacggccctgtcgccccactccggccctccgtcctcgcgcgacggcgaggcggagtagacgctgaacaggaagtcgatgtccgcgtcggtcggcatcgcggcgagcttctcgcgcgccgtcctcgcgtcccccgagtgcgcgtggcaccaccagaacaccgccttcacgcgcttgaccgacgtcagcccccggtggttgcgcaggacggccctcagctgcgagttcacccctccctcgatcatgttgttggtcgacggcagcgggccggccttggccagggcggggtcgaggtaggtgaacagcgtccccgccgacaccagcgacgacagcgacgagcgcgcccgcctcagcctctcgtgggtgtagaccctcctgccgtccaccacggtcctgtcctccaggaagtcggcccagaacccgcaccagtcgaggtagcgctcgacccagagctcggcctggtgcagcgtctcgatgcccatgaggtcgcgcgcgatgaggtagagctcgcgccccgcctggagcttcggccgcgtcgtcgtgtagcgcttgacctgcgagaaggcatggaaggtgcacctctggaccctggtgcgcggccaggtctcgcgcacggccttggcgaacccgctcccgccgtcggtgacgaccacgtcgggcgccgggatcggcgccatgagcgacagggcagtgtgggaggacctccaccacagggacccgtacccgttctggctggattaatggatggaaacggatgttctatcgggacacacattttgtcctataagccggggattcgaacccgagagggcacgggcgttaagcaaacgcgagagcgtttgtagcccgtgggcgaaaagccgtcaggctttgaagccggagggcatgcgtagcatgcccggacatccccagctctccgccagtttaactttaaagaagggtcccatttggggcccttttttaattagaagaatgttagctggggattcgaaccctcaaaaaagaggcatcctttcggacgcctcctttcagtggacttattattcttgcgccctacacctcgggtgccttggctacggtctcgctctctgccgcaagtgggcggttgtcgatgcggcggcccaggcggtcgagcttcacaaggagccactcaatgggattcggccccgagccttcctcgtcggcaaccaaatccacgacggcaatcttggtgccgtcctgcttgagcgtaacgctgcccaccttgtcgcccacatgcaccgtgcccgaaagatcgtcgtagctaaccttttcggtcacctcgccggcaagggaaaacacggtcgcttgcgccgtggggtcggcgagcgtggcgtcgatcgtcttgtccgtccaatctgtctggctaatgcgtgccataagcgggttgccgttggcggtcttttcctgcgtgttggcgatcgcgaccgtgaccttgtggccgtagtaccaattggcaagggttgcggtatcggtaaagcgctggtcggtggtggtggagttcaaaacgacggtgtagatctcgtcgccgtcgcggttgtaggcgctcgtaaagcaatagcccgcgtcgtcggtggtgccggtcttgccgccgatgttgccatcttggcccagcaaatagttatgcgtgtccatggaatgcgaatggtcggtgccgtcggcgcccgtgacctcgatccaggaatcctcgctcgctacgacctcgcggatcgtgtcgtttttcatggcctcctgcatcatcagcgccacgtcatgtgcggttgagtgcatatcgccagcccactcatcaaagtccagaccatgcgggttttcaaaaagcgtaccggtgcagccgagcttcttagcgcgctcgttcatggccttcacaaatgtggcctcggcgtctttggtcttagggtcgattttcttgcccacatattcggcgagcacgatggcggcgtcgttgcccgagggaatcatcaggccgcgcagtgcctgctccacggtaagctcgtcgccttcgagcaagccggcggtcgaattacccacggtggctgcggcgttgctcaccgtgaccttctcgtccatcttgcaattctcgacggttaggattgcggtcatgaccttggtgatcgaggcaatcttgacctgctcatcggcgccgcgcccatagtagacggtgccgtctttgcccatgacgagggcattggtcgcatcgatatcgggcaggttttcggccgtgatgccgcgcgcatcggcggttttgccgcaaacattgtcggtcgtgagcacttgggcgccggcgacggtgggcgcgccagcggcaagggcgatagcgcagacaaagccggcggcaagctgggctgagcgctttgcaaaagaggtgagggacttcacagatttcgctttcgacgggatggtctcttctgaaactagagtatatcgtttgccggcgtcggcgatcatcgcgtgcgcgcttggcccacatccgcacccgaacgggcacaagggtgcttaaggccgacttaatcacccacgcttgttgtgtgtggcgtgcgtcgcctcaggcataatggagcgcgagaggagcacgcatgaacgagcgcattttggtagttgatgacgagaaggccatcgccgacttggttggcatctaccttacaaaagagggctttgatgtccagattgcctatagcggggccgatgctgccaaggcgattttggagcaggagttcgatctggcgctgcttgatgtcatgctgcccgatatcgatggctttgagctgctgcgtacgatccgttccagccatacctatcccgtgatcatgctgacggcgcgcgatgcccagcaagacaagatcgagggcctttcgcttggcgcggacgattacgtggttaagccgttccgcccgctggagctcatcgcgcgcgtgcacgctcagcttcgtcgctacaccagctacggtagccgtgcacaggcggccgagtcgccgaccatccagttcgacggcctcgagatcaaccgtgacgctcgctccgtgacggtggacggtgcgccggtgcgcctcacgcccatcgagtattccatcttgctgtatctggtcgagcatcgcggcagtgtggtggccgtggaggatctgttccgcgcggtgtggaacgaggattttatgcccggctccaacaatacggtgatggtgcatattcgccacttgcgtgaaaagatcggcgacgacgcacaaaagccacgctttatcaaaaacgtctggggcgtcggctacatcatcgaataacgcttttcgcttgtgaggatcttgatatgacaaaagacgataggcaagcgttcgaggtgcccgatcggctctttgaatacgtgaggtcggtcgtcgacaaccgcgcgcttgcaacggtgctgctctttttgctgagcctgctgctgattggcatcgacaacatcgtcggaatcttggcggtgctgcttgtcggctttttgctgatcgatcgatttgagatcgtgtgccgctgcgtggtgattggcggcgccgcgtgggccatgacgttggcgattggcgccatggcgctcggcggcatcgaagggccggtgctgttcgatgccggctttgtattcaacatgcttggctttgtgctggcgcttgcagcgtgcgtgctgttcttgtgtggccgcgccctgtactaccagggctacgagcagggcgagcagcatgccgattgtgtgctggccgctcgtattcaagatcgcctgatcgatcaccccgacacctgggataacatcgacggcgacttcttggaggtcgagggcgcccttaaccgcgtgcgtgaccgtgagcgcaaggtgcagcaagctctgcgtgacgagtcgcatcgcaaggacgatttggtcacgtacttggcacatgacctacgcaccccgcttgccagtgtggtgggctatctttcgctgctgcaagaggctcccgagctgccggttgagcaacgtgcgcactttacgggcgtggcgctcgacaaggcgcaccggctcgatacgctcatcgaagagttcttcgatatcacgcgttttgacttccacgatatcgtgctcacgcgcggctatgttgatctggggttgctgctggctcaggtgactgacgagttctatcccatcctcaacgagcagcataaggaagtccaagttgatattcgcgaggacctgacggtgctcgtggatggcgacaaaatggctcgcgtgttcaacaacatcatgaaaaacgctattgcctatagctatgagggctcgaccatcacgatcgaggccagacgccgggacggcggtggcgtgcgcgtgcgctttatcaatcagggcgatcccatccctgcggctaagctcaaggtgatctttgagaagttctatcgcctggatgcggcgcgtgcgaccaatcgcggcggcgctggactggggcttgccatcgccaaggagatcgtatgcgcgcacggcggtaccgttgcatgtgaatcgacgcccgaacacacgatattcaccatcgagctgcccgccgcatagccagcgtgcccttacaaacacttgacaatgcgctcacgtgcatatgagccgcgattcctactatcgatactgctgaattgatatcgatgtggaggtatgcggtatgacggctgctgcggctgtggagcccacggagcttgaagaactcatgaaagcgcaggccgaggccgcgcacgagcgcgaggttggggatgcgactcgccccacggcagaggatcttgccgcctcgccgacgcgaatcgatgttgagggcctcgacctgttctatggcgaccaccatgcgctcaaggacgtgaatatcaagatccgcgacaagcagattacctcgttcatcgggccttcgggctgcggaaagtccacgttgctgcgctgctttaaccgcatgaacgacggcatcaaggactgccgaatcgagggcaagattgcgctcgatggtcaagatatcctgggcgactacgacatctgccgccttcgccagcgcgtgggcatggtgttccagcgccccaacccgtttcccatgagcatctacgacaacgtcgcctatgggccgcgcggtatgggtgtgcgcgatcgcgtcgtgctcgacgagctggtcgaagactccctgcgacgcgccgccctgtgggacgaggccaaggacaagctcaaagagtcgggtctgggtctttcgggcggccagcagcagcgcctgtgcatcgcccgcgcacttgccgtgcagcccgacattctgctgatggacgagccgacctcggcactcgatcccgtatcgacgctggtggtggagcagctggcctgcgagctcaaagagacctgcacgctcgtggtcgttacgcacaatatgcagcaggcggcgcgtatctccgattcggtcgcattctttttgctgggtgagctggtggagcacgcgcccaccgcgcaactcttcaagaatccgaccgatccgcgcacggcggattatttgacggggcgttttggctgataccatctagtaaaggtacctttagggttaagatgcggtcatgccggccgcaaaggggttcaacatgatctattacgtcgaggacgatgacaacatcagggatttgacggtctatgcgctgcgcaagcaggggattgaggccgaaggcttttcgtgcgacggtgagtttaaggctgccgtggcgcgacgggtacccgatgccgtcctgctcgacatcatgctgcccgataccgatggcttggcgattatgcgtcgactgcgtgccgatcgcctgacggcgacggtgcccatcatgatgcttaccgccaaggataccgagctcgacaaggtgatggcgctcgatggcggtgccgacgattacctgactaagccgttttcgctcatggagctcgccagccgctgccgcgcactgctgcgtcgcggcggcatggtcaaacaggcaagcgatgtgctcagcgtgggcgacatcgtgctctcgcccagccatcgtgaggtgactgttgccggcgagtcgcttaagctcaccctgcgcgagttcgacctgctcgagtacctcatgcgcaagcccggcgtggtctttacccgcgagtcgttgctgcagagcgtgtggggctgggacttcgacggcggttcgcgcaccgttgacgtgcacgtgcagacgcttcgccaaaaactgggcgagcatgccagcgccatcgagaccgtgcgcggcgtgggctaccgcttggccgagccttctgccggtgatggtgccgaaggtgacgacaccgcggccaccgcatcggaggagtaacccgtggtcttcgccccccagggaaaacatacgctgtcgcaccgcgtttttgtgacgatctttgtctgcgccatggcggttatcgtggcgtttacggtgctgggtgcgttctttgtgcaaaacaccttggcggatgccacgagtgccaacctggcgcaagaaaccgagctcattgctgccgccctcgacgagcagcaggagcccatcccgttcttgcgtagcctcgatcgagaggacttgcgcatcacgctgattaacaaggatggatcggttgcctacgacaacgaggcgccgccttccacactgcccaaccatggcgatcgccccgaggtcatcgaggcctttgagagtggttcgggttccgcggagcgcgcaagctctacgctcgacgagattatgctgtatcgcgccgtcgcccttgataacggccaggttgtccgcttggcgcaggcccagcctggcgttgcggcgattttgctgtcgatggtggcgccgatgctgcttatcgcagcagcgggtgcggtactctcgttttttatggcgcgccgcgagtcccgtgccatcatcgcgcctttgcaagaggtggatttggaccacccacgccgtagctatgagcacgcctatgccgagatggtccccatgcttgagcgtattgagtcgcagcgccaggagctcaagcgccaaatggcggtgctggcggacaacgaccgtatgcgccgcgagttcacggcgaatatcacccatgagctcaagacgccgcttacggcgatttcgggctatgccgagctcatcgcaaacggcatggtcgagggcgagggcgacctgcgcaactttggcggtcgcatctatcgtgaggcgggccgcttggcagcgcttgtcaacgatatccttacgctgtctaacttggacgaggccgagcgtgcagctgagggcgaggcggtgcccattgggtccacggagcctattgagctctcgcgtgccatctacgcggtcgagcagcgtcttgaacaggtcgcccgtcaggcgaatgtgacgataagtcatgagaccaagcctgtggtcatcgagggcgtgtcgcgcttgattgacgagctcatctataatctggcaagcaacgccatccgctacaatcgacccggcggtacggttacgctgcagtgcggcaccaacgacgaaggccatccgttccttgcggtcgccgacacgggaatcggtatcgcgcctgaagaacagggcaaggtatttgagcggttctatcgcgtggacaagagtaggtccaaggcacgcggcggaaccggtctggggcttgccattgtcaagcatgcggccctgtatcatcacgccacgctcgatctgtcgagcgagttgggcgtgggaaccaccattacggtgacgtttcccatacagcaggacgagccattcgcatagcgatataacatagatattgatgcagacgccgcatttgactttcgggtgcggcgttgttgtgcaattttacgattgcttccgacatttttacaggagagcctgtttcttatgtatagagtttggtctcggtaaaaagatgcgataacatacggacagttttgtcaatccgaactggggaaatgaaaggcaagctgcatgacccttctcgaactgttccagctgctgaagaagcaccttcagctggtcatcacccttccggtggtctgcgcgatcgccatgggcatcgtgtccttcgttgcgatggacaacacctataccgcgacgacgagcatgtacattctcgccaagaccgacgatagcggtcagatgagctacaacgatctctcggcgagtcagatgctttccaacgatatcgccacgctgctggatagcgatagcgttaagagcggcgcagccaatgaactgggcctcaccgatctggatgactacaaggtgtctgtttcctccgagaccaccacgcgtgtcattacgctttcggttaccggcaccgatgccaaggagacggctaaggtcgcaaaggccatggccagctcggtgagtacggtcgctcagaacgtcggcgctgcccagagcatcaacgttatcgacgaggctaagacccccgaagcccccagcggtcccaagcgtatgctgtacgttgctgtcgcgttcctcgccggtatctttatcgcagtcgcctatgtcgttttggcagacatgctcaatacccgcatccgcggtgccgaagaggcagaagagctcctgggcattcccgttgttggccgaattccggctatgaaaggtggtaaataggcatggctaaggcaaagaacaccgataagctcgttgtacagaatgccgccaagacccttctggccaacatccgctttgcgagcgtggacgaccccattcgcactattaccgtcacgtcctcgattcccaacgagggcaagtctacggtttccatcaaccttgcccaggctatcgccacgagcggcaagtccgtgctcctggtcgaggctgatatgcgccgcaggtccctttccgatatgctcggcgttcgttcgcgcggcggactctatgcggtcctttccgagcagatctccattgaccaggcaattgtcgagacgggtcagaagaacttctacttcctcgatgccgagccgcatattcccaatcctgccgacatcattgtctctcaccgctttgccaagttggtaaaggcactgtccgccaagttccagtacgtcatctttgatgctcccccggtcggcaccttcatcgatgctgccgagattgccagcctgaccgacggtacgctgttcgtggtgcgcgaggacttcaccaagcgcgaggaggcactcaacgctatcggccagcttaagaagtccgaaaaggtcaagctcatcggtaccgttatgaactactgcgagaccgagaccagcgagtactactactcctactacaccaaggacggtaagaaggtgaagaagggctcggacgatcaggggacttccaaaaagggcatcttcaccaaccgagcaaacgtttagttgattaaggctgacctatgcgtgacattcattgccatatcttgccgggtgtagacgacggcgccgccgatctcgatgagagcttggcgatgctcgaggctgccaagcgggccggtgtaaccagaatcgtttgcactcctcactgccgtgatccctattttgattacgacaagatgtgggatgcctttgaactgctgcgtgataacgctgacggttttccgctccagatgggcttcgaggtcaaccatcgaaagctcgttgaacttggtatcgatgccgcggagcacttgcatttcgatggaaccaacgagtttctgctcgagctttcgacgcatgccgatgcgtatgcgtttagagagtacgagaacacgatttacgatttgcagtgccgtggctaccaggtgatcatcgctcatcctgagcgctatcgtgcggttcaaaaggatgtaagcgtggcggagcgcctggtcgatatgggctgcaagctgcaggcttcggcggactttattgccggcggtcgctttggtcgcgaaaaaaagccggcacagcgcctgttcgatcagaacctgtacagcttcatcgcgagcgatgcccataacgtgggtcattacgactgcctggcgaaggctcgcgcgaagtttagcgtgcgcggagctcattttcgctaatatctgtccctaacgttcgcattgaatgaaagggcagccatggatatccaacttaagacgggatgctttgatgacgcggcgttggtgcgccgcgtcgtttttatggacgagcagggctacgagaatgagttcgacgctatcgacgaggatcagaactgcattcatgtgacgctctatgtagacggcgagcttgccggttgctcgcgcgtgtttcccgaggagcttgagcgcgtggctgacgcagaggccccggtgttgccggcatgcgacatggacgaaggcgttgcggcgggggaggcctacattatggggcgcgtcgccgtgctgccggctatgcgtcgtcgcggactggcgagtgcgatcgtcgaggccagtgcttcgtgtgcacgcgatgccggcgctaagcttattaagctgcatgcgcaggaatacgtgttgccgctctatgcaaaggcgggctacacgcaaattgccccggtagattacgaagacgagggccagccccatgtctggatggccaagcgcgtagatggcagatagggacgttccttttctgccggcagctggggacactccttggcaattgacgcattggagcgctcggacatacagtttttcgattccgtatgtatatatgcgcgctattgggttataaaatctaagtctgaacatagcaggtctgcgatgcggctcgggcaaccgggccgtttttgcggacgggggtagcgcgaaaggactgcacatgcgtcaatttaagaccgagagcaaaaaactgctcgacctcatgatcaactccatctacaccaataaggaaatcttcctgcgtgagcttatctctaacgcgagcgacgccgtcgacaagctcaactttaagagcctgcaggatccgagcgtcaagatcaaccagggcgacctggccattcgcgtctcctttgataaagacgcccgcaccattaccatctcggataacggcattggcatgaccgccgaggagctcgagcgcaatctgggcaccatcgcccattccggctccgaggagtttaagaccgagaacgccgagcagcagggctccgatgtcgacatcatcggccagtttggcgtgggcttctactcggcttttatggtcgccagccatgtgaaggtcgtcagccgcgcctacggcgaggatgtcgcccatgtgtgggaatccgacggtcttgagggctacaccatcgaggacggcgagcgtgccgagcacggtaccgatgtcatcctgacgctgcgcgagaacgagaagctcgatgccgacggcgaggccgagacctacgatcgcttcctgaccgagtggggcctcaagagcctaattcagcagtacagtaactatgtgcgttacccgatccagatgatggtgtccaagagccgccagaagcccaagcccgaggatgctggcgatgactacacgcccgagtacgaggactaccaggagctcgagaccgtcaactccatgacgccgatctggaagaagcacagctccgatgtcgagcagaaggactacgacgagttctacaagtccacgttccacgactttgacgatcctgcgcgcaccatcagcttccatgccgagggcacgctcgagtacgatgccctgctgtttgtgccgggccgcgcgccgttcgatctgtacagcaaggattacgagaagggtctggcactctacagctccaacgtcctgatcatggagaagtgcgacgacctgctgcccgactactacaactttgtccgcggcgtcgtggattccgccgatgtgtcgctcaacatctcgcgtgagacgctgcagcagaaccgtcagctcaaggccatcgccaagcgtgtggaaaagaagatcaccgccgaccttgaggatatgcgtgacaacgaccgcgaggcctacgagaagttctttgagaactttggccgcggtcttaagtacggcatctactcgagctatggcatgaaggccgatgagctcgccgatctgttgctgttctggtctgccaaggaacagaagatgattaccctggccgagtatgccaagggcatgcccgaggatcagaaggccatctactacgccgccggcgactcgcgtgagcgcttggccaagatgcccgtggtaaagggcgtgctcgaccgcggctatgacgtgctgctgctgacgcaggacgtggatgagttcaccttccaggctatgcgtgagtacgttgccgctgatatgcccaagatctacgaggacgatgccgcccgcgaggctgccgagaaggccgtggccgatggtgccgagcccgaggttgaggatcgtcacctggagctcaagaacgtcgcaaccggtgatcttgacctggcgaccgaggacgagaaaaaggaggccgaggacgccaccaaggagaacgaggacctctttaacgccatgaaggaggcactcggcgacaaggtcgagaaggttgccgtctctgcgcgcctgaccgatgcccccgcgtgcatcaccaccgagggcccgctttcgctcgagatggagaaggtgctccagaagggtcccgagggcgcgcccgacggtatgcccaagagccagcgcgtgctcgagctcaacgccaagcacccggtcttttccaagctcgtcgccgctcagaaggcgggcgacgccgacaagatcaagcagtactccggtttgctctatgaccaggccctgctggtcgagggcattctgcccgaggaccccgttgccttcgcagcagctgtttgcaacttgatgtagttaggtatttacgcggttttaccaaaccgcgtaacggctcgacgctgccctcagttccgccgttctaacgaacggcggaccagtcgacgctgcgcgggcgccagagcgacaacttgtcattcaaagaggacggcatgaccagaaggtctatgccgtcctcttttcatgccaatttgttcgctctggcgcccgctcgctggcattgccaaaacatcgacgttgccgtggtcctaagtagtcattggggacgtttttgtttgactagtcgtttaagaacgtccccgatgactatttgaattgctaatttgtgcgggttgtggttttgtgacctgctgaaatttaggatactgtacatctgtacgttaactcatcttcgtagtatattgctacccgcaaaactcaacaccattgtgctttgagacgttaaagcgcctactacaatggttgtcgatagtacgattcgatttaacgacaggatggatggtccaagcgtgagtctcggcagcaaactatccaatgcaaaggtgtcctttgcgatatttaagcgcgacattaagcgactgcttgtgaaccccgtcgccctggtggttaccctaggcgtgtgcgttattccctcgctgtatgcctggtataacatcgtggcaaactgggatccgtatggaaacacccaaggcatcaagattgctatcgccaacaacgatcgaggcacccaaaacgacttggtgggtgagctcaacgctggcgacaaagtggtcgaccagctcaaggagaatcatcagttgggctggacgttcgtcgactcgacggccgatgccaaggagggcgtcgagagcggcgagtactatgccgctatcgtgattcccaagaacttctcggataacctggtttcgatgctcgacggcaactaccatcagcccaagctcacgtactacgtcaatgagaagaagagcgccattgcgcccaaggttaccgataccggtgcaaacaccatcgaggagcagatcaactcggaatttgtctctacggtaggcaagactgttgccggtatcgccaaggatgccggtgtcgatttaaaggacaaggcaacccagactcaggactcgctggcaagttcggtgtccgaggcgtccgacaccttgggcgaggtgcgcgattcgattggcgatatgaatgccgccatcgataagacgagcggcgctatcgcctcggctgatgcggcacttgccggcttgcaaggccaggcaccgtcgctgacgcaggcgatctcccagggcaacgacctgctgagcgaagctcgcaccacggcgggcaactccatcacctcgctctccaaggcgctctcggaaggcagccttgcgctcaccaagacgtcggcctctgcgaacgctgccatcggcaagctgacgggcgcggtcacatctacgaccacccgtatcgacaactcgctcgagtctcttcaagcgacgatcgaccacaataaggccgttatcgggcacttggagattctcgccaatgacacgtcgacaggttccgaggaaattgacgcgcgcattgtatcgaccatcgatttgcttcgagagcagaatgaaaagcttcagagcatcaaggacggtctgtccgcgcagtcgagcgccatggcgaatgacgcagcggctgtttcgggtgccagtgacgctatcaataacgcaattcataccggtgcgaccaaccttggccaagcccagacggacttgggccaaaacgcgctgccgaaggcctcgagcgcgctcgactcttttgctgccgtttcgggcgacctgaccggtatcgtctcgggtatgacacctacacttgcaaatgcgcgcggcacgctggcgcagctcgacgccacgctcaagcaggcaaagaccacgctgtcccaaaccgacgcctcccttgccaaggttcaggacaagctcgcgaccgccgccaatgacattgcggcgctacagacctctgagtctatgggcgagttagccgacctcatggacgtcgacgtcgatgacgtggcagatttcatggcatctccggttgagctgacgtccaagtcaatctatccagtcaagagctttggctcgggcatcgctcccttctacaccaatctggcgctgtgggtaggcggctatgtgctcatcgctatctacaagctcgaggtcgaccgcgagggcatcggtagctttacggcgcgtcagggctactttggccgctggctgctgatggtgatcctgggtgcgttccaggccatcatcgttacggtgggcgatttggtgattggcgtgcagtgcgtcaacccgctgctgttcgtgctgggcggcatcgctatctcgttcacctacgtcaacatcatctatgcgctgtccaccacctttaagcatatcggtaaagccattggcgtcatcctcgtcattgtgcagatccccggctcgtcgggcatgtatcccatcgagatgatgcccggcttcttccaatggctgcatccgctgctgcccttcacctatggcatcaacctgctgcgcgagaccgtcggcggcatgtactcgttcaactacctgttcaacctgtgcatcctgggcgtgttcttgatcgtggcgctctttatcggtctgcagctgcgcccgttgctgctcaacctcaatctgctctttgataagcagctttccacgacgggcctcatgatctgcgagtccaacgacctgccgcgccagcgctattcgctgcgcacggccatgcgcgtcatgctcgattcggattcgtaccgtcgcgagctgctcgatcatgccgtggcgtttgagcatcgctacccgtactacatcaagggcggttttgctgccgtggtaggcgtgcaggtcctgctctttgtgctctcgacggtgctcgatatcgacaataacggcaagatcatcctgctcgttatctggatcatttcggttatcgccatctgtggctggctcatcaacatcgagtatatccgtgcgagcctcaatacccagatgcgtatctcggcgctttcggacgaggaccttcgccgtgagatgcgcgagcacacggccgccatccctgctgcccgtcgcatgtttggtctcaacgccagcgagcggggcaccaaggacagcgaacagcccacgagccgtctgccgcatatcggtgtgcatcgtaaggctcaagatgccgacgacgttgacaacgtaagcggaaacgacggggacaccaccccgcttggcaagcactctaaaggaggtgaggcataaatgaaaaacatcctgcacctgtttaagcgcgatgtccaaaacgtgtctcgctccgtgatcggcttggttgttgtgatgggcctgatcatcgtgccatgcctgtacgcgtggtttaacatcgccggaagctgggatccctacggcaataccggcaaccttaagattgcagtggtcaacaccgatgagggctacgagagcgatctgattcccgtcgaggtcaacgtgggcgaaaacgtaaccgccaccctgcgcggcaacgagaacttcgattgggtcgtcctcaacgaccgtgataaggcgattgagggcgttaagtcgggcgcgtactacgctgccgttgttatccctaaaagttttagcgcagacatgatgacgctcttctcgaccgacgtgaagcacgccgatatcgagttctatgagaaccagaaggccaacgccatcgcacagatcgtgaccgagaagggctcgagcgccgtccagagccaggtcaacgagacctttaccaagaccatcacgtccatcggccttaagacggtgtccagcctgctcgattacatgagcaccgaccaagtgagcaactttatcgccaatctgtcctctacgctgggcgattcggtcgaggacctgcaggacgttcaggcgagcgcgacgtcgctcgcgggcattttgagctctacgtccgattcgctgacatcggcgggcggcatgctcgagcagacgggcaccgttgatgagtcgacgaagcagctgatggagcacgccaagagcggcatcaatgattccaaggaagcgctcaaggccgccaacgatgccgttgacgcggcgattgacggaagcgcgggctcgttcgacaacgtgtccgccgagcttgcgaaggcattcgatgccgcgaatcagcatgttgaccttacggtgtctcagctcaacgaagccgcagcggcgctcaatacgcgtgctgacgatatcgatgcgatggccgatcggctccgcaaccttgccgaccagatgagcgatgacaagctcaaagacggcctcaagtccgctgcgacgtcgctgggcagaattgccgtggagtaccgcaacaatgcgaaggatctgacggcgaccgcaaagtccctttcggacagcatggcggaggtcaacaactcgcgtgccgaggtcgaccaggccatcgccgatgccaaggcgggtatctcgggagccaagtccgactacgattctacgttctcggttaaggccaaggaactcaagaagaccatttcgggcgttctggattccctgaacggtatctcgggtgacttggatagcgccgtgagcggtctgaccgacgcctctggttcgctcgcgaagggtctctccaaggctgcaaagctggtcaacaaggcttccgatcagctgggcgaggcgtcgaacaagatcagtgcctttaaggacgagcttgatagcgctctgatctcgggtgacctggccatgattaagacaatgatcggcaacgaccccgagggcctcgccgtgtcgctttccggccctgtcgcactcgatcgcaagccggtctatccgatccgcaactacggctcggctatggcgccgttctacacgattctgtcgctatgggtcggctcgatcgtactggcggccatgatgaaggtttcggttgacgatgagcttatcaacgagctcatccccgtgcgcctgcacgagatctacctgggtcgctacctgttctttggcggtctggctctgctgcaggcaacgctcgtgtgcgcgggcgacattctgttctttggcatccagtgcgacaatcccctgcagtttgtgctggcgggctgggtcgcgagtctagtgttctccaatatcgtctacacgcttacggtatcgtttggagatatcggcaaggccctcgccgtcgtgctgctggtcatgcaggtcggcggttcgggcggtacgttccccatcgagatgaccggccccgtgttccaggcgatctacccgttcctgccgtttactcacggcatcaacgccatgcacgccgccatggccggtgcctaccatatggagtactggattgagctgggtatcttggcgagctacctgattccgtcgctggccctgggcgtcgtcttccgccgtccggttatcaaagctaacgactggatcatcgaaaagctggagagtactaaattaatctagcgcaacaatgtaaacgctgatgctgcggcaatgtcagcgagcgagccgcatttgcgccaaggtgacgtgaaatgaaagggcgctgaccttctggtcgcgcccttgaaattgaacgtcagattggtgtgaatgcggctcgcgcagcgtcggccggtccgccgttcggtagaacggcggaacaaaacgctttagtgggctggattgcacgggttgcttggttgttgctacagtagcggggcgtgccgggggtccggcgcgtcccgtttttatttgaccatgaggcggcacgcagccttacgcgtgcggacaccacgcccagtttgagtgtgaggatgttccatggcccaatacgctgccaacgaaatcgaaaacttgcccgatagccctgttgctcgcgaggacctaggcgcgggcggcacctcccgcggcgccggcgctcgctcgccgctgttctggaaagttctgctgctttcggtggcgattatctggggctactcctttaccactatgaaggatgcgctcgacaccattccggtgttcgagctgctctatgtacgctttctgcccgcagcgttggtcatgtttgccgtcttccacaagcgcatcattgcacatttcaacgctcgcaacctgatcgttggcctgagtatgggcgtgctcatgtgggcggcctatgcgttgcagacggtcggtctggcacatactacggcgggcaagaatgcttttttgacgggcacgtactgcatccttgtgccgttcgcgagctattttctgagcggcgaaaaactcacccgctataacctgggcgcggcactgctgtgcttggcgggcattggtttggtggcgctcgatagcgttgaattcaacatcggtgacgtcattacgctggcgggtgcggtctttttcgccatccagatggcggtgactgccaagtacggtcgcaaaatggacatcaacgtcatcacgttttggatgtttgtgggcaacggcgtgctgagcctggcaacgtcgctgctattcgagacccaagcgcctctgtccgtgtggacgccgagctttatcactgcgatggcgtttctctcggtgggctgcacatgcgtggctctgctcatccaaaacgtcggcctggcgcatgtcccggcctcgacgggctcgctgctcctttcgatggagtcgccttcgggtgtgctgttctcggtgctgctgatgggggaggcgctcacctcgcgcctgctcgccggcttcgcgctcatcttcctgtcgattatcttgagcgagactcacttcgattttttgcgtcgaaagccgcgcccgcaattgtaaacaacttgttgcgccgccctcccggggcggcattttttatgcctcgcccttaaagtagtaccttgcactttatgctatcaaagtgcttgctgcaaaaacgatactggagggcatctatggcaccagctttgtccgatcttcaaccgcaatcagcgcccaaggccaccgcagcggcgcagaccgctatcggtgacggtcttgttgcagaagctcaggcttttgcagacgagctcgctgcgtggcgacacgatctacaccagatgcccgagctgggtaatagcctcccacagacctctgcgtatatccaagcgcgcctgaccgagatggacatcccgtttgccacgctcgtcgatggttcctgcgttgtgggccttgtcggcgccggtgccgccgcggcccagggtaatggcgtctgcacgaatgagcaggccggtacggtcatcatgctccgtggcgacatggacgccctgcccgttgccgaggaatccggcgagccctttgcatccaccaacggctgcatgcacgcttgcggtcacgatatgcacgcgacggcgctgcttggtgcggctcgtatgctcaaagcgcgcgaggcagagcttgttgatgccaacgccacggttaagttgctgttccagccgggcgaggaaacctttgagggtgcccgcgccgccatcgccgacggtctgctgcagaacccgcgtcctcaggtcgcctttgccatgcatgtcaatagccagtcgccgcttggtttggtgctctacggcagcccggcgctctcgggcgtgtacggttttcgcatcacgcttcaaggcaagggcggccatggctcgagccccgagatttgcatcgaccccatcacggccggcgtgcatgtgcatctggcacttcaggagctcatctcccgcgaggtgccggcggccaaggaagtcgcacttaccgttggtaagtttgccggcggcttggcggccaacgtcatccccgacacctgcgtgcttgagggaacgctgcgcggctttgatgttgagctcatggagcacctaaagacccgcatcgcggaggtcgttaacggcgttgccgcaacatatcgtacgccggcgaccatcgagacgctttcggatgttccgccgcttgtactcgacagcgatatgactcaggcgtcgcttggctacgtgggcgcagtgctgcccaaggtggctttcttgccgcttttccatgccatggcgagtgaggactttgcgcttatctcgagcgagattccgagtgcgtactttaccgtgggcgcggccgtaaccgacacggacgaacactttgcccagcaccatcccaaggcacgttttaacgatgccgagcttcctctcggcgccgcggcctataccgccgtcgctttgggctatatcgccgaccaccggtagcacccaaccttgcctttcaagcctgcgggcatggccgtaaggcctatgcccttgtctttcaaggcaatcttgggcactaccggcgcccggcgccggctattcgtttgttaaataaggagcagtatgtcccagcagcgtaagttcttccccggctggctcgttgtgacctccggcttcgtgatcatggccacgtgctacacgattttcgtcaactgcatgagcctgttccagccgctgatcgtcagcgacctgggcatttcccttgcgcagtacaacatctccaatgccatctccaccgtggtgagtgtcgtgggttcgctcgttatcggccatgttgccgataaggtgagtggccgcgtattgggctcgcttaccgttatcgccacctcgacggtgctcgcgggcatgagctttgtgggtgagctttggcaggtctatgtgctctttgccgtctcgggctcctttgcgagcacctggatcgtgtgcctggcgtgctccgtggtcatgctcgtgttcctgctggcatccgagcccatcgccgccaagctgcgcgcgagcgtggcgggggagtaggtaggccaaagcgcatcgccgcttgtccgcttcgtccgcggcggcgcgtctggccgaacgagtccccataccctcgttcggtcaggcgcgccgccgcgttgctgctttgtgccgtataatgtccactacctatgacgcgatacaaaagaaaggtgtttgcccatgcaggcacagaaggcggagggaacccgcgaccttatcggcgccgagatgcgcgcctggcaaaagatgcagcagattgcggccggcgtgttcgagccgtttggttttaaacccatcgagacgcccgcgatcgagcaggttgacgtgtttgtccacggtatcggccagtcgaccgacgtcgtgcgcaaggaaatgttccgcgtgttcagcggtgccaacctggagcgcgtctttaccgagggcaccgacaccaaactcaagcccaagcagcgcctggcacttcgccccgagggcacggccggcgtggtgcgcgccgtcgtcgagaacaatctggtgccccagggctccacgccgtttaaggcttactacgccgaggccatgttccgcggcgagcgtccccagaagggccgcctgcgccagttccaccaggtgggcatcgagtggctcggcgctcccgatccggcggcagacgccgagtgcatcatcatgctcatggagttctacaagcgcctgggcttcgatctttccaagcttcgtctgctcatcaactcgatgggtgacgcccagtgccgtccggcttaccgcgagcaggtcaagcagttcatcctcgatcacgcagacgagatgtgtgacgagtgccgcgagcgcgccgagctcaacccgctgcgtgccttcgactgcaagaacgaccactgccgcgagatcatggccgaggctccgctgatgggtgacaacctgtgcgatgagtgccgcgagcactacgagcaggtcaagcgctatctggatgccgccggtatcgagtatgtcgaggatcccaccttggtgcgcggcctggactactacacccgtactgtctttgaggtcgaggcccctggcgccggcgtcggctccatcggcggcggcggccgctacgatggcctggtcgagctcgagggtggcaagcccacggcgggcgtcggctttgctgtcggttttgagcgcgccctgctggccctgcaggcctttggcagcgatttgggtgccgatgaggccccgtgcgtctatgtcgccaacgccggcaaggagctgcgtcagaacgtctttgccattacgcaggagcttcgcgccgcaggtatcgtgaccgaggccgactatcagggtcgttcgctcaaggcccagtttaagcaagccgataaggtaggcgccaagctcatcttggtcctgggtggcgacgagcttgccgccggcaaggtcaaagtgcgcgacatgcagagccatgacgaggtgctcgccgatctggacaacgtcgtcgaggcggttcgcgagcgcctgtagcgcatctttttgagcttcgggcctgctaacgtgccctgctcatggagagcgattgttacgggggtgtttcgcttttatgcggaatgcccccgtttacgtatgccgcccaccgagaaatacgaccatttagggcaaaaacctttgcaatgcagaaaatacttttgtgtggtaaagcgcaatcagtgtcgaaagtatttctcaagcgcctataatgaataccgcatgttacgtgcatagaaggaggaatgggaggaaacgtggctgagaacctaagcaaccagtctgtacccgaagccgcggcgcgcgtcgctgccgtggtcaaccgcctcgttaaccgaatcggctcgaatgccgagtccagggagcgtctcgccgagatcgagatccccgaggagctgcgcgacaatctggcgctgttcttgcgcctggagcgccgtgtgcttagcgagtatgatcccgagatcgcggacctgttcgacaagattttgacagccgagattgtggtcaatgccggcaaccccggtacctgcgctgccgacgaagccgtcgacgagcagggcgtgcccaccgccgacgagcccactgccgtggcatttcgtgaggtcgtcgatttgatcgacagcctgccgctcgataagcagcaggtcatcgttcgcgcctttacgagctttttccatctggcaaacctgtcggaggagaactaccgtgtggcgcagctgcgcgagcgcgaggccggtgcgtcgaccgataccgaggtcgatcctgccaacgagcttaccgttgcctatcaccagctggtgaatgagctgggtgtcgagggtgccaacgagctgctcgacaagctcgagttccaccctgtctttaccgcacatcccaccgaggcccgtcgtaaggccgtcgagggcaagatccgccgtatctccaacctgctggaggagcgtccgcgtctgggcggctccgacctggtggagaacgagcgccatatgctgcaggagatcgacgccctggtgcgtacgagccccatcgcgctcaagaagcccacgccggtcgaggaagccgataccatcatcgacatcttcgataacacgctgttcgacgttatccccgttatctatcgtcgttttgacgattgggtgctgggcgacaaggccggtactgtgccgccgctgtgcccggcgttcttccatcccggcagctggatcggttccgaccgcgacggtaaccccaacgtcaccgccaaggtgagccgtgaggtcgccgccaagtactttacgcacatggtgctcaagctcgaggacaagtgccgccacatcggccgcaacctcacgctcgaggccacctacagcaagccgtcggccgagctcattaacctgtggaaccatcaggtcgagatgagccctcggtacacggcccgcgccgagctgatctccgagcacgagccgcatcgcgccgtcatgctcgtcatggccgaccgtctgaacgccaccgtgcgccgtatcaccgacaccatgtaccacagcgccgacgagttcctggatgacctgcgcgtcgtccagcgttcgctggccgcctgcggtgccgtccgtgccgcctacggcccggtccagaccatcatctggcaagtcgagtccttcggcttccatatggtcgagatggagttccgtcagcactccgtggtgcatgcccgcgccctcaaggatatccacgagaacggtatccatggcgacctgcagcccatgacgcgcgaagtcatcgataccttccgtgctatcggctccatccaaaagcgctacggcaagaagatggcgcaccgctacatcatctcgtttaccaagagcgcccagcatgtggccgacgtctttgagcttgcccatctgtcctttgcgcacgaggaggatgtccccgagctcgacgtgattccgctgttcgagcagctcgaggacctcgagggctgcgtcgacgtgctcgaccagatgcttacgctccccgtggtgcagaagcgccttgcccagaccaaccgccgcatggaggtcatgctgggctattccgactcctccaaggatgccggtcctaccacggccatgctcgcgctgcactccgcgcaggagcgcattgccaagtgggccgagaagaacgatatcgacttggtgctcatgcacggtcgcggcggtgccgtgggccgtggcggcggcccggccaacaaggccgtgctggctcagcccaagggttcggtcaactgcttctttaagctcaccgagcagggcgaggtcatctttgcccgttacggcaaccgcacgctggctcagcgccatgttgagtccgttgccgccgcaacgcttttgcagtcggccccgagtgtcgagaagaccaacaccgagaccacgcagaagttctgggatatggccgagaagctcaacgccgcaagccacgagcgctatctggacctgctgaacaccgaggactttacaccgtggttctcgaccgtgacgccgctgaccgaggtcggtctgctgccgatcggctcgcgtcccgccaagcgcggcttgggtgcaaagtcgctcgacgacctgcgtaccattccgtggatcttcagctggagccaggcgcgcatcaatctggctgcttggtacggcctgggtaccgcctgcgagcagtttggcgatctggaccagcttaaggctgcctaccaggagtggccgttcttccgcacctttatcgacaacatcgagatgtcgatcgccaagaccgaccagcgcatcgccaagatgtatctgcacctgggcgatcgccaggatctgtccgagaaggtcttcaccgagatgcagctcacgcgtaagtgggtccttgccatcgtcggtgacgaatggccgctgcagcgccgccgcgtgctcggctgcgccgttcgcgtgcgtaacccctacgtcgacgctctgtccatcgcccaggtccgcgcccttcgcgaggtgcgcatgaatcaggacgagatggccgaggagaagaaggccgagtacatgagcctgattctttcgactgtgaccggcgtctcggcaggtctgcagaacacggggtaatcgatagccctgtagtcattgtccggggccgccgtttgttttctttccggcgcgtcctcggacatgcaagaagccctcgctgcgcacttcgtgcggcgagggcttcttgcgtcctgcggaatgcgccggaaagaaaacaaacggcggcccctacgatgtccggtcttcggtggattacttgctggggaaataaaggcgcgcttcgcgcgtttggaaagggcttcgtgctgcggaatgcattcagggggaaacccatcgggttccttcgtcctcggttttcagggattaaagctgatgaaaataaagtgcgcttcgcgcctaatgtggagtgcggcgagggcttcttgcgtcctgtggagtgtgcctaaaagtaaacctatggcgggccctgcgatgtccgacctttggcgaatcagccgctgggtgagggtggtgcttggggcgacgtgcaaaaaacggagttttcagcagccaaagattgatgcataaggccatagccggctttcgctacctttgttgatgcttttgcacgacaattgggccttggcgatgcccgtatatggctggtttctcgccgcatgctatccagatgggacgagtcatgaggactatctaccttttgaaagacttttgacaccaaaatcttatcccgcgatgctgaatactcgcaaaaatgcacgctccggagggtactaccctgttacggctagaaatccatgcgccattttatgcaattagttgacgtatttatacaagatgacttacgcgcgcatgccatcggggtgaacgttcgtctcggcattgcgttgaccatcctgcccatagtgtcttttacaggcggctgcggttccgtttgggatcgcggccgttttgttgtgggtcaaatatgaacgttgtgttaatgactcggtggacggtggtgtttttcggtgagcggcgtatccttccaacggtttatctagtgtgtcagttgaaaggaagagggcgctcgtcattgtttgaatgtgaactaccgtttgaccacaagacgttgcatctagagctcgaggataagaacttcgtgggtgtgatggaaggtcatcaaaacgagtttaagactacaaaatcgcaggaagagctggtagaagagtcgcttgccaacccttacggctcaccttcgctcgaggagctttgtgctggcaagaaggatattgtcattattagctccgatcatacgcgtcccgtcccctcgcgtgtgacgatgcctattctgctgcatcacatccattccgctgcgcccgaggctcgcgtgcgcattctggttgctacgggtatgcaccgtccgtcgacgcacgaggagctcgtcaacaagtacggcgaggagatcgttgccaacgaggaaatcgttatgcacgtcgcgactgacgacagcatgatgaaaaagatcggcaccctgccttctggcggcgagtgcatcatcaacaagattgcggccgattgcgatctgctgcttgccgagggctttattgagccgcacttctttgctggcttctctggcagccgcaagtccgtgctgcccggcattgccagctataagaccatcatgtacaaccataacggtcagtttgtgaacgattcccattcgcgtgccggcaacctgtgccacaaccacgtgagcgaggacatgtttgccgctgccgagatggctcaccttgcctttgtgcttaacgtggtgctcaacggcaagcacgaggtcatcggctcctttgccggcgatatccacaaggcgcacgaggctggctgcgagttcgtgaagagccttgccggcgttgagcccgttgagtgcgagattgccatcaccaccaacggcggctacccgctcgaccagaacatctaccaggccgtgaagggcatgtgctctgccgaggccacgcttcccgagggcggcgtgattattgatgtcgccggttgcgccgacggtcacggtggcgaaggcttctatcacaacatcgccgacaacgatccggcggagtttgagcgcgcctgcatcgaccgtcctaaggacgagaccctgcccgaccagtggacgagccagattttcgcccgcatcctggcgcatcaccctgtgattatggtcaccgacctgtgcgatcaccagatgctcaaggatatgcacatgacgccggtcaacactatcgaggaggcgctcaagctcgcctttgagatgaagggtgccgatgccaaggttgccgtcattcccgatggcctgggcgttgtcgtcgcgcagcactagtgcacggcccaaacgaatcgtttataaccgacaagaaagataaggttttatgcttaccaaactcctctgcgaattcggcgcaacggccctcatgatcatctttggcgtgggcgtacactgcgataccgtgcttaagggcaccaagtatcagggctccggccacatgtttgccatcaccacctggtcttttggcatctcggtcgctctgtttatctttggcggcgccgtgtgcatgaaccccgccatggtgcttgcccagtgcatcgtaggcctggtgccgtggagcagctgcattcccttcatgattgccgatatgctcggcggctttgcgggcgccgtgattgcgtggttgatgtatgccgatgagttcaaggcttccgatggcgtcgtcgaccccattgcccagcgcaacatcttctcgaccaaccccaccaccgagggtacgaactacgcccgtaacttcttctgcgaggctatctgcacctttgtgttcatcagcgccatcctcgctgccgctagccgcgccggcgagaacgttctgatgctcgccatctgcgtcggcctgatcgtttgggccgttggcatgggcatgggcggcatcaccggcttcgccatgaaccaggctcgcgaccttggtcctcgcatggcctatcaggtgctgccgatcaagaacaaggctgacaacaactggaagtacggcctgctcgttcctggcatcgctccgtttgtcggtgccgctctggctgcactgtttgtgcacggtttcttgggcatgttctagtccaaggctacatagttgtccgctgtccgcatggggtaacttcccagcgcgtcctcggacatgaaagaacccccgctgcgcacttcgtgcggcgggggttctttcgtcctgcggaatgcgctgggaagttaccccatgcggacagctgcgggatcttagtcgcgttggaacaagcaacccgacatatatatctgaatttggatgggaggggcttgttgctggtaggggcgttgaagtgcgagtgacgctttgggatgcgtggcggcctgggttggggcgatgctttgggatgaggttcttacttagttgaagaggggttttatggctgagaggtagtctttggctacgtcctcttttggggcttggaagttgtgccaggcccaccattggaccattcctacgaagcttgaggctatgtggtgtagtaggaagcttcggtccatggtggcggcggggccgtttgggtcggtagggacggtttcggctgcgcgcgacatgatggtcttgcggaggcagtcggcgaagacgcgtgagccggcgccggctacgagggctcgaacgccctggcggcgctcccagaggttgttgaggatatgctcgacctgtacgagcgggtcatcgaggggcgtaccgtcatcgtcgagggcatgggtgcagatgtcgcgcacgagctcagcgagcaggtcatctttgctcttgaagaggccgtagaacgtggcccgacccacatgggcgcgagcaatgatgtcgccgacggtgatcttgccgtagtcctcctcgcgaaggagctcggaaaacgccgcaacgatggcggcacggctttttgccttgcgggcatccatggttatgcgtccgcgtcaacgagcaggcagcggagcgtaccggagcaaccctcgtaggggcgcttaccggcgccgtagccgacggcctcgatgcggtagcgggccggcaggtgctcggacgtgcgcagcgcggcgacgatggcggcgcccgtgggcgtcacgagctcgccggcgaccggtgcaggcgtgagggcgatattgcccgcctgacacaggttgacgacagcggggacgggaatgggcatgaggccgtgggcgcagcggatggtgccgtggccctcggagagcgactcgactacgatgtcctcaatacccaggtcgtcgaggcagatggcgacagagcagacgtcgacgatggagtcgacggcgcccacctcgtggaacatgacggtgtcgggcgttttgccgtgagcctttgcctcggcagcggcgagtgcggaaaaaatggcgagggcgcgacgcttggcgccatcgcttagctgtgaaccgtcgatgatggcggtgacgtccgccaaagagcggtggtgatggtggtgggcgtgatgatggccctcgtggccatggccgtgggcctcatgctcatgcgtgtgctcgtgttcgtgctcgtcatggtcatgatgatggtgttcgtgctcatgtgcgtgctcggcagctgcttcgttgccgtagagccaggccatgtcgtggtcgtggttctcgagcccctctgccaactgaacgtcaaagtcgcaggcgtcgatgccatgcttgtttacgcgcgttacagcgatcgaaaagccgtcgaccggcagcgtggcgagctgttcgcgcaggtgctcctcgctggcgcccaggtcgagcagggccgcgacggtcatatcgccgctgatgcccgaagtgccgtcgatgataagcgtgtgctgatggttggacatggaatgctccttaacgggcgcaggatgtgccggcgctcagatgattgataagacttgcctggtaggcggcaccaaagccgttatcgatattgacgaccgatacgccgctggcgcaggagttgagcatggcgagcagcgcggctacgcctccaaaatttgcgccgtagcccacgctggtgggaacggcgatgaccggacagctcaccagaccgccgataacgctcgccagggcgccctccatgccggcgatggcgatgaccacctgcgcctgggcaagttcctcggcatgcgcgagcaggcggtgcaggcctgcgacacctacgtcgtagaggcggtcgacctcgttgccatagaattcggccgtcaacgcggcttcctcggcgacgggcaggtcgctcgtaccggcgcaggcgacaacgatgcgtccgttgccggtaggggagggcttgccgcccacgagggcgagctgtgcgtctgggacatatcccaggtcgatgccgttgccgaggagcttcgaggcgcgggctgccttttcggcgtccaggcgcgtgaccaggatgcgcacctggccggcattgagtaatgctttgataatggcggcaatctgctcggcggttttaccggcgccgtagacaacctcgccggctccctggcgcaccccgcgcgaaagatcgagctgcgcaaaacccagatcggcggttggcgccgtctggaggcgcgtgagggcgactgccggggtgactactccgtcggcaacatcgctcagcaattgctcaagatctcgcttatccatatatgttcccttcgacggcgcaaagtctagcactcaaagggtatgtttccgaacactaagacaaaattgttcggaaactataggacagactgattctcttgttagaaagatcgactagtcgcgcaggatgatgtccatggcgagcatcaggttgcgctcatcgatggcaaacggggcggcttcgcgcgtcttgggcttggcgcaaaacgcgatgcccgtgcccgcggcctgaatcatggggatgtcgttggcgccgtcaccgatcgcgacggtgtgggccatgtcgacaccgcactcaaccgcccaatccagcagctggatgagcttggactccttggtcacaatgtctgccgccagcttgccggtgagcttgccgtccacgacttccagacggttggccaggcaaaaatcgatgcccgcggcggccacgatcttgtcagcgacctcgtgaaagccgccgcttaccacgccgaccttccagcctttgctgtgcgccgagcgcacaagctccagcgcgccgggggtaaacgtcacgcgctcaaaggtgcgctcgaacacactctcgtccaagccggcaagcagccccacgcgctcctcgagcgcctgcttaaagtccagctcgccgcgcatagcgcgctcggtgatttgcgcaacttgctcgcccacgccggcctcctcgcccaacaggtcgatgacctcctggttgatgagcgtggagtcgatatccataacaatgaggcgtgcagtcatgacgggcctttccaagtgctgttttattggggcatattgtcgcacgtgaatagcgcgggcgggtgccgcggtgcgtcaattgtttcgtctccgtcaagtctttgggcaagagctactttttcgtggtacatcgacgcgggtgcgataagatagaacgccatgtccggctgcgcggtttacgcaggctgggcaaatctgtacgacgccgcccggaacgacacggggcggcacagatccataaaggaggatcactggtatgagccagacccgtcccatcgatgagcattccatgcacacccgtacctgcggcgagcttcgcttcgagaacgtgggcgaagaggtcaccctcaccggttgggtgagccgtcgccgcgaccacggcggccttatcttctgcgaccttcgcgaccgcgagggcatcacgcagctcaccttcgaccccgagcactccgatggcgatgcctttaagatcgccgagaccatgcgtcccgagtggcccatcaagatccacggcgtcgtgcgcgcccgtggcgaggagaccaccaacaccaagctcgcgaccggcgagatcgaggtcctgaccgaccacgccgaggtgctcaacacgtccgtcaccccgccgttccagatcgaggacggcatcgagacgagcgaggacacccgcctgcgctatcgctatctggacctccgtcgtcccgagatgatggccaacctcaagctgcgctccgactttacctttgccattcgcgaggcgctgcacaaccgtgagttcatggaggtcgagacgccctccctgttcaagtccacgcccgagggcgctcgcgacttcatcgttcccagccgtattcagccgggtaacttctacgccctgccgcagtccccgcagctcctgaagcagctgctcatggtcggtggcgtcgagcgctactaccaggttgccaagtgcttccgcgacgaggacctgcgcgccgaccgtcagcccgagttcacccaggtcgatatcgagatgtccttcgtggaccagaacgatgtcatgagcgcgctcgaggaggttcttgccgatgccttcggtcgcatgggtgtcgagatgcccacgccgctgcgtcgcatgaactactgggaggccatggacacctatggctccgacaagcccgatacccgctacggcatgcacctggtcgacctgaccgacatctttgccaactccaagttcaaggtcttcgcgaccgctgcgaacgaggagggctctgtcgtcaaggccatcaacgccaagggcgccggtgcctgggcgcgtgccaagatcgataagctcgccggcgtggcctccacgtttggcgccaagggcctggcctggatcgccttccgcgaggacggttccatcaacagccccatcgtcaagttcttctcggacgaggagatggcggctctgcgcgagcgcatggacgtcgagcccggcgaccttgtgatgttcgccgccggcccgcgcctgctttctgatgagatcctgggcggtatgcgttcgcacatggccaatgcgctcgagatcaagcgcgagggtcacgacttcctgtgggtcgtcaacttcccgctgttccattgggacgaggatcgcaaggcctatgctgccgagcatcagccctttaccctgccgaccgagaccgacatcgccaagatcgaggccgatccgctggcagccggttcgtgcacctacgactttgtcatggacggctttgaggccggcggcggcggtatgcgtatccacaacgccgagatgcagatgtccatgctcaagctcctgggctttaccgaggagcgcgccgagtctcagtttggcttcctcatggaggccctcaagtttggtgcgcccccgatgggcggtttcgctctgggtctggaccgcgcgtgcatgctgctcaccggttccgactccatccgcgatgtcatggcgttccccaagacggccagtggctccgaccttatgtcgggtgctccgagtgccgtttccggcgcccagctcaaggacgtcagcctgcgcttgatgtaggcgagcggctacatattgcccgcaacgagggaaggacgcgtgccttccctcgttttttatacgccgagattgtgagggcatggggtgaccgggcgtcgcggaaagtgcgtcccggaatctgggtccagaacgggtcgcgctttcccaaagggggtcctctgggaaagcgcgacccagaatttggcaaaataatggggcacagtttccggttgagctgtctaacggaaactgtgccccagaatgagcgctcaaaacggggcaggctttccgcaacaactgtctggcggaaagcctgccccaatatcttatagcgagtctctctggattagctgcatgtgcatcacggaggtggtgggctcggcacccttgatcatatcgagcgcaatgttggcggccatgtggccttcttcgcgcaggggctggcggacggtcgtgagcgcggggacgcagcgcgtcgcaatctcgtgatcgtcgaagccgacgacagaaacgtccgccggaacggataggcctgcctcgttgagtgcggtgatgacgccagccgcgatacggtccgatccgcagagcacgccatcgaaagcaatctcgcgcgcgagaatctggtgcatggcctgatagccgtctccgctgttccagccggtatagataacgtttgcgtctgggaggtcttcgcacaagacggcgcggtagccgcgcaggcggtcgacaacagcgaggttgtcttgcggtcccaacacggcgacgatatccttacgcccgcgctctttcatagcgagcgctgcaaagcgtccgccctcttcgtcgtcagagtagaccgtcgagaacacatcgcgatagggatgaccctcgagctggccgcacaacacggtgggtacgcccagctcgcgcagcacctcgagcagctcgctgcccttgtagggggagacatcgatcacggcgtcgaacgagcggcgctcaaagtgctcgcgtgcgcggttgcgctcatgcgtagaagacgcctgcaagataacgggcagataggacgactccgacagctcctcggtaatgccgctcaaaaactcgctataggtggggtcgctgaagagttcactcaggggctcggtcacgagcacggcgatgatttccgtgcgcccgacagcgagcgctcggccacgagcgttggggacaaaattgacttccttggccgccgcgcggacgcgctttttggtttcctcgctaatgcggggcgaatcgttgagggcgcgcgatgccgtggagcgcgacacgccggcagctgcggcaacctcggcaagcgtaggtgcggtgcgaactggttgggtcatggcgtctcctggaaaatgcggtcgatgttgtcactgatacgggctagtgcggatacagcttactatagtgcgcctgaacagcgttcatgatatccggtgaccggtgtcgttttgcaaccaagccgaaatcgaatacgtctcgtgtgggtgagatattagcgggcgtggcggttgcctacgagcttgagaacgatgtcttgcgccgagtttcgatactcagggtgacataagtgccgcggttgtacaaccggttgcaccgttaacccggtcaaatcgaccgttcagcggacaaccggttgcacagctttttgcatcgcccgtaagataaggacaaccggttgcacaagaatcactacgatgacgaaggagcatcaccatggacgccattaacgattgggaaaaccaagcgctcacccacaggaaccgcctggcaccccatgcgtactttatgggctacgagaccgccgatctcgctgcaacgtacagccgtgagctgtcgcgcgggtttgtccagctgtccggctcgtggcagttccgcctctttgagggccccgctgccgtctccaacgaggaactctccacgtacaagcccgagtgggatcacgtggaggttccgcacctgtggcaggtggacggctatggcaaccttgcctacaccgacgagggtttcccgttcccggtggaccagccgttcgttccctccgacgaccccacgggcgtctaccagcgcatcgtcaaccttcccgccgttcctgccggcgctcgcgagatcattcgctttgacggcatcgagagctatggcgagctgtacgtcaacggccagtttatcggcatgaccaagggctcgcgcctgtccgccgagttcgacgtgaccgacgcgctcgtcgagggtgacaacctgtttgcggtcaaggttctgcagtacagcgatggtagctacatcgaggaccaggatatgtggtgggcctcgggcatcttccgcgatgtgtaccttatgcagcgccccgccgcgcacctggtcgactttaggttccgcacgcaccgcgagggcgataccgctctgattacgctcgatacggtggccgaggacgctacccgcgtcgtgtatacgctcagcgatggcgagaacgtggtggctacgggtgagtgcatcgacggccatgccgagtgcagcgtgaccgatgcccacttctggaaccccgaggaccccttcctctatgaccttacgtttgaggtctacgacggtgacgaggtcagcgagtacgttccgcatcgccagggtcttgccgaggtgacggtcgagggcaatcatatctacctcaacggcacttactttaagatgcatggcgtcaaccgccacgatcacgacgatcacaagggccgcgccgtgggcctcgatcgcatgcgccgcgacctggagctcatgaagcagcacaacatcaacgcggtgcgcacgtcccactacgccaacgacccgcgcttctacgagctgtgcgatgagtatggcatcatgctggtcgccgagaccgatatggagagccacggcttcgagaatatcggcaatatcgccctggtcaccgacgacccggcatgggagccggcctacgtcgaccgtattgagcgcctggtgatgcaggagcgcaaccacgcctgcatcattatgtggtcgatgggcaacgagagcggctatggctgcaacatccgtgcaatgtatgccaaggctcacgagctcgatggtcgtccggtccattacgaggaggaccgcaacgccgataccgttgatgtcatttccacgatgtactcccgtgtttcgcagatgaacgactttggcgagcatccgttccccaagccgcgcatcaactgcgagtacggtcactccatgggcaacggtcccgggggcctgtccgagtaccaggaggtctttgatcgctgggattgcatccagggccagtttatttgggaatggtgcgaccacggtctggctgctgtgaccgaggacggcgttgcctacgacatgtatggcggcgacaacggcgactaccccaacaacagcaacttctgcatcgacggcatggtgttcccctggcagcagccgagcccgggccttaccgagtacggccaggtcatctgcccggttcgtatggcctacgatgccgaggcaggcgagctgaccgtcaccaacaagcgttggtttaccaccctcgaggatgtctgcctgtcggcggagaccctggtggacggcgacgtggtctgccgcaagacgctcatgcccggtgcggttgcccccggcgagtccgtccagcttccgctggtgattcgcgaggccgcagtgggcgagaccctgctgaccgtgcacgcctacaccatggcggctcacgcctggtgcgagccgatgttccaactgggtgcaagccagtttgccatcgcaaaccatccggcgccggcaattgccgcccccactcgtcctgagcttacggtcgaggagaccgagcaggagattcgtattcgctccctcaacggcgagctgaccttcagcaaggtcaacggtaccgtgagcgagtggaaggcatccggtcgcgacgtcatgacctccggtccccaggttggtttttggcatccgctcgtcgataaccacgcccaggagtacgactccctgtggaaggataacttcatcgatgtgatgcagacgtctacccgcaatgtttcttggaagcgggatgacaatgcggttgtcgttaccgtgagccagcgtatcgctcctcccgtccgcgcgttcggcatgcgcgtcgagctcgtctataccgtgcttccgagtggccgcgtcgacctcaaggtttccggcgagccctacggcgactattcggacattatcccgcgcatcggcatctccttcgaggttcccggttgtgatcgtgccgtcgagtggtatggccacggcccgggcgagaactatccggactcgctgcgcgccaacccggtcggtcattaccgcactacggtcgacgacatgttcacgccctacgttatgccccaggactgcgccaaccgcgagggtacccgctgggtcgccctgcgctccagccacggtgacggtctggtcgtgacgcgtccgagcgacgccgcttccaatccgttctcgttctccgcatggccctatagctgcgaggctatcgataatgccaagcatgtctacgatcttgtcccggacgacacggttacggtcaacatcaacgaccagctgctcggccttggctcgaactcttggggttccgaggtgctcgattcctatcgcacccgttttgagagcttcagctttgaggtgtccctgcgaccgctgacgtctgccgatctggctcaggcgctggcacccattaaggaggcataagtcatgcatatctttaactcgcgtgccgatttcgacgcccagatgaagtccgtcaagaagtggatgcgtaccggtcaggcactcgacggcgtttctgaactgcagcacgatgtggcgtactctatcggcgactcgctggtgtattggtgggtgaacgcccacgaggcggctactgccgatctggtcggtcaccgtcgctaccatgccgtgctcgccccgctcgacggcaatctgaccgttgaggtggcttccaaggccgatcttacctgtacgcgcgcctacagcgatatcgatgatcgcgagcgctttgagggtacgggggagaccgtgacgattcccaccggcggcgttgccgtcgtcgaaattgacgaggcctaccgtgtcgtggccgatgccgcggatccccgcgtcgtggtactgcacgtgacagtcgaaggttattccttccccaacaagtagtattcgtccgcctggacgtttgcttcgcgccgttaagggggatggctttgttgactcccttttccccattccccttagcaggtgcgccgtccgtgtttgcacttgcagctcggacggttttagatgacatttaacagatgattgggagggcttatgagctctgaaaaacgaggaacgattggttcgttcgctctgctgggcatgacggtcgccgccgtgttcggtatcaagaacatcatcaacaacaacgcggccatcggcttggcagctgcgccgtcgttcttcttcgccacgcttttgtactttgtcccctataccctggttaccgccgagttcgtcggcctcaacaaggactccgagtctggcgtgtacgcatgggttaagacctcgatgggtggtcgctgggcgttcctgacggcatttagctactggttcgttaacctgttcttctttgcgtccgtcctgcccaacgtcatcatctacgcgagctacgtgttctttggtgccaacgccgagctttcgcagctgtggatcaccattatcgagatcgtcgtctttgctatcgccacgtgggtttcgaccaagggcgctaagtggatcggctccatttcctccttcggttcgaccgcggctctcggcctgaccgccgtgttcatcctactgtccctggctgctgcctttggcggcgttgagttcgctacggctcctactcccgctaacatggctcccgacatgagcaacttcgcaactgcgtggggcttcttcggtacgcttgcctggatcatccagggcgttggcggcgctgagtctgtcggcgtgttccttaacgaccttaagggtggcgtcaaggccttcgtgcgcaccgtcgttatcgccggcctgaccatcggccttctgtatgcaggcgcttcgctgctggttaacctgttcatccccgagggcggcgttgccatctccaccggtatcttcgacgtattcggcgctgtctttgcccactttggcattcccatggaagtgtctacgcgcgccatcggcttgatccttctcgccgccacgctgggctccctcatgatgtggacctccgctcccatcaaggtcttcttcaccgagatccccaagggcgtctttggtagcaaaatcgtcgagctcaacgagcacggcattcctgcccgcgctgcctggctgcagttcgccatcgtcgtccccatcctgatcattccggccctgggctccggtaacctcgacgacctgctcatgatcgtcaccaacatgactgctgccaccgctctgctcccaccgctgctgattttgcttgcctactttatgctgcgcaagaactttgacgccgctccccgtggcttccgcatgggttcgcgcagctttggcctggtcgttgccgcattcctgcttgtggtcttctgcttcgtgcttatctgcggcaccattccgctcgatcagccgctgtggctgacgctggtctacaacgttggcggcgtggttgtcttcttgggccttgccgtgatgtggtacaaccgctacatcaaccgcctgcgcgagaccgatcccgaggccgccgagaacgagcttcgcccttccgtcctcgatatgatggagtagcggctaggattaatctgcggctgtggaataaatcgattccctttcctaaggaggggccttacgaggcccctccttttgtgttttggggcatggttttggcccccgtggtcaaaaaatgccaaatatgagtactgttgcaaaagaagtgccatatttttcggcctgctctgagcgaaaatgggctcaaaatcgatttatctaactccctttaaagggcgtttgacggctttcaacctcttcgaatcgctcaagctaggcaatttgctctcgattttgctgctactaaatttgtgacagtactcatatttgccactttttgaccacggggtatccggaggggccctcgataaacatctaacgctacaataactaccacgtggctgggtttgccggccgaatgtgtgatgtcgtgggaggggacatggtcgagtttacaaagacgattaaagatccgttgggactacacgcccgcccggttgcgctgctctatgacatcattgccaagcaccgtagcgacgtgtcggtcagcatcggcgaccgccataccgacggtcgcgatgtcatgggcctcatggctctctacggcgagtgcggcgaggacatcatctttcgcgtttcgggcgtagacgaggcttcctgcgttacgtcgatcagaaacctctcgctctaagcatgacaaggcgcggcaaaggacagctctttgccgcgcctttttgtttcgtataggaaactttttcgaaatctgaatggggaccctttccaaaaagttaaccacgtgttagtttactaaagcaaacataggcgtggttaacttttaccgcgtcgatgttgaggacgaactgacgttaggagccactcatgtcttgcggaccgcagatgccggcaatgccgctttcgatggtaaaagcgggcgaaaccgtgcgcgtgtctcgtgtaaagggcaatgaggatatgaagcaccacctcaaggacctcggctttgtcgagggcagcgaaattcacgtggtgagctcgagtggcgccaatatcatcgtcacggtgctgggcgcacgctttggtatcgattccaaggttgccatgcacatcatgaccgtcggttagtccgcagcatttcataaaaaccgaaagggggacaagaggatgaagacgttgggtgacgttaaggtgggcgagagctccaccatcgtcaagcttcacggtgagggtgcgcttcgccgccaccttatggacctggggctcatcaagggcacttcgttcaaggtcgtgaaggttgcaccgctcggtgatccggtcgagatcaacgtgcgcggctacgagctttccatccgcaaggaggaggctgccgtcgtcgaggttcagtaagggctcgcggcgcatatatctgcagataaagttaggtttttctaacttaatgcagcaactttaaagcacattatccagcctgcgcggagaaagcagcgcaggcacacaaggaagaaggattgaatggcggattctcagatccatgtcgcgctggcgggtaaccccaactgcggcaagaccacgcttttcaacctgatcaccggcgccaacggctacgttggcaactggcccggcgtcacggttgagaaaaaggaggccaagctcctaagcgacaagaacgttaccatcacggacctccctggcatctactcgctttccccctacagccctgaggagcagtgctcgcgcgattacctcatgagcggcgagcccgatgtcgtcgtccaggtggtcgacgccaccaacctcgagcgtaacctgtacctggcgcttcaggttatcgagaccggcctgcccgtggtcgttgccctcaacatggccgacctggtcgagaagaacggcgataagatcgacacggacaagctctccaagaagctcggttgtccggtcatgatgatctcggcccttaagaacaagggcatcaaggagctgttcgagcaggtcaagaagtccgctgcttccaagggccaggtgccggagcacaagttcgattcctccatcgaggacgttctggaccacatcgagaacaatctgccggcgagcgttcccgccaacaagcgccgctactacgctgtcaagctgttcgagcgcgatgcggacgcctgcaagctcatcaacctcaccaaggagaagaccgctcgcgtcgaaggtctggtcgctcagtgcgagcaggactgcgacgatgacgccgagtccatcatcaccggcgagcgttacggcgtgattgcccacatcattgacgagtgcctcaccaaggctccggcaaagatgagcacctccgagaagatcgaccgcgtggttaccaaccgtatcctgggcctgccgatctttgtggtcatcatgttctgcgtgtactacatcgccgtttctaccttgggcggcacggtgaccgacttcaccaacgaccagctcttcggtaccgacggttggtacgtgctcggtcagggccgcgacgcctacgacgcggccgtcgaggctgcgggcgacaatgccgactcggtcgacccggcacagtacggcccctatgttcctggtattaccaccatggtccacgacgcccttgtggcgggcggcaccgaggacggtggcctggtcgattcgctcgtctgtgacggcatcgtcggcggcctgggcgccatcttcggctttgtcccgcagatgttcctgctgttcgtgatgctgtccttcctggaggactgcggctatatggcccgcgtcgccttcatcatggaccgcgtgttccgtcgctttggcctgtccggtaagtccttcattcctatgctcgtgtcttcgggctgcggtgtccccggcgtcatggctaccaagaccatcgagaacgagaaggaccgccgtatgacggtcatgaccaccacgtttattccctgcggcgctaagctgccgatcatcgccctgctcatgggctccatcatcggcgattcttccaccaccgccgcgtggatcagcccgctcttctacttcctgggcgtctttgccgtcatcgcctcgggcctcatgctcaagaagaccaagctcttcgccggccgtccgaccccgtttgtcatggagcttcctgcctaccacttcccggcgatccgttcctgggcgctgcacgtgtgggagcgctgctgggcctttatcaagaaggccggcacggtcatctttgcgtccaccgtcgtcgtttggttcctctccaactttggtagctataacggttcctttggcttcctgcctgcgatggacggcatccccgaggagtttatggactactccgtgcttgccatgctgggcaacctggtcgcttggatcttcgccccgctcggctttagcacctggcaggccaccgcgctgactgtctctggcctcgtcgccaaggagaacgtcgtcgccaccgccggctcgctgctgtccgtcgccgacgcgggcgagaccgacccgagcctgtggaccgcgtttgccggcatgttccccaccatgggcgcttgcgttgccttcggcgccttcaacctgctgtgcgctccgtgctttgccgccattggcaccatccgcaaccagatggattccggcaagtggactgcgatcgccatcggttacgagtgcgccttcgcttgggtgatcggcctgttcatcaaccagttctacaacttgcttgttcttggacaatttggtatctggacgattgtggccattgtgctgctggttgcgatgctcttccagatcttccgccccatgcccaaacatgcatggaccgacgaggacgagaccaacactgcttccgccgcagtttccgcttaagtccgaataaggattagccccttttcacgagcccgggtgtcccagcgacactcgggctttttggtgggggagatgtggcgtttccgcagataaaaccgaccaaaataaacctgtccctttttggtaggtggaggatggggtaaagtaagtggtggttaactaggggaggcttgctatggcacctatcgatattgttgtactggctgttatcggcgttgcgtttgtcgcggtatgcgtgcgcatctaccgcaagggcacctgcgccgactgcgctcagggtggcgtttgcacggggcattgctccaacaaaaagacgtgcgccgcgctgaaaggcgtcgacaaaatcgccgaagacttgggccgcggtatcaagtaaggcccagacatctaagcgcctcgcgagcatccgttcgcggggcgtttttcacttttgtggggtgggctagagacgctgcatgcggtacccgacacccatgtgcgtctgaatcatcttggggtgagaggggtctgcctcgatcttcttgcgcagggtgcgcatgaacacgcgcaggctcgccagatcgctgtcccagctcgtgccccatatctcgcgggtgatgaaggtgtgggtgagcaccttgtcgacgtttttcgccagaaggacgagcaatttgtactcggttggggtgagcgagagctcgcgtccgtctttcgttgcgtatcccgcggcgtagtcgatatgcagcggaccgttgtcgaacgtgctcgcttctgtcgactcgctcgacgccatcgaggagcgcctcaaattcgcacggacgcgcgcgagcaactcatccacagaaaagggcttggtgaggtagtcgtctgcccctgcgtcaagtgctgcaatcttgtcggaatcttcggtgcgcgccgaaatgacgataatggggactgccgaccagcttcggatcttcgtgatgacctcgataccgtcaatgtcgggaaggccgaggtcgagcatgatgaggctggggccgtgcgacaccgcatccatgatggcggcctggccgttgcaaaccttgctcacgacatagccgtggaggtcaagcgcggtcgaaacgaggttttgaacggtcaggtcatcttcgaccaggaggatgcgtggcttagcggcattattcatgaatctcaatctcctcggcgggcagggtaaaacggaagacggccccatgggggtggttgtcgcgaacctcgatgacgccgccatgcgcctccacgatggagcggcagagcgacagcccaaggccgatgcttcggcgtgaatccacgggccgcgtatcgcttgaggtgaagaagcgctcaaagatatgaggcttgtcgcagtctgccacacccggcccatcgtctgcgacgtccaccacgacgaacgcaccctcgcgacatgcgctgatggtgacagtcgagtcctcgggcgtgtatttgaaggcgttcatgatgagattcgtaagcacctgcatgatgagatggacgtcgatgcgtaccagcaggatgtcgtcagtgtgctcgatggtgacggcgcgtccatgcgatgcttgggcgacatggctgagggcggcctcgatgacctcgtcgataagctcggatgttaagttgaggcgaatggtgccgtcctcgacgcgtgtgatggcgaggaggttctccacggtatcgataagccagagggagtcgtcgtagatggcatcggcaagatcgcagcgttgttcgaggctgagcttctcgtcgctcttccgaaggattgccgcagatccggatatagccgtgaggggtgttctcaaatcgtggccgatggagcgcaaaaggttggcgcgcagctgctcgtttttcgccaagaccgcagcctcttcgcgctcttgcgccgctcggtcgctttcgagcgccaaggcgcattcacctacgatagataggacgatcgaatgctcgaaggcttcgatctcgcgcccctccagggcgataccgatgacaccgaataccttgtcgccggtgcgaaccgcgaggtagagacagcgcgcctcaggcagggtccgcgtgcttgcgcccgcgcgcttgttgttggtgtaggtccaggttgcaacggcgcgctcgtagtcggtgagcagcgacgcggatcggttttcggtgccagcggactcatagagcgccttgtcgagcgtgccgtgttcggcggggtagaagaccacgtcgagttttagcagtttgacgagttggttcatggcgacgcgggcgcactcctccgcgctatgggcttgctgcaagagctggttcgtttcgaggagtacgcgcgttttgaatgcgttctcggcggatgtacgggcgttgtcggcgatgcgcgcagttaactcgccggcgaccatagcggtagcgaacatgatgccgaacgtgaccagatagcttcggtcgtagctggcgagcgaaaacagaggcgtgacgaagcagaagttgtaaagcactacagagagcacgctcgatacgattgtgcagatacgtcccgtcgtggtgacggcggtcagcagggccgtgaggatatagagggatatgatgctggaatcggcaaatcccagatggcggaaagccgtgccgatcgccgtggcggcaagagagagggccagcgtgcgaagcacgtttcggctgctgggcggctgcagggcgagcgcatggcggcgtcctttgggtcgggagggcggagtcgactggtctggaatgatgtaaatgtcgagattcggggcgaatgttatgagctgttctacgagagatttgcggccgaagagggcctgacggacgctgctgtgctcgcccgtgcgccccatgacgatcttcgaaatacccgacaggcgcgcgaactcggagatctgaaacgcgacgtcgtcgccatagacggtttccatatgtgctccgagctgctcggctagggcgatattggctgcaagcttggcgcgctcatcatcgctcatggcttgcgtgcgcgggctctctacgaacagggcgacgagctcgctgcgaaacgctttcgccatgcgtgcggcggcacggacgatgcggggattggtcggcgccggggagacacagactaagatacgctccctggtgtagtagtcacggtttcccagcacgcgtgcggcgtctgtgaggtgaccggtgcgatcggcgcagcggcgcagcgcgatttctcggagtgcggtgaggttctcgacggtaaaaaaatgctgttgcgctcggtcggcttgtgcgggacggtagacgaggccggcgcgaaggcgctcaagtaggtcttcgggctctatgtcgacgagctcgacctggtcggcatcatcgaagatacggtcggggattcgttcgctcacgacaacgccggtgatggatgcaaccatgtcgtttaggctctcgatatgctgaacgttcacggtcgtatagacgtcgatgcccgcatgtagaagttcctcgacgtcttgatagcgtttgtcgtggcgagaccccggcgcattcgtatgggcgagctcgtcgacaaggatgagctgaggggcgcgctcgatagccgcatctagatcgaactcgctgagcgcaatgccgttgtgctcgatgagtttacagggcacgttctcaagcccttgtgcaagatgggcagttgccggacgttcgtgcggctcgatgtatcccgcgacgacgtcgacacctcgccgcttggcggcgtgggcggcttgaagcatcgcataggttttgcctgtgccagcagcgtagccaaagaaaatcttgaggtgtccccggctggttcgagtgtcatcggcgacctcgtctttctcaattgccttgaggatgaggtctggattgacgcgagtgtccgatgcgtcgcgctgcatagcgtagcctttctgaagcgttgtccatgcgtgcatacgcggtgaggacaccactgtatgctcgcgaggtcgagtataggcgcactgcagctgcaatagtgctttctacctgcatctttacggcatcttaaggacgtgagccccggccctcacgcctctttaatccctagaagcgtttactgtccccagacgcttgcgagggcaggcgtccgagacatcggaccgcgtgtgaaaggggcggtaaatggacatcctcattcccatcatcggagtcgtctgcattggacttcttatctattacatctacattctgatgaggagtgattcgtaaactatggacgctgcgattcagtacatcttgtactttgccgtgctcgtcgtcctggccgttccgctcggtcggttcatggcccatatcatggatggtgagcatacgttcctgtcgcctgtgattgctcctgtggagcgtggcgtctatcgtctgcttcgcatcgacgcggcagaacagatggggtgtaggcgctatctggcgagcgtgctggtcttttcggggatcggcctcgtgactcttgtggcactccaggcgcttcagtccttcttgccaggcaatccccagcacctgccgggtgtgtcatgggacctgtcgttcaatacggctgcttccttcataaccaacaccaactggcagtcctactccggtgagaccaccctgtcctaccttgtgcagttcatgggtctcactgtgcagaacttcgtttccgctggcaccggtatcgcggtcatgttcgcgctgatccgcggcttccgtcaggtcaaggagcagggtctgggttccttctgggtcgacctcacccgcaccgtcctgtatgtgctcatcccgctgaacctcgtgttcggcatctgcctggctgccggtggcgtcatctccaacttccagccggctcagaaggctgagctcgtagaacccgtcgctgttcagcctaatgcagacggcggctggagcgtcatcgacggcgcccagattgagggcgacacggtcaaggtcgacggcaaggttgtcgagggcgcgcgcgtggtcaccgagcagttcctgccccagggtcccgcagctcctcaggtcgccatcaagcagtccggcaccaacggcggcggcttcttcggcgtgaactccgcccatccgtatgagaaccccagtgccttcaccaacatcatcgagatgaccagcctgctgctgatcccggccgcctgttgcttcgccttcggtatcggcgtcaagaacaccaagcagggcaaggccatctttgccgccatgttcatcctgctggtgatcttcaccggcatcatcgccgtcaacgagcatgcgagcaccccgcagctggccgatggcggagcggtcaatatcgagatgaccgacggccaggccggcggcaacatggagggcaaggagagccgtttcggtatcgcctcctcttctacctggtccgcttttacgacggctgcttccaacggctcggttaactccatgcacgactcctacaccccgctgggcggttttgtccagatgctccagattgctctgggcgaggtcgtcttcggcggcgtgggctgcggcctgtacggcatgatcggcttcgccatcctcacagtgttcatcgccggccttatggttggccgcacgcccgagttcctgggcaagaagatcgagccgaccgagatgcgctgggcggtggttctgtgtctcgcaactccgtttgccattctggtgtgctcggccatcgcctgcatggtgcccggtcttgccgaccagctcaacaatggtggcgcgcacggcttctccgaggcgctgtatgccttcacctcatgcggcggcaacaacggctcggcgtttgcaggcatgaactgcaacattccctggatcaacgtcatgctcggcctcgagatgctgttcgcccgcttcatgcccatcatcggtgcgctggctatcgccggctcgctggccaagaagggcaaggtcgccgagagcgccggtaccctgtctaccaccaacggcatgttcgtattcctgctcgtgttcatcgttctgctgatcggtgccctgagcttcttcccggccctggcgcttggccccgttgccgagttcttccagatgattgcgtaaaggagggcgcagatttatgactatgcaaaaagacatgatgggccgcgcggtccgcgactcgtttgccaagctggatcctcgcgtccagattcaaaacccggtcatgttcctggtgtggctttccgccgtcatgacctccgtcctggccgtcgcttccattttcggtgtgcaggacgcgggtgtgcccacctactatgtggtcgccatcgcggtcatcctgtggcttaccgacctgttctcgaacttcgccgaggcgcttgccgagggccgcggtaaggcccaggccgattccctgcgtgcggccaagaaggatgtcgaggcccatcgcatcgagtccgttgaggacaaggagcacttcaccgtcgttcccggcaccgagctcacgcgcggcgacctggtgatcgtacgcgccggcgagcagattcccggcgacggcgacgtcatcgagggcgctgcttccgttgacgagtccgccatcaccggcgagtccgcccccgtggtccgcgaggccggcggcgaccgctctgccgttaccggcggtaccacggtgctgtccgactggatcatcgtcaagatctccagtgagcccggccagagcttcctggacaaaatgatcgcgatggtcgagggtgccgcgcgcaagaagacccctaacgagatcgctctggagatcttcctggtggccctctccatcgtctttatcctggtcacgctggccctgtattgttactcctgcttctcggtcggtcttaacgacatggacaaccccacggccgtgaccacgctcgtggcgctgctcgtgtgcctggctcctactaccatcggcgcccttctttccgccatcggcatcgccggcatgagccgtctgaacgaggccaacgtgctggccatgtccggccgcgccatcgaggccgccggcgacgtcgacatcctcatgctcgacaagaccggcaccatcaccctgggtaaccgccaagccgccgagttcatcccggtcgatggcgtcgatcccgcggagctggccgatgccgcccagctttcctcgctggccgacgagacccccgagggtcgttccatcgtcgtgctcgccaaggagcagttcggtctgcgcggtcgcacgctcgaggataagggtatggagttcatccccttcaccgcggcaacgcgcatgtccggtgtgaactacgagggcaatgagatccgcaagggcgctgccgattccgtgcgcacctatgtggaggcagctggcggcgtgttctcccaggagtgcgacgaggccgtcgagcgcatcgccaaggccggcggcaccccgctggtcgtgaccaagaactgtcgcgtgctgggcgttgtgtacctcaaggacatcatcaagtccggcgttaaggagaagttcgccgacctgcgcaagatgggcatcaagaccatcatggtgacgggcgacaacccgctcaccgccgcggcaatcgccgccgaggccggcgttgacgacttcctggccgaggccacccctgaaggcaagctcgagaagatccgcgagttccagcgtgaggggcacctggtcgccatgaccggtgacggcaccaacgacgcgcccgctctggcccaggccgacgtcgccgtggccatgaacacgggcacccaggctgccaaggaggccggcaacatggtcgacctcgactccagccccaccaagctcatcgaggtcgtgcgtatcggcaagcagctgctcatgacccgcggttcgctcacgaccttctcggtggccaacgacatggcgaagtacttcgctatcatcccggccctgttctcgccgatctacccgggccttggcgcgctcaacatccttggtctggcaagcccgctgtccgcggttctttcggccatcatctataacgcgctcgttatcgtcgcgctgatcccggccgcgctgaagggcgttaagtaccgcgaggtcccgtccggacagctgctgacccacaacctgctcgtgtggggtctgggcggcatcgttgccccgttcgtattcatcaagctcatcgacatgctgctcgcgttctgcggcattatgtaagtggaggtttgtatgttcaaaggtgttgcatcgcgcgcactgggcgtgttcgcgctgtttaccgttgtctgcggcctgggctatacgctcgtcgtgaccggcatcgcccaggttgcgttcccgtaccaggcgaacggatcgctcattacggttgacggcaaggttgtgggttccgagctcatcggccagaacttcgatggcgaagcccatatgtggggtcgtatccagaacgtgtcaattgtcgaaggcgaagacggcgagctcatggcgtatggtgccccgtccaacctgtccccggcgagtgaggagtatcggcagctgatagatgcgcgcgtgaagaagatccgcgccgccaaccccgatgctgatatggacgctgtgcccgtcgacctggtgacgtgttcggggtccggcctcgacccggagatctctcccgatgccgccgagtaccaggtcccgcgcctggcgaaggccacgggcaagagcgaaggcgaggtgcgcgagatcatcgcccagtgcaccaagggccgattcctgggcgtcttcggcgagcccacggtcaacgtgctcaaggtgaaccttatgctggacggcgcgctgtaggtgagggagtggcggatgagggcatgactgactatctgagccctcaattccaccccgcccatcagttgcggtgaaatacggactgttttggctgtcaaaggcctcatctactccgtattccaccgcaactttttatgggtcgagcagaagttggggaagcgcgtgcggtcgggtgctgcgcggttactgatatgataagtacgttagcaactgccgccgagcggctcaaacgaaaggaaccctgtatggagtcctctgcctatccgatgctctttagcccgatcaaggtcggtacgaccgaggtcaagaaccgcgtctttatgccgccggtgtccaccaacctggccgatcatggctatgtgaccgacgatttggtcgatcattaccgtgcccgtgccaagggcggcgtgggcctcatcatcaccgaggtcgtgacggtcgagcctacctatacctatctgccgggtgacatgtgctgctacgacgacacgtttatccctggctgggaaaagctcgccgcggccgtccacgagtatggctgcaagatcatgccgcagctcttccaccccgcctacatggcctttaacattccgggcacgccgcgcctgatcgctccatcctttgtgggcccgtcctatgcccgcgaggcgccgcgtcctatcacggtcgatgagattcacgagctcacgcatcagtttggcgacgctgccgtgcgtatgcagaaggccggtgtcgatggcgttgaggtccacgcagcgcacgcccacggtatgctcggcggctttttgaccccgctctacaacaagcgtaccgacgagtacggcggctcgctcgatgcccgcatgcgcttcctgctcgaggtcatcgccgagattcgcgagcgctgcggcaaggactttatcatcgacgtccgcatctcgggcgatgagtacaccgatggcggtctgaccctcaacgatatgatctacgtctcgcgtcgcctggagaaggccggcgtcgacatgattcatgtgtcgggcggcaccaccatcaagcgcggttccgcgattcctgccgccggtacccagcaggcctcgcacgctgcctgctcgcgcgagatcaaaaagcacgtcaacattcctgtcgccaccgtcggccgcatcaacgaggcctggatcgccgaggagctgatcgaggacggcgctgccgacatctgcatgatgggccgcgccaatctgtgcgatgccgagttctgcaataaggccgctgccggcaacgccgacgacatccgcccctgcatcggttgcctgcgctgcctgaacggcattatgttcggcaagcgcatctcctgcaccgtcaacccggacgtggagcgcgacgaggctggttacgagcctgccgccgaggctaagaacgtgctggttgtgggcgctggtcctgcgggcatggaggcagcttacattgccgccaagcgcggacacaacgtggtgctcgtggataagcaggatgagccgggcggcgagatgcgcatcgcggccgttccgccggcaaagcaggaactcacccgcgtgatcaagtatcagtaccgtcgcctggccgaggtcggcgtgaagtgcgtatttggcaccgagcttactgccgaggacattcaacgcgactacgcgggctacgaggttgtcctggcttatggcgccgagcccatcgctccggccttcatgcagggctttaagcaggttatgacggccgatgacctgctgggtggcaaggctttcccgggcaagaagatcgtcattgtgggcggcggcaccgttggctgcgagacggccgattacctggccccgttggtcaacgacctgtcgccggccaaccgcgatgtcaccgtcatcgagatgaccaagacgctcgccgccaacgagggcggtgccggtcgcgcggtgctcatcacgcgcatgctctccaagggtgtccacgtgctgactgaggccaaggtgaccgaaatcacagaggacaccatcagctacgagaaggacggcgaggtccacaccatcgccggtgccgatacgctggtgcttgccatgggctatcgtcccaataccaagctggccgacgaccttgccgctgccggcgttgccacccacgtgctgggtgacgccaacaagtgcggcaacatccgcgacgccatcggcgatggctacaaggttgcctgcgagctctagtcaacccctggtgcattgggaggggcatccctgcgccatccgatagcaaaacagcggcggggtcccgggtttcgggatgccgccgcttgctcttgtgatcctggcgacgcgagcgcgccctatttcaccgcaactgatgagataggggatgcgatagtattacgggtgatattcgacaaaccgtgagcttcatccgagggctttatggaacaacaccagcattatcagagcttgcaagatcaggcatacaacgcattgcgctccaagatcatctatgccgagttcaagcccggcacgcgtctttcggcgattggtctggaaaaggagacaggaatcgggcgcacgcccattcgcgagtcctttgtgcgcctgcgtgagcaggagctggtggaaacgcgtcccaaaagcggcacctatgtctcaaaaatcagcatggagcgcgccgagaacgcctgtttcttgcgcgagaaactcgagagaagcgtgcttattaaatgctgttcggccgcctcgcctgagcaaaagcatcggctcgagcagattcttgccgagtctgagtcactcgaccatggcgaaacgcgtcgctttttcgatctggacaacctgtttcatgagacgtgttttgagattgccggtcgtcacatgttgtgggattggatgaagagcgtcaacactcattttgagcgatacaactggttgcgtatggtgtcgcaggacctggattgggagccgattcgtcggcagcatcgccggattctcgaggccattaagaggggcgataccgatgcggcgagttatctggcagagacgcacttgcacctgatgcccgaggagcagggcccggttatcgccttacatcccgactattttgagctgcctaaagactcgaataactagcccatcattgcatctgctcgagacgcaaaaacgatgctgctcacctacagcgctttgcaaccgagatttttaaaaaatgcctaaaatggctcagacttccgacattgggaaacggggtgcgctatggcgcagatgagaatcaaggacattgccgccgaggcgggcgtgagtccggccacggtctcgcgctatctcaacaaccgccccgggcaaatgaccgaggaaacccgtgctcgcatcgcggcggttatcgagcgcaccggctatcgcccgcgtgccgccgcgcgcaatctgcgcagctcgcggaccaacctcatcggtgtgatcctggccgacatcgccaacccgttctccagcgccatgctcgaaggactttccgccagcgccgccgcgcgcggctgctcgctcatgacggccattagtggcaacgactccgctaaggaagcggagtcgctcaccagacttatcgatgccggcgtggacggcctggtcgtcaacacctgcggaggtaatgacgaggcgatcgccgcggcagcgggacgtctgccggttgtgctgcttgaccgcgatgttgccgacggcggtgtcgatctggtgacatctaacaaccgtgagctagtcgccggcttggtagacgccttggccgttgcgggcagcgagcgtctgtgcctgctcaccgaggcaagcgacgatagccccgtgcgtcgagagcgcgctgaagcctttaccgatgagctttcgcgacgcggccttgcgggtgaggttgtcaccttggccgatggcggtgccacgggcgtcggtcgcttggacgagactatccgcggctatgcaggcaaaaagctcggccttatcgctgtcaacggcttggtcttcctgcgtctgaccgaggccctggcgcagttgggaccttcgttgccggcgggtctcaaaatcgcgacgtttgacgattgcccctggaaccgcgtgctctttggcggcgtcaccacggccgcgcaagacacccttaccattgccgagtgcgtagtcgagcgcctctccgagcgcatcgacgtcgttaccaccaccgtgggcgaggccgcaaagctggcgcccaaacgcatcgagatccccggccacatcgagcaccgcgcatcgacctcgcgctagtcactcgttcgcaactgcctgttcgcgcacgttttttgagcgcttgatacgctttaaccctgcggaaacatttttctgcgatagtatctgcgatatagaccagtcgaaacccgcccgaaagaaaggggagcgacatgaaccagcagaacatcgattacgtactccgctccgtagagcagcgtgacatccgctttgtgcgtctgtggtttgtcgacattctcggccgcctcaagaactttgccattagccccgaggaccttgaggtcgcttttgaggagggtattggctttgacggctccgccatcgagggctttgccacgcccgaggaagccgacatgctcgcattccccgatgcttcgaccttccagattttgccgtggcgcccgagccacaacggcgtcgcccgcgtgttctgcgacgtgtgcactcccgaccgcaagcccttcgctggggacccgcgcgatgccctgcgccgcatgttccacaaggccgagaaggctggctatctgctcaacgtgggcgccgagctggagtattactacttccccgacgagcacacccccgagccgctcgacaacgtgggctacttcgatctttcggtgagcgatgccgcccgcgacctgcgccgcaacacggtcctcacgctcgagaagatgtccgtgcccgtggagtacaccttccatgccgccggccgctcgcagcacggcatgagcctgcgccacgccgaggccctgagcatgtccgacgccatcaccacggccaaactcatcattaagcagcaggcctacgagagcgggtgccacgcctcctttatgcccaagccgttggcgggcgaggacggcagcgctatgttcctgtgccagtcgctattcgaccacgacggcaacaatgtcttttggggcgaggacgacgagaagtaccatctttccgacatcgccaaacactacatggccggcattctggcgcatgcccgcgagatcagcgccatcaccaaccccacggtcaactcgtacaagcgcatcaccacgggcggcgactccgtgccgcagtacgccacgtggggcctgcgcaaccgcgcgagcatggtccgcatcccggtctacaagcccggcaagcagctgtccacgcgcatcgagctgcgcagtcccgaccccatggccaacccgtacctggtcaacgccgtcacgctggcggctggtctggacggcatcgagcgcaagctggaactcccgcccgaggcaacggccgagacgctcaagctcaccgaccgtcagatgctcgaggccggctacacgccgctgccgcgctcgctcaaagaggcgctcgacgtgtttgaggactcgcagtttatgaaggatgccctcggcgagcacatccacagcttcttcctcaaaaagaagcgcgacgagtggcataagtttgagtctacgatcaccgagtgggagatcaagcactacctggcgaactcctaatcgcgctggcttgttccagtacgattgagctcatttctttggaggccgatatgtccgaaaagagtgccctgttcatggcgcgcacgacgcgcttccacgagtttgcccgcagcttgacgaccaccctgggtgtcgaggtgagcctggcaacccccgattcgccgactgcggcgcacgactttgacctgctgatcctcgattccgacggcattcgcagcgaccgcatcgatcagattgccaagtggcttgacgatcgtggcggcgtccccatgctggtgatcgtcgacgatgaggcccttggcaccctgcgcctgccgaatcacgcgcatgccgactttgtgtgccccacggcgacgcccaacgagctcaaggctcgtgcgcagcgcctgatgggcgaggaggagaccgtcaccgccgacgatgtactcaacatcgataacctcgagattaacctggccacctaccaggtgacgctcgatgatgagcccatcgacctgacgctgatggagtactcgctgctgagctttttggcgacgcaccccaaccgcgcctacagccgcgaggtgctgctgcaccgcgtgtggggctttgagtactgcggcggcacgcgcaccgtcgacgtgcacattcgacgcatccgctccaaggtgggtccgcagatcgcggcgcacatcaccaccgtccgcggcgtgggctatctgtttaaggactagcttttcaccacaaaggggacaggcacttttgtggtggttttgacgcaggtacggattcctttcgggtctgcggcagaacttaagccttcctaaaagattgcgttctcatacacttgcgcccgcatattggggtacaactcaacgtgaacaatgatggcccgccacatgtttggcgggcctttggttatttgacgaaaggatcgcagctatgagcgagaacgattcccagcacccccaggatgcgggcaacgctggcgagacccagcagcagccgcgtgtgcaggtggagtcgacgcctgccggtagcaacattccctacgtgcaggcatacgatacgcagaccggcaagccgctgggcggccaacaggtcgtgaacaagcacacggtggtcaagaccaagaccaaaaagctgccgatctttattacggcactcgccggctgcgcctgcggcgccctgctggtcatcgcgctcattatgagcggcacgctcgatatcggcggcggcaagaatgccgtgacggcgggcgcttcgggttcatcgacgcaaaagatcacgatcgactccgaggacaccacgctggccgaggccgtttctgctaaggccctgccctccgtcgtttccattaccgccacttcgagcggcagccagaatggctcgctttcgcagtctgctgatgagtcggatagctcgggcagcgtcggttcgggcgtcgtgctcgataccgagggccacatcctcaccaacaaccacgtggtcgacggctacgaccagtacgtggtcaccatggacgacggcaccacctacgaggccgagttcgtgggcaacgatgcttcgagtgacctcgccgtcatcaagctcaaggacgccgacgcctccaagctcacgccgatcgagatcggtgattcctccaagctcaacgtgggcgagtgggtcatggcgatcggttcgccgtttggcaacgagcagtctgtctccaccggtatcgtgtcggcgctgtatcgctccacggccatgagctctaccagcggcaacactatctacgccaacatgatccagaccgatgccgccatcaacccaggcaactccggcggcgcgctcgttaacgacaacggcgagctggtgggcatcaactcgctcatcgagagctactcgggctctagctcgggcgtgggctttgctattcccgttaactacgccaagaacattgccgaccagatcatcggcggcaagacgccggtgcacccgtacctgggagccacgctttcgagcgtcaacgcgctcaacgctcgcactaacaagctgagcaccgatagcggcgcgtacgtggcgagcgtcgttgaggacggtcctgccgcaaaggccggcatccaagagggcgatgtcattaccaagctgggcgacgacgagatcacgagcgccgatggcctgatcatcgcgctgcgcagccacgaggtgggcgagaaggtcgagatcacgcttatgcgcggcaaggacgagaagaaggtcaccgtcgagctgggctccgacgaggagctgcagaaccagcagcaggacgacagctcgaccgacaccggcaacggcggtattaccgacgagcagctgcgccagtatctggaggagctgctgggccagcagggccagggtcaaggctacggccagggtttctaacgagctgtatcgcacataccgatgccagaggggctgtcccatcaacgtgggacagctcctcttttcttattgatccgttggggacggaggaaaacgggtcatttagaactgacaagggcatgggttgatcgcgcgatccaccccggtccgtcggctgccgattcggtgcggttcgaaagggctattcggcgccatggtgaccggtggtactctagtatccgtttgaaatcgagcgaaggagtgccgctatggagcaatcgagcctgtttggtgacggcgtggacatcgataccgaaacgcccgcgagtgcggatgccgctgcaccgaccgatgcccgtgcccaggcggcagcacgtgcggccgagctgcgccacgagctcgattaccacgcctatcgctactacatgctcgatgcgcccgagatcacggacgccgcctttgacaaaatgctcgttgagctgcaggagatcgaggctgcctaccccgatttggtaacgcccgacagctatacccagcgtgtgggcggctacgtgagcgagcagtttacgtcggtcacgcatatggcgcgcatgtattccatggacgatgccatggatctggacgaacttgacgcgtggctccaacgaaccgaggatgcgctcggcgcaggtagcgtcacctatacctgcgagctcaagattgacggcttgggcgttgcgcttacctatcaaaacggcaccttcgtgcgcgcggccacgcgcggcgatggcaccacgggcgaggacgtgtcgctcaacgtgcgcaccatcaaggatgtgcccatgcacctgtccgagccggcactcgcccacatgggcgccgaccgcgagcgcaccattgaggtacgcggcgaggtctacatgcccaagggcagctttgtccgcctgaatgaagaggccgatgccgagggccgcgaccccttcgccaacccgcgcaacgccgccgccggcagcctgcgccaaaaggatcccaaggtcacagcacgccgcgatctggccacctttatctacgccatcgccgataccgacccgttgcacgtccacagccagcgcgagtttctggactggctgcgcagcgccggctttagcgtcaaccccaacgtggcacgctgcgccacacccgccgaggtccacgagttctgtgcccaggcgcttgagcaccgcggtgacctggactacgacatcgacggcgtggtcgtaaaggtcgacagctttcagcagcagctcgacctgggctttactgcccgcgcgccgcgctgggccatcgcctttaagttcccgcccgaggaaaagcagaccgtcctgcgcgaaattcgcatccaggtgggccgcaccggtgtgctcacgccggtcgccgagttcgacccggtgacggttgccggctccaccatcgcgcgcgccacgctgcacaatatcgacgagatccgtcgcaaaaacgtgcgcgagggcgacaccatcatcgtgcacaaggcaggcgacgtaatccccgaggtcgtgggcccggtactcgataagcgcccggccgattcggtcgactggcacatgcccgaggtctgccccgtgtgcggcagccccgtggtccacgaggacggcgaggttgcctaccgctgcgtctccatcgactgccccgcgcagctcaaggagcgcctgctccactgggtgagccgcggctgcatggacgtcgacggcctaggcgacgagattgtcgacaagatgatcgccgccggcctggtccacgatgtcgcggacttctaccagctcacgatcgatgacatcgcaggcctggacacgggccgcgtggtaaaaggggggcatcgtaagggcgaccccatgctcgataagcatggaaagccgatgctcaacgaggacggtactccaaggctttacaaagccgatcgaatcgttaaaaatgcgggcgagcccataccggtgggtgtgaagacggctgaaaagatagtcgatgagctcaataaatctcggcagttgccgctcccaaggattctgtttgctttggggattcgcttggtggggaagagcgtcgccgagcttatagcccggcgttacctttcaattgatgcacttgttatagctgacgaggaagatatagcccagatcgaaggggttggaccggaaatcgcaaatagcataaaggagttcttctctgttccggaaaatctcgatgtgcttcagcgacttcgtgaatgcggtttctctctcgaggaagaccttatgggcgcaatgcaggcaaagtctgaaaaagctggtatttccgccaatctcgcttcagagcaaccactaacaggattgacttttgttctgaccggtacactcgagaaacgttctcgttccgaggctggggatgtgttgaaacttctgggggctaaggtgacggggtcggtttcgaagaaaacctcctatgtagttgcgggggcgaatgcgggctcaaagctcactaaggcccaagcacttggtgtgcccgtactggacgaagaccaacttgaggaaattatcgaaacgggcgaagttcctgtggagtagggagactgtcatggcggcagacgtactgtttttggatgttgaaactccaaatggacacaatgatcgaattagctcaattggactaattcgatgtgactgcaatggtgccgtccttgcagaggattcctatttggttgatcctgaggagccgttttcggaaataaacatgaggctaacgggcatttcccacgctgatgttgccggtgctcctacatttccggaaatatggtcacgctcattgaaaagcttgtttgacggagccgctctggttgctcacaacgcttcatttgatttggcggttctgtggaagctattcgacgcctatgaacttgacaggcccgagtggaattacgcctgcactaaagagcttgccaagcagtggcatccagaatacccagactataagcttccaacggtttgccgatgcctagatcttgagatggggaaccatcatcgagccttggacgatgcggatgcttgcaggcgtattttccactcgttggttatggaagacgaggggcgtgtccccacgtttgcaccgtatagtcttggtgctagttgcaaacgacgttcaaatgaaggggcttcccgtgcttcggcacagagagtgaagtcggaaaagactgccgattactgcgactttctaagtttgtgcgaaatgatagtcgccaatggccgagttgatgccttggaggcaatgtcagtactgcagtatgtcgaagaacatgataagttgcaaggcgaccctttgctcgacaaagtttgctcgcttctaactgccgctttggcggatggtgatatagatgagcgcgaatccaatcaattggttggtttattgcagggggtaatcaatccctgctccgatggcgtagcgcatcgacaggttcaaattgaaggaaagaaattctgcctctctggtactttctatcatggttcaaaagagtgtatcaagcagtttattttgcagaatggcggccaggtactgagtggcgtgtcaaagaaatgcgactacgtggttgtgggcgatgaaggcagcgatgcttggactacaaagaactacgggagtaaggtaaagaaagccttggaactccagtccaagggcgatgacattcagattgtcagtgaagatgctttaggactttagcggggtcgttttggtgtaacataattgtgtacacaattatgttaggagtgtgccatgcccgtttgcgttccaattaaagatatgcgggacaccgcaaagttttctgagctcgttgaaactactacgggcccagtgactgttacaaaaaacggctatagcaaatttgttgtacttcgatctgaagactatgacctcatggttcaggaacaggctaaggctcgcctgatggctcgtatagctgtggccgagcgggagcgtgctgccggcacggcgcgtgatgcctttgaggccctcgatgaccttgaggcaaaatatggcctataacgtcaagattctgcctacagctgaacaagaggttgacgatatcgttgattatctattagggcatggtatttttaccgcccggcattttcttgataaataccgtagtcagctccagcttcttcaaagtggtgtagttgactacggcttatcgaagttacccgagcttgcagcgcttggctaccatgcttgcctcgtcaattcttatgtaatgctttattactacgataacgaggacgttgtggttgcccatgtttttcaccaaagccaagattatgccgcattggtgatatctagaaatcgattcgagttgctggataatgattagtaagaaccgcccggaagcacgatgccttccgggcggttcttactttgccgggacaaccggcaccgtgatctgcgtcacgtaggtcgccgggtcgtcgctgatgatgtcgtcgatgggggcgatttcgcgttgccccgctacgctgccaacttgtcaaaagccccacgccggttgagcacggtaaacgcgacaacacagatgactgccgacaaaatcgagccgcatggcgaagcgatgcccatgggaaacagcgtgtcggaataggcgttcgacagcagccacgcgcccggcacgcgaatgagtgccacggccagcacgttgtgcgcaaagccgatgtaactcttgccgtatgcagcgaaaaagccactaaagcaaatgtggatgccggcaaaaatcgcgtcgaaaatgtagctgcgcatatagccggtaccggccgcgacgaccgcggagtccttggcaaaaaagccgataaacgccggtgccaccagccacatcagcaccgtgatcaggcagccatacaccaccgagatcgtcatggcgtctttgagcacctgacgcgcgcgatcgcccttgcccgcgccggcgttttgcgccgtgagcgcgctgacggtggcacccatggaactcggcacaatgaacaaaaagctgatcatcttttcgaccaggcccacggcggcagcgtcgacgagccctcggtggttggcaatgacggtgatgaacataaacgccacctggatgcagccgtcctgcacggccacgggcacgccgatcttaagaatgctgccgagcacctcgggctgggggcgcaggtcgctacgcttaacgtggatgttcgtgcgacggctcttgagccacacgagcgcgagggcaacgcttgccgtctgggcggttaccgtgccgagcgccgcacccacggggccgagtcccatgtggccgataaatagaaagtcgagcgcgatgttgatgatgcatgccacgccgatcacgtacatgggcgagcgcgaatctcccagcccgcgaaagatggccgaaagaatgttgtacgcggcgataaagggaatgccgacaaagcagatacgcaggtaggcggcggttccttcgaccgcctcggccggcgtgccaatgagcgccacaacctgcgggcacagcgcaagcaggacaacggccagcaccaccgagacacccataaagagcgtgatggtgttgccgatggcggtctcggcacggtcgaagcgacgcgagcccacggcgtggccgacgataaccgtcgttcccatggccaggcccacaagcgtcacggtaatgatatagagcgtctgcgcgccattgcccacggcggtgatgccggcggcgccgctgaactgccccatcatgtacagatcggccatgccgtagagcatctgcaaaaagtacgagagcatatagggcagggcaaagaccgcgatggtcttgaggacattgccgtgtgtgaggtcgtgttccatgggcggggcactttctggcttgggtcgtttacataccagtgtagtgaaaaccctacaacgattgtagagtcaaggtttgtgttggcggtggggcgaaaaagtcacgctcgcgttcatttctaattgaatacggacgtgcgccctgtgagcatggcgcctgcactagccttgcagaaatcgatttcggaacacttgacaccgccgcacggcgcgccataatacgtgggtttgcgaacaacgtttgatgggggatgaacctgcgtgcgcaatctcaagattctgttttcctatctgggggcataccgccgcgatgccatactcggcgtgttctttgtgactgctgagacggcgctcgagctgtttatcccggtcatcatggcaaatatcatcgatgtgggcgtgcccgcgggcgacatcaactacatgctgttgcagggtacgtatatgttggtatgcgccgcattttcgctggtacttggcttgggctatgcacgcacgtctgctcgcgtcgcctcggggctgggcgctaacctgcgcgaggccgagtatcgcaagatccagacgctcgcttttggcaatctggacaactacgacgccagctcgctcgtcactcgcatgaccaccgacatcaccgtgattcaaaacgccgtaggtaacggcttccgccccatggtgcgcgggccggtaaatctggtcatgggcttcgtctacgcttttgcgctctcgcgcgagctcgcggcggtctttgccgtcattctgccgatgctcgccatcgtgctcggtatcattaccgtgcgtgtgagcccgctctaccgccaactccagacctcgatggaccacctcaacggcgtggtgcaagaggaccttaccgccgtgcgcgccgtgaaggcttacgtgcgcgctgagcacgaggaggccaagttcgacaccgtcaataccgagctcgcgcgcactgcgacaaagacctttggcagcgcggtgctcaacctgccggtgtttcagctgtcgatgtacgtggctgcgctctccatcctgtggattggcggccgcatgattctcgccggcaagttgggtgtaggctctctcacgggctttatgagctacgtgctgctgatcatgaattcgctcatgatgatttccaacgtgtttttgctgctcacgcgcgctcttacgagtgtgggccgtatcgccgaggtgctcgatgaggagccctttatcgccaaccccgcgggagacctcgcgattgcggcgccagcggacggcagtatcgagtttcgcgacgtttcctttaaataccgcgcggatgcagccgaggatgtgctcgagcatatcgaccttcgcatcgagagcggctcgacggtgggcatcctcggcggcacgggctcgggcaagagttcgcttgtgcagctgattgcgcgcctgtacgacgccactgagggcaccgtgcttgtgggcggacacgacgtgcgcgactacgacctcgcgaccttacgcgatgccgtgggcattgtgctgcaaaagaatgtgctgttcacgggcaccgtgcgcgagaacctgcagtggggtaatccgcaggcgtcggacgatgagctcctcgcggcttgccgcgcggcgtgcgtggacgagttccttgatcgcatcggcggactcgacggcgagttgggccaaggcggcgccggtgtctcgggtggccagaagcagcgcctgtgcatcgcacgcacactgctcaagcatccgcgcgtgctcatttttgatgactccaccagcgcggtcgatatggcgaccgacgctaagattcgcgagcacatcgctcggattcccaatacgaccgtgctcatcatcgcccagcgcatcgcgagcgtcatggatgccgatcgcattgtggtgttggatgacggtcgtgtccacggcgtgggcacgcacgaggaactgctggcgggcgacaacatataccaggagatttacgcctcgcagatggagtttgcggggaacacggacgccagcgacggcggcgacgatggctgcgcgaatgatccgttttcctccgttcccagcggatcgcccttggaagggggtgagcgccatgcctaagaccgcagcccaagcacgcccggccgacctcaagcgcacggtgcgccgcctgctctcctacatggggcatgccaagttctcgttgctcgcggtgggcgtgctcgcctccgtcgccgccatcgcgagcctcgccggcacctacatggtgcgccccatcgttaacggtttggctacgggcggggaggaactgctcgccaagcaggtcatcctgacggcgatcatctacgccgcgggcgtgctttcggccctgggctactcgcagatcatggtgcgcgcggcccaacgcgtggtgtccgatattcgccgcgacctgttcgcgcacatccagacgctgccgctcagttattttgacagcacgcgctcgggcgacatcatgagctttttcaccaatgacgtcgacaccgtctccgaggcgctcaacaacagctttgccaacgtgattcaggccgccattcaggttgtgggcaccacggctatgctcatcatccttaactggcagctcacgattatcacactcgtgtgcgatgcggccattgtgctgtatgcgcgctactcgggcgcgcgctctaagcgtttctttgctgcccagcaggcatcgcttggcgacctggacggatacgtcgaagagatggtctcgggccaaaaggtcatcaaggtctttaaccgcgaggcggcgaatgtcgccggcttcacctgccgcaacgacgagcttcgccgcaccggcaccgccgccgtgagctatgccaactccatggtgcccatgaccgtggtgattggctacgtcaactatgccatcgtcgccgtggcgggcggcatgctctgcatcaagggactcgccgacgtgggcgcgctcgcgagctacctggtctttgtgcgccaggcggccatgcccatcaaccagtttacgcagctgggcaacttcttgctcaacgcgttggccggtgccgagcgcctgtttgcggctatggaccttgagcccgaggtggacgagggctgcgtggagctggtgcagacgggcgacgccgcgtgggcgtggaagattcccgagggccagggcgtgggcgcgtacgggcacttgcatgacgtggcagccgttgatgagtcgggccgcgcggtggccgccgacggcatcgagctcacgtgcggcttggtcccgcttgccggcgacgtgcgcttccatgccgtggacttttcctacgtgccgggcgcccgcgtgctcacggacctcaacctgtttgccaagccggggcaaaagattgcgtttgtgggctccacgggcgccggcaagacgaccatcaccaacctcatcaaccgcttctacgaggtcgatgacggcgagatcacgtacgacggcatcgacgtcaagcacattgccaaggccagcctgcgcgggtcgctcggcattgtgctgcaggacacgcacctgtttagcggcaccattgcgcagaacatccgctttggcaagctcgacgcgaccgacgaggaagtgcgcgccgctgccgaggccgcctgcgccgactcgtttatccgccgcctgccgcggggctacgacacaccggtcacggccgacggcgccaacctgtcgcagggtcagcgtcagctgctcgccatcgcgcgcgtggcggtggccgatccgccggtgctcatcctggacgaggccacgagttccatcgacacgcgtaccgaaaagctcatcgagcgcggtatggaccgcatcatgcgcggtcgcaccacgtttatgatcgcgcaccgcctgtccactgtccgcgacgccgacgccatcatggtcctcgaacacggccgcatcatcgagcgcggcacgcacgaagagctgctcgcccagcacggcgagtactggcagctggcgcatggcttaaaagagctggattaacccgttcgagcacgatgctttgacccctccgtgcccctcacctcgcctcaaaccatcacaacattcgacgttttttgccaaaatcgggaaaagcatcgaatgttgtgatggtttttctgccgctcgaccgggtggaatcgctttcttgcgcacgaaggtgtgcggacccgtgggcaggggaataaggttggttatccgactccattggagggctcatggacctgccgatcgtcctgtcccataagactgcctagctgtaccacaacgtggcgcgcccgtccgagccgccctcgcgagcaagcagcctatacgatgaggactcgcttgctaacgatgcggagccgaccgcgagcctgcccaaattgggactcgatgccaaagggctgagggcttcaacggcagctgggatcgttaccgactatctggtttcgcttggtattccgcgagaagagctcgatcatatcgacacgctcgtcaacttcgattttgagcgctcgacgccggctggatttagatgccacgtgtttggggcgccggtgcctccaggccatcttatcgaggtggcagagggccttctagtggttgatgaggtcatgtgctttgtccaagcgggttcgtggatgagcgagcccgagcagctggaatatggctacgaaatctgtgcccgataccatttgaatcatctgtcgacaggcgattacatcgagatggggcagaggtataccgttgccgacttgattgcttattgcaatgagaaccgatctcgccagggggctatacgcgcggccgccgcgctcaagcgcgtgcacgatggcgcgcggtcgcccatggagacggccaccgcaatcatggtcgtagcaaaacgttcccagggtgggctgggatacgccaagatcgagctcaaccatcgggtcgatgttcccaacgagttcaagtatctcgcaaaggccgggtatttcgagatcgacgtatatgcgtctgcgagcggtacggggattgaatacaacggctcggaccatcttgataaacagcgcagcgcgtcggacgcggagcgtatgaccgtgctgagcgcgctgggctttaggatgatcgtcctcaccgggactcagtttgcccatcagctgcaattgcaccgggcgatgaacgccatcgcgcttgctatgggtctcaagtgcgatcgaagcgaagcgttccagaaacgtcagaacgacctgcgagaattcgtgattcggcactgggacggcggcctttaggggcgctttggcccttctacggggtgccgtgggcaagcaaaccatcacaacattcgacgttttttgccaaaaacgggaaaagcatcgaatgctgtgatggtctgtgctgaggatgggcttgggaagccggtcttgcccaaagtgacctgtcctgtcgtacgggtgtcggcgtgattctctcgtggggtattatgttttccgaagaataaaacgccgcgtgaggggagggctgcgtggacgggcacgtgcaacatgacggctttggccgcgatatcaactacctgcgcattgccgttaccgacaagtgcaatttccgctgcatttactgcatgccggccgatggcgtggcgccccgcgcacacgacgagctgctcagtgccgaggaaatcgcccgctttgtgcgcttggtggcgggggagggcattcgccgcgtgcgcctgacgggcggcgagccgctggtcagccgccgtatcatcccgctcattcgcgacatccgcgcgattccgcagatcgaggacatctcgcttaccaccaacggcgccctgctgcccaagttggcgccgcagcttaaagatgccgggcttaaccgcgtcaacatttcgctcgacacactcgaccctacgctgtttggaaagatcacgcgcctgggccggctcgagcagaccatggcaggcatcgatgcggcgctggcttggggctttgagcccgttaaggtcaactgcgttgtggtgcgccggctcaaccaggatgtggcggccctcgcacgactgaccgtcgaccgccccatccacctgcgctttatcgaatatatgcccatcggcgacgagcacacgagctcgcattgcgctgtggacccgcatgcgcccgcgctcaatcccgagctgtgggacgcgagcgacaccgtgccgagcgacgagctgcgggcgcgcatcaatgccggggccaccgcggcgggactgggcgagctcgagtcgctcgacatcaacgacgctcctgccggcgcgggccctgcgcgctattggcactttccgggcgcggcgggaacggttggctttattagcgccatgtccaaccatttttgtgcgaattgcaaccgtctgcgcctgacggccgacggcaacgtgcgtccgtgcctgttcagcgatgctgagtattcggtgcgtgaggcgctgcgccgtggtgatgatatgcaggtactttcgatttggcgcgatgccgtggcccacaaaccgcaggaacacgcgataattgagggcacgcaacgatttatgtcccaaatcggaggatgatcatatggccaagagcaggtacgccgatgccaccaaggccgctcgcagggccgcgatgtctgcccacaaagccacggctgcggcgaatgctggcagcgccgacacgtccgtgcagccgtctgccagcgctgccaccgagcccgcccgtgacgcccgtcgcgacgagctgacgcacgtggacgccaggggcgaggtgcgcatggtcgacgtgtccgacaaggccgagacgcatcgcatcgccatcgccgagggcaccatcctcatgcatcccgagacgcaggccatggtgctgcaagaccgcgccaaaaagggcgacgtgcttgcctgcgcgcgcgtggcgggcatcatggccatcaaacgcacgagcgacatcatccccatgtgccatccgctgctcattaccaagagcaagtgcgacattgcgcccatcgcttcggcggggatgcctgtcgagaacgtgcccgagggctgggcgccggcgcgcgcggacgggcaggttggctttcacgtactggttacggccggcgtgacgggcaagacgggtatcgagatggaggccctgaccggcgcgagcgctgcgtgcctaacgatctacgacatgtgcaaggccgtcgatcgcggcatggagatcgtcgacgtgcgcctgctgcacaaggaaggcggccgctcgggtgtgtgggatcgtgcagagcgtcaggccgctgccgttgagtccgtggccgctaacggtgccgcgcccgcgagcgcacccgtcgccgtcacgcccgcagctcccactccggccgtccccgcgatcgcgtttatcggctaccaaaactcgggcaaaaccacgctcgtcgagaaggttatcgccgagctcacccgccgcggcctgcgcgtgggttcgctcaagcatcacgggcaccacggctttgatatcgatgtgcccgctaaggatacgtggcgccatcatcaggccggatccaaacacgtgggcctcatctgcgccacgcgctgggcggagtacgccgacacgcgcgaggaggacgagatgcccgcgcgcgagctactgtcgcgttacaacgatgtcgacgtggtgatcatcgagggctacaagaccgagggcttcgacaacattgtggtcgcgcgctccggtgtcgaccgtctgcgcggcaagagctcgctcgacctggtcgacggtcacacgctggcccttgcctgcaatgaggccttggcgcgtcaggccttcgacgccggcttcgcgacccgagccatcaacatcaacgacgcccgagccatctgcgacctcatccaagaccacctttaaggcttgacgctgaacctgccaaaaagggacaggtttattttggtaggttttatctgggcaaacgctgtttccaccacaaaggggccaggtacctttgtggtgattttgctttgttagatgtgtgggacatgccttacaatctaccaagtagttcatactgagcgaaaaacggagagaaggggcttgatgcgcccttaatgtttcatgcggatagattgatttgacagacggtggcgaatgcccgccgtccgcattcgtatgaaacaaggagtctccatgcttgcctctcttttctcaaaacctcaaccatcgctgtccgtgcaggccaagcgcctggtggcgatgcgctttctcatctacaccggttttcagaccagctactttatcggtgtcatcggaacgctcacctatgcagacgatgcctcggtcgtggcgacatcgctggccgttctgtttatgaacgtattcgtgatcctggggtcctttgcgggcggcgctgcgctcgacgcctggggcccacgtcgccatttcttgttgagtatcgtcggcacgctggcgacgggtgcggcaatcatcgcctttggcagcgcgaccggaacagtccttgccgacgcggcgctcctaggttttgtgatgggattcgcccaacccatcgccacgtcctatccggcatatctcaccgacgatcccgccgaactcaaagacatcaactccgccataaccatgttctccaacgtgagcattatcgtcggccccacactgggcggctttgtcgcggcggctacatcgtcacgcgcggtgttcgtgctcatgatgatttttaccgtactggcgttcattgccggccggggctttagaccgcaagcagttcgcgtcgccgcgcgtgaaagtactcccgcggacagcagtacaaaggcaatcactgccagccaaagctccaaccccagcacgttcgcccgcgtcaccttcgcgacaagcatcaagacagtcttcaccaacagtatcctcgccttgctgttctgcattattttcctctcgaactttggctacggtgccttcgatccgctggagtcgttcttctaccgcgatgtcctgcacgtcggtgtcgaatggatgggctggctctcgtcggccagcggtgtgggcgcggtgctgggcgccgtggccgcgctccgcttgccgccgcacctggtcaaccttaagacgctgcttgtggcgctcatgtccgtgggtctgggaagcctgctctacgtgggaacgctgtacgtgggcgtagcccttgtcggccagattgccctgggcgtggcctggggcgtcgtcaacccgctccacaacacgatcgtgcaaacgacggccccgctcgagcagctcggtcgcgtgaactcggtcatgggttttggcaatatgttcgccggcgtggccccgctggcgattgccccgtggctggcggcgacgtttggtgtgcagcagacgctcgttggtgcgggcatggtcgtgacggcagttcccgcggcgttgctgctgtttggacgccggcattttgatcgtgccgcaaggcagtaaaaaccatcacaacattcgatgaaaatcgcgattttgccgaataacgtcgaatgttgtgatggtttgcgttccggccaggccaccacaaaggggccaggcacctttgtggtggtttttgctttgacgggccgcgcctgtgccttggtataccatgtacgccgttcacgaatacgccccacaccgccgcacaacccagaaaggcccccatggacaccaccttcagccacattaaagccgtgttctgcgatgtcgacggcacactgctcacaagccagcacacggtgtccccgcgtaccgtggcggcgatccgcgcactgcgcgagcgcggcgtgctctttggcctgtgcaccgggcgcgacgcccacgcgaccgaggccatgtacgagctctggggtatcgaaggcctggtggacgtgctcgtgggctgcggtggcgccgaggtcatcgaccgtgcacacggcatcaacgagctgagctacccgctaccgggcgagaccatcgcgcacatctgcgagcacatggcaggcctgccggcaacgcctgtttgccctcgggacggcgtgctctatgtgcccgagagcaatgcgtgcgtcgagcacctgtcgcgtgtcgacggcgtgccctacaaggtggtcgactttgccgagtttttgcgcgagccgcagaccaaggtgatgtttaccatggcgcccgaggtgatgccgcaggtcatcgagcgagcgtcgacgttcgccgacgataccgttaaagcggctgctctacagaccacgcagcgactctacgaattcatggatccgcgcgtgtccaagacgcgcggccttgtgcgcgcggcggagctcaacgacatggagctccagaacatctgcgtgtttggcgatgccgataacgacacctgcatggtggccgacgccggcgtgggcgtggccatggcaaatggcagcgatgctacccgtgccgccgccgactttgtaaccgccagcaacgacaaagacggcatcgcgatctttatcgaggaacatctgctgtagcgccggtggagagccaccacaaaggggacaggcacctttgtggtggccgcttgattgcaatagacactcaggtgatttagatgaattgatgcctaaaatctgcgcgcaaattcaaatatggttgtctgaacattacgcttctaaccaccgatgggttaaagatattctcatcagtttggtaggatattccttccggttgatgacctactgctcgcggtcgattttcgaccgtgagcaggatgtttgctattgaacaaaaatttgtgcaaataaatctaatgccattaaaaaataatgtgcaactaaattaccagtagaaacaaaaaatagatagcgaataaacgaaggtaaatctgagcaaatgtcaagagaattgagactcctctacaaaaatgtcggttttgttgctcagatgtctaaacaatcgttacaatatgaacattaaacgtgcgcaattacagattgcgcagatacgtttgatagtgaaagagcaagatcgcggtctcttggggaggagacatcgatgaaagcaaattcagacaaatctaagcagagtaataaagcgacgcgccgtgtactggcaggcgttttgtgcggagcatctgttttgagcctggtgctgtcgctcgtcatgcctccgatctcgcaggccattgccaacgatgcccagacggtttctgccgaggaatccgttgcgggcgaaggcgctttggacgaggaggccggtgcagacagcaccgcagataagggtaccgaaaaccagaatggtgatgacaccgagcatagccagggcgaagacgccgctacgacggacccgtctgccgatggcgcggaagccaagggcgccgcgcagccttctggtgatgaagcggatgatggagatagcatcgctcccgttgcagatgacgaaactaaatacgatattcatagtggggaagagttggcttcaaagcttcaggacgagagccttcggcttataggacaaaatgtgtgtccacgttgggggcatcggcgcaggtcgatgcctcagggaggcggggctgtccctcccggaatcgtccaaataggtgttgccaatccagccccatccccgcctcgagcggcaagaccgtgaggcacaggctcaacaggggcggcgaccggcaggcgaacagcgcgctgcacgagatcgcgaggcagagggtcatgcgcgaccccgagaccgccgagtacgccgagagggccagggggcggggaaagagcgacagggaggtcatgaggtgcctcaagcgctacgtggccagggaggcgtaccgggcgctgatgcgcccgcacgagatcaggaggcccgaggacgcctcggagctcgtggcggccaggcgcgcggcgaaggtcagccaggtgagggcggcgtccatactgggcaccagcgagaagtacatctcgatgctggagaggggccaaagggagctcaagcccataaggagggcctacgaggcatgggtcgaggccggacttccgctcgattgggacaggcaagccttcgaggccgagcgcaaaatggattctaaaaaacaccttgccaaataggagcgccacacatggtcgaggacgttctgaaaactaagcccggccccgccggacaggccacactactcgcagagcagcttagcgatctggacggcgttggtcgccgcgcccttacggatttggtcgccgcagcaccagaaggtaataccgcgcgtggcctcggggttcgagatgtcgcgacgcacgcgaccgacccagatcaggtcctggtcggacgtatccatcggcatggggaagcgatcgtgcgcatcctcggcgctcatatcgtcaaccagcttcacgcccggagcggcagccagcgcagcacgggcctcttccaccgtgatgtcgcgctcaaactcgagcgtaatgctctcggagtgcgaacgcagcacagggacgcgcacgcaggtgcagttcacgcgcagctcgggcagatgcatgatcttacggccctcgttctgcagtttcatctcctcggaggtaaagccctcctccttgacgccgccaatctgcggaatcaggttgctcgccagctgggcggcaaacgcgcgcggctcgggaatctcctcgccacggcccagggcggccagctgagcctcgagctcggccataccgggcgcgccagcgcccgaagctgcctgatacgtggacacgatcatacgcttcacgccggcaagctggtgcagcggccaggtgggaaccaggccgataatggtcgcgcagttggggttggcgataaggccgtgatgccatttgatatcgtcggcattgatctcgggcacgaccagcggcacctcgggatccatgcggaaggcgtggctgttgtcgaccacgacggctccgcgcttgacggcctcgggcagcagctccttagcgatatcgtcgccggcagcgccgagcacgatgtcgcagccctcaaaggcctcggggcaagcctcttcgatcacgatttgctcgccgcggaactcaacggtcttgcccgcggagcgtgcgcttgccaacagcttgagcttgccgaccgggaactcctgctcgttgaggcactcgagcatctgggtgcccacggctcccgtcgcgcccaaaatagcaaccgtgtactgtttcatgcttccccctttaaaggttgtggcttttgcccgcacgccgagcaggccgattattgttgccagtttatacaagaacggggcgggcacgaaacccgccccgtcgaaacgaaaccgaaacgaaacgccccgccgtagattttgaggcaactcccaaaaatctagcgagatagcagctacttgtggagcgcagccagagcgggatcgaccggcgcggaagcctccaggtcggagaccttcacaatgccgttctcatcggagaaggcacggtaaatggtccgaatcgctaggtcgaagtccttctcctcgacaccgatgatgatgttgatctcgtcgcagctctgcgaaatcatacgcacgctcacgccggcctggccaagcatgccaaacagatggcccgagatacctgcgcggccgcgcaggttacgaccgacggtagcgataagcgccagaccctcaacgacctcgatctcgagcggctcgacctcctgctggatgtcgcccacaagcgagtacagcgaatcgtgcacatcctgctcctgcaccacggcgccaaagcggtcgacgccggtgggcatatgctcgacggaaacgtcatagcgctcgaagaccgaaagcgcacggcgcataaagccaacgcggggcttggtgcggtcgcgggccacgttgatggcgacaaaaccgcgcttgccggtcacgccggtaatgatgggctctgcctcgccctcgtcagccgtctcgctaatgatggtgccggggtcctgtggcgcattggtgttcttgatgaccagcggaatgccggcctcgcgcacggggaacacggcctcctcgtgcaggacactcgcacccatgtacgaaagctcgcgcagctcctcgtaggtaacgcgggcgatgggctgagcctcgggaacaatacgcggatcggcagaatagaagcccgagacgtcggtccagttctcatacagatcggcgcccaggcacttagccaagatcgagcccgagatatcgccgccgccacgatcgagcagcttgatctggccctcacgcgtcgcgccgtagaaaccgggcataacaaagccgccctgctgaccgtactcctgcaccaactcggaggtacgattcatgctgagcgtaccgtcgtgatggaacgccacaaccgtcgcggcgtccaggaacggtaagcccaggtactcggccatcaggcgggcggtaaagtactcgccacggctcacaagctcctcggtggagtagccgcccgagcgggcgcgctcggcaaaggccgcgaactcctcacggatgggataggtgagctccagctcgtcggcaatatcaaagtagcgctggccgatgtcctcgagcagctcctcgcacgacacgtggtacttaacgtgcgcgttaaccaggtagagcaggtcggtcaccttggtgtcgcccttaaagcggcgaccgcaggcggaaaccaccacaaaacggcgagccgggtcggcatcgacgatggccttgatcttcttaaagtgttcggcgtcggcgaccgacgagccgccaaacttggcaatcttaatcatgggctggaggttacctttctaaaaagcctctgcgaacctattttgcgcgctctgataccatggtttcaccgattgggaccaaggcatccgaggagcagtgttatatgggaacttatcatagtacacgaggacgcactttatcgtgctcaagtaaggtggcaatccgcaccggcatcgctcccgacgggggtctgtttgtctcggacgagctcggcacccagcaggtcgatatcagctcgcttgcagataaatcgtactttgaaatcgctcaagatgtgttgggagtgttactgaatgattacacgaccgaagaaatttcggcgtgtgtcgacgaggcataccgcggcacgttcgcgagtgaagaggttacgccgctcgtcaaactcgacgctgcgccgggcgctgacgcccctcagacctatgtgatggagctctttggcggccccacgagcgcctttaaggacgtcgccctgcagatgctcccccgcttgatggcccgcacttccgccaaggacggcggcgccgagcgcatcatgatcgtcaccgccacgtcgggcgacaccggcaaggccgcacttgccggttttgccgacgccccgggcacgggcatcaccgtcttttatcccgagggcaaggtcagccgcgtgcagaatctgcagatgtccacgcaggagggcggcaacgtcgccgtctgcggcatccgcggcaacttcgacgacgcccagagcgccgtcaagcgcatctttgccgataaggagctggccgagcgccttgaagccgccggcacggtgctttcgagcgccaactccatcaacgtcgggcgcctggtgccgcaggtcgtctactactttgccgcctatgcgcagctgctgcgcgccggtgccatcgaggccggcaatgccgtggagttctgcgtgccgaccggcaactttggcgatatcctggccggctactacgccaagcgcatgggtctgcccgttgccaagctcatcgtcgcgagcgacaagaacaacgttctggctgacttcctgaccaccggcgtctacgaccgcaaccgtccgttcttcacgaccatctcgccgtcgatggacatcctcatcagctccaacctggagcgcatgctgtacttcctgtccgatggcgactgcgagctcgttgccggccttatggagcagctggcacagactggtcgctatgaggttcccgccgacctgctggcaaagattcagagcgtgtttggctgcggctgggccagcgaggacgaggtccgcgccgccatcaagagctgctgggacgccaacggctacgtgatcgacccgcacaccgcctgcggctatcacgtctttgagcaggtcgcccccgccgagggcgctaaggcccgcgtgctgctttcgaccgccagcccctacaagttcccacgcgcctgctgcgacgccctgggcctcgacgttcccgaggatgattttgaggccatgcgtgtactcgagcaggccaccaacacggtcgccccgacccagctcgccgagctcgagtccaaacccgtccgcttcgaagacgtctgcgacgtagccgacatggccaactacgtagagtctgcagcaaaaaagatggctaccaactaaaccccatataaggcgccggcgaaagccggcgcaccttcttttatcagatacctaccgggatgatgacgaacgtgcatagcgtgcctggctgtttagttcgtcgcgagttccgcacgcaaaggaaagcacttaatgtgctttccgtcttgcgcaggactgcccgagcagcgaactaaacagccaggcacgccaggaggactcacatgatcaagatcaccgtcccagcaacaagcgccaacttgggcattggctacgataccctcggcatggccgtcagcctctactcgcactttacctttgagcgcgccgacaagctcaccatcacgggctgccccgaagagttccaaaacgagaataacctggtctatgtaagctttgtcgatgctctggccgcctggggcgagccggcttttcccgttgccatcgacatccagaccgacgtgcccgtcgcccgcggcctgggctccagctccacctgcgtcgtcgccggcattatggccgccgccgcactgacaggccacaccgtcgaccgcgccgagctggttcgcatcgccaccgaggtcgagggccatcccgataacgtcgcccccgctatcctgggcggcgccgtctgctcctttacgccgaccgattcgctcccccagtgcctgcgctacgaggtgagcgatcgcctgcgttttattaccgtgattccgccctacgaggtacacacgagcgaggcgcgcaaggtcgtgccgcaggagattccgctctccaccgccgtgtggcagatgggccgcatcgccggtatgacgcgcggcttggagaccggtgacctcaacctgattgccgccgccaatgacgaccgcattcaggagccctatcgtcgccgcctgattcccgactacaacgccgtgcgcgacacctgccttaacggcggcgctaagaccatctggattagcggctcgggctcgaccctcatggctgtgaccgacgacaccatcgtggcaaagttcctgcaggtcaagctgcgcgagcagttccctaagtgtgatacgcatattctgacgtgcgacacggaaggcgctcaaatcgagtacctgtagacatcgccgatcggtctgtccgggccacccaggggcatccccttaaaaacgtcctcgcacttgaggcccacttatcctgctccttcggagctgcggataagcgggcctcgtgctgcggaatgtttttaaggggatgcccctgggtggccctatggcaacgtagctagcgatgtctacagggacccacgctttgaaggggcgccaggctgaaatcatggccttttattgataggggctcttgctaggctggggcacttattagaggcaggcttcggcgatgcggcgcttgagttcgtcgatgccggtaccggtctgggagcttgtgatgatcacgttctcggccgggacgttgagctgctttttgatggctgctgcttggcgggcctgctgggtgcggctgagtttgtcggccttggtgaggcagacgataaagttgaactcgttgccctgtaggtagtcgatcatgtcgtggtcgagcttgctggggtcgtgacgaatgtccaccaacgagacgaccaagttaaagctgcgctcggagtcgaaaaagtcgccgataagctcggcccagcggtcgcgctcggccttggagcgacgggcgaaaccgtaacccggcaggtccacgaaatgcacgtcatcggcctcaaagaagttgatgttgctcgtcttgcccggcgtactggaaaccttgaccaggttcttgcggccaaagagcttgttcatgatggacgacttgcccacgttggagcggccgacaaagctcacctcggggcaggtggactcggggatctgcgaaaccttgccgtagctggcgacgaacttggcaagctgatagttaatggaatcggccatggacactccttggtcgtaggttcttacaaatagacgcgctattgcgcagcggcaatgcggcggacgatatcgagcgtgatgtcacttgcgacacgcgcgtactcgaacagatcgaactcgcgctcgcaaattgcatcgtacgcctcgtcacaattatcgctgatagcgcgcaacaccaggcaatcgacaccatttttggttgcgacatgggcaattgccgcgccctccatgccgacacaatcggcatgcgtcgcctcgatagcgtcgttgcgcatggtggcgcccgtcacaaagcggttacccgtggcaatcgtgccgaccaggaactgcttggtgccctcattcgaagcgactgcatttgtcgaagcgtcaacaaacccacgctcagcaagcacttcggcggcaatatcgaccagcgcgggcgtcgagccaaactcctcgagccccggtgcggactcggcgataagcgcggtatcggtatccagatagcgcaggcgtttgccaatgaccacgtcgtcgatatggagcttggggttcaaaccgcccgcaatgcccgaaaacacaacagcctgcggagcatacttgctaatgaggtgctgtgttgcagcggcggcgttcaccgtgcccatgcccgccgttgtggcgacaactgtcaggccgtcgagctcaccgctcacaacggtcaagcctgcctcccgtgcctcgcaaacgtcgctcagctcttccttaatctgcatgatctctttttcgagcgcaccgataatcgcaatggtagccatgccattccccaaacctattcgaaattctcaaccacggtatggtaccagcattttgtttgacctcgtcaaacgaacacgctaagccagtgcagctcgcgtatcaaacagagcctttgcaatcgcggccgtaacctcgctcgagcggtcgctccacggcatcgatgtcatgatacccatgacataggtacagccatcgatgtcgataaggcccgcatcgcatgtcgagtagtaaccatcctcgctaatccagcctgccttgttgcgcaccaaaacctgctcgtccgcaatgccatcgcgaataaacgagcgcgatgttgatgccagaaggcccgacaaccactgtgaagtctcggtatccatgctcagatactcgctcatctcacgccataacctcgcagaagtgcgcgggcagtaggtcggaaaatcactcatcggattcagtgccgtttcgtcatcaacacccagattggcaatccaatcctcatagccatcatggtcaaacgccgcgcgtaacgcgataaacgaatcgttgtccgagttgacgaccgcggcctcgataaggtcacgcactgtctgccagcccatgctgtaaccaccatacgtggctaaaggcccatcgagcgacacctgccccgattcgaccaacatctcgcaaatatagagtgcatacagcgccttataactgctcgctccatacacctcaacatcggcgttatacgtcacgcccctaccactcgataggtcgtagaacactacacccacgtcgcccagctcctgcgcccgacacagggcatcctggagcgaggcaaggctctcatcctccaaggcaggagtcttgttatccaccaacgagaaggtccgaacggtatcacccgaagggatatcgttgaagtccgccttcgaaagtctcgtcttgagatctgccgtcgacagagcttgatctgccgacgctttggactttgaaaccttctcgttttgcagctgtaccgttgacgcatctgggcgccccgttcgctccgaggcgtaggttttaacggtaattccgaggataataaccgccgacgttagcatcccaatagcggcaatcttcctcacgcggatgcgagcgccggcaaggccacgcgaagacgtgcccttcgtcttatatctgctgccatgctgcggcacatactcgtcccgcgatgcgatgtttcgcacgtggtctcctgactgccaccgtttatatacgagcagcatgataccgagcaggcatttctttccaaagatattcagcagcgtttaaggtgtctttaaagaaaccacaagcgtatttatccaaatggcacgattctgttgcgcatctctacccaaaacgaagttgcggtgaaatggttcctgtttgggcgacatgggcctaaaaacaagaactattccaccgcaactcagctgggaacgaggggatatgagggctatggcatgctatccgatagcgtttttgagctccgcacggcgctttttcataccggccataacggcattgcgcagctcgggcatgcgcgcggtatccatctggggcacgccctcgagcttatagggaatgcccagttgctcgtacttgacgacacccatcgtgtgatacggcagcatttccaggcccaccacgttgtgccatggagcgatgaggcgaccgagcttctcgcactcctccgccgtgtcggtaatgcccggcacaaccacgtggcggataacgaccttgatattgcgacgtgcaagctcatcgccaaacgccaggatgcgtgcgggatcacaaccggtcagctttttatgctcgaccgggtcggcatgcttaatatcgagcagtaccatgtcggtctcgttgagcacggcatcgaacttctcgggatgctgagggtcgaaggcgtagccacagctatccaggcaggtatgcacacgaccatcggggttgttgtgcattgcacggaacaggtcggccaaaaactcgggctgcagaagcggctcgccgcccgaaacggtaatgccaccgctgcggtaaaactcatggttgctctggaactcgtccatcagatgctcgacggtcaccatggtgccgccgttaaccgaccaggtatcgggattgtggcaatacgcgcagcgcatgggacagccttggacaaacactacgaagcggatgccgggaccgtcaaccgtacccatcgtctcgatcgaatgtacgcggcccagggcaaacgcggagtcctcgggacgagcgtccacaccctcgagcgtcatctcagccattcccgctaccttgcctctcattggttttagttacataaatgccagagccattctagcccatacatatgatggcgaaacggtttagaggtcaattaggtcgtcctatttgactccacgcaaaagcggcgggagggttatcgcaacccgcccaccgccgaggcaatagaaatcgatagactccaggccttacgccttaagcgtgagcaccgcgccgaaggcggtcgggccgcaatggctcgagatgacgccgccgacctgagtccaggtaatgtccttaaagccaagatcgtgtgcatagacttccatgtcgtcgcgcagctcctcggaaagacctaccgaatacgccaggccaatgtgcgagtagtcaatctcgcccttggcaaccatgtgatcaataaaggcgcgggcgcacttgagcatagagccgcggaacttcttggttgccacgaacttgccgcccgttacctcaatgcagggcttaatcttgagcagatgggcgcccaggaacgcgacgttggacaagcgaccgcccgccttaaggaaggcaaggtccgtaggaacaaagcccaacagcacgcggtccatgacggagttcgcgaaggcgaagatctcgtcgacggtggcatcggggtgagcctcgatgtatttggcggtctcgacgacaacaagcgactggcctaccgagacaaagcgcgtgtccatggagaacacgtagtcgcgcccctgggccgcaatctttgaggactgatgcgaacaggtcgtggcctcggaatatgcaagatgcaaaatagtcgcgtcgggctgctcagcgtgaatgcggtcgtacacgtgagcaaaatccgcaggcgcgcagccactggtcttgggcatcacgccaaactcattgcagcgcgaataaatctcgagcggatcgatcgagccgtcctcgacggtctcgtcaccaatcgtgacatgcatgggcacgcgcacgatgccgtagcgctcgcagagctccggcgtcacatccgacccagactcgaccacgattacgtacttgcccattaatatcacgacccatctcgacattggcttttcaatacatggcacgcaccgccgcactgttgcacaacggcgtccaagcgccaaagagacgccgccccttgcacacaacaaaggacagcgtctccctggaaaactccgtgcttatctgagattctacacggtttattaaggagtgttacttattccgcaaacggtagctatacgcgatgaacggtagttcgctgcagcgactgcgacacattccgcccagcaagtccaatcgcgctccacacacggttaatgcgcgaggcggtagaaatccatcgacgccgcaccctcggcatgcaaccccatcgccggaaccgccggcgaataggtacggctcgtaagtgccgcctcgccgccatttgcaaaaatctcgaccatcgtagtgtccgaaagcacgcgcaggtcgcgaagctcgctgagctcgatcgacctctggtcgcgcccatagccttcgtcacccatgtcgagggtaagcatcccgtctgcatagcgcacaaagacacccttgcggatttcgagctcgatcacctgggcgccctcacaggaaaccacaagatcaaacaggcggcccggctcctcaacggtttcaccgcctgtcgcgcaaacgcagtcgccgcgcatcctctcaatctcgtgcaccggctgctgacagagcttaccatcgcgcatgctcagttctctcggcaccgtcaacgcgcactgccacccgcgtgccaccgtcgggctttttgccgtcgcatcggggcaacccgaccacccgatcatcaaacgccgacccgcagcatcctcaaaagactgcggtgcgtagaaatcaaagccggcatcgaccatcgggggcatgccctgcccggcgatcttaaaactcggcgcctcccaatcggcctcgatgggaaaccacacgcactggtgcggattgcggtaacgccatccatcggcggacacaccctgcggacagcaaacgagaataagctcaccatcgagctcaaacagatcggggcactcccacataaagccaaacttctcgcccaactcaatgcgcgtcgcatagctccagtcctctagatcgctcgaggtatagacaagcacgcagccgcggtcgtctttcgtacgagcgcccagaaccatgtagtagataccatcgtgttcaaggattttgggatcacgcacgtgcgtaccgatatcgtcggggtaatcgaccggcccaacagctatgcgcttctcgcccaattcgtcggggttctcggcaaccacatgaatctggttttgctcacggcccgtcaacacgtagtcgtaatcatcgcggtcaaaatgcttgacgttgccggtatagaagtagtgaatcttgccgtcgtgtacaaaggcagaaccagaatacgctccgctcgaatccaaatcggaatcggggaacagcacagggccgcgattctcgtacgtcacaaaatcctttgttgtcagatgattccaaatcactggaccgccatgcgcagcatcgaatggatcgtattggtgatagatgtgatacgtatcaccgatctgcaccaaaccgttggggtcgttgagccagccaagctcaggctccacatggaacaggagcctatcggggtcggacgcgatgcgacccgccgtctcatcctgtccggcacgccactgctcatagtccgcgcgtgtcaccttatttttttgattaaacatcgccgttgactttctcgtctatggggaaggacgctcgactcacacgagtcgaacgcccttccccaaatggacttatcctcagattacgctgaacggctcaactagaagctgacatcgaagccagcaccagcgccctcttcatcagtggtcggcacgccctttgccttgttgtaggcaaagatcaagacgatcggcacgataaaggcgatgagattgccagccacataccacacgagcgtctcgggcgtgacgatgagcaggccaagcacgccggtcagaccctgaccgatggcgcgcacctcaaagagcttcacgaaggcaccgccgcagcctgcaccgatgcaagcgcagatgaacgggatgatcgagtagcgcatgtttgcagcaaagattgcgggctcggagataccgaccagcgtcgggataaaggacgacatgcagatgttgcgctctttggaatgcttcttgtgaatgaggtacatgccgatggcgccaccgccctgggcgatgatggaaaccgaccagattgcctggatgtagttgaagccagtcgtggcaacgaggttggcctcaataccctggatgaactgatgcgtaccggtaacgacgagcggctgcaggaacgcggcaaagacaaaggcgccaaagacgcccatcctgttgtacaggacatcgattacgccagcgaggacgtcgccgatcaggttgccgagcgggccgaacacggtgaacagggcaacgttagcaagaatcagggtaacggtcgggacaaagacaaacgagacgacctcggggatgtacttctgggcaatcttttcgaccttggccataaaccaggcagtcaggattgcagggaacacgccgccctggaaagcaaccatggggatggagagcggaccaaagttccagtactcagcacccgacggatccataacgaacgcgttacggttcataaggctcgggtgaaccatgacgataccgacgaggatgcccagaatcgggttaccgccaaaacgcttcaccgcgctgtacataaccaggacaggcaggtagtcaaacgtggtggcgataatggcaaagaagcttgcgaggttcttgaggaactcgctgtggtcggcaaggctgccctccatgccaaagaggccgttggcaacgatcagcgacttaaggccgatgatgatagcagcgccgacgaaagcgggaatgatggggataaagatatccgagaataccttgaggaccgagaagaacttgcccttcttgtccgcctcggcgcccttgacctcggaagcgctgatctccttaacgcccgtcagagccataaactcatcgtagaccttgttgacggtaccggtaccgaagatgatcatgagctggccgctgttgtacagcacgcccttgacgccatcgatgttctcgagctcggccttgttgtacttgctcgtatccttgagcaccagacgcagacgcgtaacgcaatgcgtggcgccctcgatgttctccagaccgccgacgttatcgacgacttgctgagacactactttgtagtccatgttcctctccattcccttacgaaatcataaaacgttttgatgccattacagagacgcgatcgttgcatttgcgcacttgagcgtaccgtcggtgaccgtcagtgccacaccctggccctgcttattgcagaagcgcgcgttaagcgcaacatcatcgacaaagatggtcgcgatatcgtcgtcaacgaccaggcgcacatgatgagtgccctcgcccttaaagaacaacggacgctcgaggcccatgttgttgacctggaaccacggatactggggggccgccgtaaactcgagcttgccctcacgcaggttggcgcggaactcataggcaagaccggactcggcgtcctcggcaagcttcaccgagaagccggcagcgtcaccggcgagctcgatgtcggcatcgagcatataggtggaaccggcatccgcggcgagcacctgctcgaccttgcccgactcgcaggaaagctcaaaggcctcgactgccttagcctcgccaaaggcgccaagcatgctgtcagggagcttggtgccgagcgttccgtcggcacgctgaacgatctcgagaggcataaaggtgccaccccacaggtaagagctggggtcgccgccctcgtcacgcgtaggaacccaaccaaagagaacgcggcgctcgccatcaaatgcggtacgcgcggcatagtacgcgcggccatcgaaggaatcgtccgcaggagtgatccaaggaccgttgatagagcgagacatgcggtaacgggtcttgttgccatcactgtactcggagaacaccagataccaccagtcgcccatcttaaagagatcaggcatttcgaacatggtgtacaggcccggattccaccagtcgccctggaactcccaggtatccaggtccttggaggtgaacttgaccagacgaccggtcatcagacgcttgtcctcgcccacacgcgtgccgaggatgagcatgtactcttcgttctcctcatcccaaagcacaaagggatcgcgccagttgcggtcatcgtaaccctcctggggcggaagcagcgtctcggcgatgttcttctcccacttgacggcgtcgtcactcgttgcgtgaagaagaacctgcttcatcaagcgtgccttgaccttatcgcgattgcaaccagtgtagagcgcatggtacttgtcgcccaccttaaacaccgtgccggcataaacatactggtcgacttcctcgtcgccgccacgctcaaggctctcgccaaagtctttgtaattgacgaagtccttggttgtcgcgagtgcccagccaaacggctctccgaaaggtccggggtttcgcgtgtcacgctgatgatagagatagaacgtgccgtcctcgccgtacggcatgatgtcgcctacccaaattccctcaggctggtaatacaccttgtgcatccgagacttcctttctcacgagatactaactcggtacaactgcaagatatgtcaatcgttttcatatgtcaaacgttttcacaccaatacgtcttttcgcagttccagtcgtcggcaaacggttgacatatgccggcgaacggtcatcagaggtgtttgaggaattcttttggcacgggatgaactacgcggttttaccctcaatgagttcaacggggagcttgatattcgattcgggcttttcgccgttaataagagcaatgatggattgcgccgcgagctctccgatgcgatcgatatcttggcgaacggttgttaagtcaggcataaacgtcatagtgcggcgggcaccatccgcgcccacgaccttaatatcgcccggagcgctcaagccgcgctgcttcatcacgttaagacagatagccgccatcgtgtcgtctcccgcaaagatgccgtcaatatcggggttctcatcgaggatcttcgcaacgaccgcgctcttttcgtcgtcgggcttaacgaactcgacctcacggacaagcgcgggcaaaccggcctgctcaacaacatcgaggtaggcatcggtacgcttattggcaggcatgcgcatgcggctattgctgcgcaggcacaggatgcgcgaacacccgtcatcgatcaggcgacgcgtggcaagttcgccgatactatagctgtcgctcgcaatctgaacagaggcctcgccaaggtcgcagtcgataccaaccagactcaaacccatctcggcatacgcctcggcaccgatattaagcgagttgacgatgacgccatcaaccatattgcgtcgaagcatgtcgatataagagcgctcaagctcgggtcgattggcgctattgcacagcagcatcttaaaaccgttttcggccagggtatgctcaatgacttgaaccacttgggcatgaaacggactgctgacataggggacgatcataccgataagattcaggcgaccgttgagcatggcacgggcgatatcgttgggcgtatagttgatgcgcttcatcgcggcatggaccttatcgcgggtctcttggctaatatagccgcgattattaagcacgcgagataccgtagtaggcgaaacccccgccaccgccgcaacttccttgatgccaggcttagccgtatccttagaacgagcactctcgcgagccatagcaccctcccccatcaacatgtcatacgtttacatacgaacaaagcataccccaacaagagcgggaagacggtaacagtacaagtaagtaaacgactcatccaaataattaggagagttccgcctaaagggtgactccaaaggaccccacatggccggttttgggttattttccaaaacatcccgcaggacgcaaagaggctccgccgcgcaacgcgcgcagcggagcctctttgcatgtccgaggacgttttgggaaataacccaaaaccggccccagtaatcctacaggagttgaaccctttagaacttgtcgtggaaggtacgcgaaatgacctcgtcctgctgctccttggtgagcgtgtggaagttcacggcatagccggaaacgcggatggtcagctgcgggtacttctcggggtgagcctgagcgtcgagcaacgtctcacggttgaagacgttgatgttcaggtggtggccacccttctcggcgtaagcgtcgagcatgtggaccaggttatcggcctgagtctcggaaacttcagaaaccttcataatgtgtctccttcgattaataggcgccggccgaaaccggcgcgctaatcagtaatcgttattgttagtatagcactaacaatagttactcgcccagctgatcaaggtcgatatcgccaaagaacacctggtcctccttgccgagcgcactcgggatgatggagaaggtgttggagatgccgtcctgagcatcgcggaacgggagcttggaaaccgaagacagcgaagcgatggcgccgtggctatcgcgcttgtgcatggggttagcacccggggcgaacggctggccagccttgcggccgtcgggcgtggagccggtcttcttaccgtacacgacgttggaggtaatggtcagaaccgaggtcgtaggcacggagttgcggtaggtatcgttcatgcggatgtactccatgaactggtgcacaacgtcgtgagcgatctggtcgacgcggtcgtcgtcgttaccgtacttggggaactcgccctcggtctcgaagtcgacgatgatgccgttctcgtcacggacggggtggaccttggcgtacttgatggcggacagggagtcagccacgacggaaaggccagcgatgcccgtagcgaaccagcggtgcacgtgcttgtcgtgcagagccatctggatgcgctcgtagcagtacttgtcgtgcatgtagtgaatgatgttcagcgagttgacgtacacgccagcgagccacttcatcatgtcgttgtacttggccacaacgtcgtcgtaatcgagcgtatcgccctcgacggcgcgatacttggggccgacctgcttcttggagacctcgtcaacaccgccgttgagtgcatacagcaggcacttggccaggttggcgcgggcgccgaagaactgcatctccttgccgatgcgcatggaggacacgcagcaggcgatgccgtagtcgtcgccgtggtaaacgcgcatgaggtcgtcgttctcgtactggatcgaggagctggcgacagaagtcttggcgcagaacttcttgaagttctcgggcagacgggtcgaccacagaacggtcatgttgggctcggggctggtgcccatgttctcgagcgtgtgcaggtagcggtagctcatcttggtaacgagcgtacggccgtcgacacccatgccgccgatggactcggtgacccactgcgggtcgccggtgaacagggcctggtactcgggggtacgggcaaacttgaccatgcggagcttcatgatgaagtgatccacgaactcctggatctgctcctcggtgaaggtaccgttggcaaggtcgcgctcagcatagatgtcgatgaacgtagaggtacggccgatggacatagcggcgccgttctgctccttgacggcagcaaggtaggcgaagtacatccactggatggcctcctgcgtgttggtagcagggttggaaatgtcgaaaccataggtctcggccatcatcttgagctcgccgagggcgcggatctgctcctgcagctcctcacggtcgcggatgttgtcggcggtcatgaccgtcggagtggaagccttctgggcctccttgtccttgatcaggtagtcgacgccgtacagggcaacacgacggtagtcgccgatgatgcggccgcggccatagccatcgggcagaccggtgatgatgtgagccgagcggcaagcacgcatctcgggggtgtaaacatcgaagacgccggcgttgtgggtcttgcgctcaaaggtgtagcgctcaacaacgttctcgtcgaccttgtagccgtgctggctggcagcctggcaagcgatgcggataccaccgttgacgtgcagcgcgcgcttgagcggcttgtcagtctggagaccgacgatggtctccttctcgcggtgggcgttatcgatgtagccagcggggtggctcacgatacccgtaacggtcttggtgtccatatcgaggacaccaccctgctcgcgctccttaagcagcaggtcgagaacctcgccccacagctccttggtacgctcggtcggacctacgaggaacgactcatcgccctcgtagggggtgtagttcttctggatgaagtctcggacgtcaacctctcccgtccagataccttccttgaagccttcccatgcctcctgcattgtgtaaccacgctcctagttacgtgtaatgcggcgctctctcacaccgctacttattgaattcttgaattatcggcttgcactaccggcttcttccgttcttcaccacacgttggtacagggaaaaacgtttgtccaccttggaactgcaacccaaaacccaagatttcacccgtttgagaaggataacatagccacccccttcatcagggctgttatatgtttctttttttataccattagggcatttttaacaaatccgcaggaaatgcgagcgtgaacaactaccgttcaccgatttgtttggttttttccttgcctttgtacgacgttcactctagctgttatgccagctttatcagggtaaagtgtcccaaagaccctacagaaactgcagggcggccacgggatcccccgtggccgccctgtggcgtagctagtttttagctttgattaccgtttggcattaggcggctgcggaggccttgtcggtcgttgccttgccgttgctctgctggccctcaaaatgcttgtagcaccagctggtgaccagcggggtcaaaatagccgtaacgattgcgcaggcagcaacctgtgccgtggccgtcgcgagcaccgcgccgccgtacatggcctcgttgacgcttgccatggcagcaggcgtggccacattggctccggcgcagctcgaaatggccgcacctgcgacacccgtaccgcccgtgagcttatcgaccgcgatgacgggaattgcaaagatcaccgagcagatcacgccgagcaggatgccgggaagaccgccgttgataagctggccaaaagtcatggtcgagcccatggcaaagaagacgagcacgatgatggcggaaagtgccggtgccatcatcttcttaaagctggggaacaggttacccagaataatgccgacgacgatcggcagaatggcgcccacgagcgaccagccgatcggggcctggccggcagcgccgagcacgatcatcgtgaccggagggccgacaaccagcgtggtgatggcgacagcgccacgctcagcctcgttgcccatggtacccatcagcccagcgtacatagcgttgttggcgccggtgcaagccgccagcatcaccatggcagagatgccaaacaagttgtcgttgaacacataaaggatgagcagcgacatggcaacgaccacgatctgcttgacggcgatgatgatggcgccgcgggcagcggcggcaggagcgctcttaaacgaaatcgtcgtaccgacgatgagcaaaaaagcgcccacgagcgggccagcgccctgctgggtcatgccaagcgtaaagctgccgagcgttttgaacaggtcagggaatagcgtgttgagcaggcagcccagcaaaagcggcaccaaaatattggcacccgggatggaggacatcttaaagaacggctcctttgccgccggcgcctccaccgcagtcgattcactcatatatatctcctttggatgcatgcgaatcgtagccgcacgcgcctatgtcagaaagaaggcgacggtcccgagtcgcaggagccgtcgccgaataatcgtcgcggggtattacccgtccaggacgatgccgccgtcgcagtcaccgatctcgccgttcacgaagctggcgagatcggaagcgaagaacagcaccatctgcgcaggctcgctggcctgggcggcgcggcccagaggaataccgttgatgatgcgctgagagttctcgtcagagagaatcgaggtcatatcagtaagggtgagcgacgggcacacggcgttgcagcgaacgccaaacttgccgccttccttggcgactgccttggttagaccgttaacaccggccttggagctcgcgtaggccgcggtgccgagcaggccaccgccgatcttgccagcaacggaactcacgttgacgatagtgccggcatgggccgccttaaagtgcgggtacacggcgttcatcatggtaaaggtgccgttgaggttgatgtcgatggtgcgacgccactcggtgtcatcgatctcatcgaacttcttggtgctgatgacgccagcgcagttgatcaggatgttggtttgcggcaggtccgtaaaaatctgctcgacagtctcgcgcgccttgggtgcatcggcgacatcgagctgatagaacttgttgccctcgccaagctcggccaccgcggcctcgcccttagcagcgttccttgcgatgagcgcgacatgtccgccgcccgcgacgatgcccttggcgatctcgaggccaatgccctgagtgccgcccgtgacaatcgcggtcttgcccgtgaagtcaaatgccatgactccatccccctttatataaggtgtctcctcgcgggaagttggagcatcgcacgtggcgattatatgagtcccagtcgtcatggtggtgacaacccctcgcctaaccgcgtgcataatagttctttgaaacgctacaattattgaattattttaattctttatacgctctttatattacctagcaaccaggtattttttttgggacatgcccagagatctacccctaactttgctgataccgacggtgtacggaggtcgcctaaagattgttttctaggcatgacccaaaaatctaccgtatagggtgcgcgtgcaagggtatcatctttcaccggaaatagtttctagtgttaggggttttcgatggaagataccgatttccatgagcttgggcgtcagctcttaactgagtttggcagcatgcatcagcgaatttcgcgctttgcggacaaagctctcggcggcgagatggccgtcatgcgcgccctcatgcgcgccggcggctcactcacaccgagcgaactcgccgatcgtgcctgggtttcgagcgcccgtatcgccaatatcctgcgcgccctcgaggccaagggttgggtcgagcgcgagcactcaaagaccgaccgtcgtcgcgtacacgtcacggtgaccgacaagggattccaggtcatcgaaatcaaacgccgggaattcgaggaccgcaccgcggccttcctcgagcagctcggcgaaacagatacccaagagatggtgcgccttctaagacgtgccaacgaaattatcgaccgcaatcaagaaaggagagatgccgagtgaggattctcaagctctttaaaaagcatatcctggcactactcgcagctatcgtactcatcgtaatcagctgcaacgccgatctggcgctgcctacctatatgagcgacatcgtcgacgtgggcgtgcagcaaggcggtattgcctcgcccgtgcccgacaccattcgcgccgaatcgctcgacgacctcgaactctttatgagcgccaaggacgccaaggctgtggaggccgtgtttagcaaggctggcaaaaacggcattcgagcgtacaagggcaccgaggaagagcgtgccgatggaggcaagattgccgacattatgagcctgcccgagactgtcgtactttcgttcaaccagggcattgacgccgactccatgggcgacatgaccggcacgtccggcgaaaaagacagcgacgccgcccaggccatgcccacccccgagcagatggcggcgatgacgcccgagcagctcgccgagatgcagcagaaggccgcagcggcgcagaacatgcaaaagcagattgatgccgacggcggtaagatcaccatgaagagcctgcgcctgggtgtcgagggcggtctggtagaccaaagcaagctcgtcgagggcgccaacgaaatggcggataaaatgggctccatgtcgggctccatcgtgacccaacgcgccgtgagctatgtgcaagacgagtacaaggcgcagggcatcgaccccgccgacgtgcagaacgcctacctgggccgcatggcgaccacgatgtttggtctgtgcctgatctcgctcgtcgccaccatcctgaccggtgccgtggcttcgcgcaccgcctgctccatcgcccgcgacctgcgccgcgagaccttcaacaaggtaatgcacttctcgccggccgaggtgggcaagtttagccaggcctcgctcatcacccgctgcaccaacgacattcagcagatccagatggccgcaaccctgtttatccgcatgtgcctgatggcccccgtcatgggcatcgtcgccgttatgcgcgtcctggccaaccacaccggcctggagtggaccatcgccgtggccatcatcgcggtttcggccgttgtcggcgtgctcatgggcctcaccatgcccaagttcaaaaagatgcagagctttgtggaccgcgtgaaccttaccgcccgcgagctgctcgacggccttatgcccatccgctcgttcaaccgcgaggaacatgagctcgagcgttttgacaaggcttcgctcgacctgatgaccacgcagctctacaccaaccgcgccatgagctttatgatgccgctcatgatgcttgtcatgaactgcatcaccgtgcttatcgtctggtttggcgcgcagggcgtgtccgacggcgtgatgcaggtcggcaacatgatggcgtttatctcctacaccatgcagatcgtcatggcgtttatgatcctcaccatggtgtcggtcattctgccccgtgccgaggtcgcagccgagcgcgtggaagaggtcatcacctgccccacgagcatcaacgaccctgtctcgcccaaactgcccgcggccagcgcgccgcgcggtgagctcaccttccgcgacgtgagcttccagtatcccgatgcccgtgccgacgtcatcagcggcgtgaacttcaccacgcatgccggtcagatgctcggcatcattggctccacgggctcgggcaagtccacgctcgtgcagttgattccgcgcctgtacgacgtcacgggcggcagcatttcgctcgacggcatcgacgtgcgcgacatgaccctttccgaactgcgccgccgcattggttacatcccgcagcagggtcgcctgttctcgggcactgtcaagagcaacctcaagtttgccggcgacatggtaagcgacgatgacatgcaccaggccgcgcgcatcgcccaggccgaggactttatcgccgagcgcgagggcggttacgactcccccatcagccagggtggctccaatgtttcgggcggtcagcgccagcgtctggccatcgcccgcgccctggccaaaaagcccgaggtcgtggtgttcgacgactcgtttagcgcgcttgactacaagaccgacgcgcgcctgcgcgaggagctggccaaaaacgtcaccgacgccgcgctcgtggtcgtggcacaacgcatcgcgaccatcatgcacgccgaccagatcatcgtactcgacgacggtcacgtagtgggcaccggcacgcacgaggagctactgcgcagctgcccggcgtacctggaaatcgcacagtcgcagctttccgccgaggagctggggcttacccaagaagaaattgcagccgttacggaaggaggcgagcactaatggcagacgagaccaagacccaaattcccaagcccacccgtcagcgtggacccatgggccgcatgggcggcatgcgtcgcggcgaaaaggccaaggactttaagggcaccatgaggcagctgctcggctatatcggccagcacaagattgccgtgtttgccgccgtcgcctttgccgtgtgctcggtcatctttaacattgtgggacccaaggtgctcggccaggttacgaccaagctgttcgaaggcctggtcgccaaggtcaacggcaccggcgacgttgactttgactggatcgccaagacgctcggctttttgctctgcctgtatctggcgagctctgtctgcagcctggtccagggctggctcatgaccggcgtcacgcaaaagatctgctaccgcatgcgcaaggaaatcgccgccaagattgccgtcgtgccgatgagttacttcaacggccacagcaagggagacgtactcagccgcatcaccaacgacgtcgatacgctgggtcagtcgctcaaccagagcgtgacgcagctcatcacgtcggtaacgcagattatcggcgtgctcgtcatgatgctttcgatcagcctgccgctcaccggcgtcaccgtgctcacgctgccggcagccgcgattatcctgaccgtaatgattcacttctcgcagccgtacttccgcgagcaacagcaggttctgggcgccgtcaacggcattatcgaggaggactttgccggtcaaaacgtcattcaggtgttcgaccgcgccgaggtctcaatcgaggagttcgaccgtcaaaacgaccgcctgtttattagtggctggcgttcgcagttcctgtcgggcctgatgatgccgcttatgagcctggtgggcaacatgggttacgtgggcgttgtcgtggtgggcgcgcagctcgcgctgaccggcaatgccacgcccggcgacatccagagctttatccagtacgtgcgcaactttacgcaacccgtgcagcagctgggcaacgtgagcaacacgatgcagtcgatggcagctgccaccgagcgtgtgtttgagtttttggccgcacccgaggaggagcagaaggccgacgcgcagatccctgagaagcgccccggccacgtggagtttgaccatgtgaagtttggctacacgcccgacaagaccatcatccacgactttagctgcgaggcgcagcccggccagaccatcgccatcgtcggccccaccggcgccggcaagaccacgctcattaagctgctgcagcgcttctacgacgtggacggcggctcgctgcgtgtcgagggcgtcgatgtgcgcgactgggaccgcgcggcactgcgcggcgagtttgccatggtgctgcaggacacctggctgtttaacggcaccatccgcgagaacatccgctacggacgccccgacgcgagcgatgccgaggtcgaggccgctgcgcgcgccgcacgctgcgaccactttattcatacgctcgccggtggctacgactttatgatcaacgaggagggcaccaacctgtcgcagggtcagcgccagctcgtgaccatcgcccgtgccattttggccgaccgcccggcactgattctggacgaggcgacttccaacgtcgatacccgtaccgaggagcttattcagcgcgccatggatgcgctgatgcagggccgcaccagctttgtcatcgcgcaccgcctgtccacgatccgcaacgccgacgtgatcttggtgattcgcgacggcgacatcgtcgagaagggcacgcacgacgagctgctcgcccagggcggcttctacgccgacctgtacaactcgcagttcgacgaagcggcgtaaaaaccggcggcaaacaaccgcaatgccaagaaaacgggggcgcaggacaacctgcacccccgttttgtgtccttcgagcctcgaaacgccttccctgagacctcactgacggcgctttccagaccccgtgggcaaaaaagggcaaatatgagtactgttacctttttagtaacagccaaaaccgcctcaaatgccgctcccacggcttacacgcgtccctaaattgatcaaacaacaccatagcggacttatatgtgtttgcgttaatgaacatattttgctgttatgtctattattttgcgaaggcaatatgatactaagatagcaaccgtactcatatttggcattttttgcccacagggtatttcctagggaaccgacaacagccttagggtcccgcgcggcgccgctccctcccggcatccgccgacgtttgcccagataaaaccgaccaaaataaacctgtccctttttggtcggtttcggggtgacaagggcttgcactttagcgtgcgacagcggataatgccgaacactcgacaatacgcttattgctctttctatagattgaggaggcccctatggccatggaattcaaacgcaggctgccgatccccatggagatccgcgaggaaatgccgctttctgccgagcttaccgccaaaaagcaggcatttgacgccgaggtcgccaaagtctttaccggcgaggacgcacgcaaggtgctcatcatcggcccgtgctctgccgaccgcgaggattcggtgcttgagtacatgaaccgactggccaagaccgccgaggaggtcaaggacaagctcatcatcattccgcgcgtctacaccaataagccgcgcaccaagggcaccggctacaagggtcttctgcacaaccccaaccccgaggctcccgacgacctgctcgagggcgtcaaggccatccgccacatgcacctgcgcgtcatcgaggagaccggcttctttaccgccgatgagatgctctacccgtccaactaccaatacctcgttgacctgctgagctatgttgccgtgggcgcacgctcggtcgagaaccaagagcatcgcctggtgtcgagcggcatttcggtacccgtcggcatgaagaatcccactgccggctctaccaccgttatgctcaactccatttacgccgcccaggcgcaccagagcttcatcttccgcaactgggaggtcgagtgcgacggcaatccgctcgcacacgccgttatgcgtggctacatcggtctcgatgggcgcacctaccccaactaccactacgaacacctggaacgcttggccgaacgctataccgagcatgccggctatgccaatccggcagcggtcatcgactgcaaccatgacaactcgggcaagcgtccgctggagcagtatcgcatttgcaaggaggtgctcgacagctgccgccgcaacgaatccatctccaagctggtcaagggctttatgatcgagtcctacctggaggacggcaaccagccggtcgacggcggcgtctttggcaagtcgatcaccgacccgtgcctgggctgggaaaagaccgactacctcatccacgagatcgcggaacgtatttagctacgcggttttaccaaaccgcgtaacggctcgacgctgcaaacccgccagaacggcaatctgcctttcaacttcggcggcatgatcaaaagatcaatgccgcctcgtttcaaggcaccttgctcgctctggcgggttttcgctgacgtttttcgacctgcattgttgccagggttggcaccaatgactaatgcgatagctagctacgtcggtccgattgatcggctgggtttccgaggtgcggcagattcccgcgaaagaggagggcatagaccttaagggtcatgcccgacgattgaagggcaaggtgccgtgcctcgggaagacagacagttacgccgagggctcctgctgcgtaatgcagtggatatttccgccaccgaagacgacctgctcggactgaacgccgacgcacttgtagacgccctcgccccagacctcgtcgtagatcttctggagcgtgtcaacggcaagctgatcgttctcgtcgccgtactgcgggacgataacgccgtggttggtgaccaggtagttcatgtaggaggcgatcagcggctcgttggcaacgcgcggctcggcgttctcgtcggcgtcgatggtgtcgcaggaagcctggtccatgaacagcgggttcacaggcatgcagagcttgtagaccttcatcttgcggcccttggcgtcaacggcgttggaaagggtctcgtagacagcatggcattgctcgtagaacggatactcgggatcgtcggtccagatgcaggccatgacgcccggagcgatgaacgtagcgacatcatcgatgtggccgttggtctcctcggggtcgatgccctccttaacccagatgaccttctcgacacccaggtaatccttgaggtgctcgtccatataggcgcgaagttcctcactccagggctcaaacttcttgtggaacttgggccagatggactcgggatcctcttcctcctccagaaccgcagagcaggtgcggcccggggaaagcaggcactggtcggtcacgaccacggtgccttcgccgtcgacggtaatggagccgccctcgaggatcatgtcatcgggacgatagcgacggcagccggaaagctcagccatcttaagggcaatctgctcgtccttgtcccacgggaaatagaggccgtcgacgaggccgccgtaggcgttgaagtgccagtggttggcgcgcttatcgcccttgccattgataacaaaagtggcagcggtgtcgcggaaccaagcgtcgtcggtggtcatctcgataacggtgacgttctcgtcttcctcaaaggcggccttgcagttggcgtagtcggcctggtttgcgcacatggtgaccggggtgaactcggcgatggcgcgagcgatggcggcatactgcttctgagccggcttggcgccgtgggcccaggtgtcggtgcggtggggccaacccatccacacgcgatcctgcggagcgaactcagcgggcataaagaagccgtcggccttaggggtggactcggactcggtgatcgtacgcataagatttcctccaaatcgaacgatcgcttgctgcgggcgggttaccctcagcctaaaaccaagagatggtaggcgcccattccccggcaaaggtcggggcgcctggcaccggttttcacggatgtcgcaccggcaagcgacgacgtaacccggtgcgcggagacaaaacgcacgaaggatacggaagagagattggggcgggcggtggttaccggagcaatagctcacacccacctcagagaaaggttagcaaacctgttgcttgggcacgcctccgaagaggctagagcgtcccgagtcgggagcgacaagcccgacgaagcgtacgttggtacgcgaggaaggttggagccccgaatccgggtgctctagtcctcctcggactcctcagcgaggcgctgagcagccagctcgggagtgagacccttgtactcggtctcgcggcccttagcactgacgacgcggacaacctcgccaataagcaagagcacgatgaagatgacgatcatcgggaccttatcgccaatctcatcgacagagaacggaatcagcgttgcaacgatagccagaatcagctcaatgcagggaatagccagcatgaccttcatcatggcgcccttaaacgggaacgtaaagatacgctcacggttggggtcgttcttacgaaggttgaggaatgccgggaacatcgggatgtaggtcagcagcaggaagacaacggaggtaccgaagagcatccagaagacaccgttggagatggcgtcgatgggaaccagctgcaggcacagcaccagggaggcaacgatggcgttgaccaggttggcgccgttgggcatgtcgtcatccgagatcatcgaggcgaagaccttgggcatgttgccatgctcggcagcatagcgagcgacggagttgacgccgaaggaccaggcagccatgttggcgaacagcgtgatcaggaaggcgatgcagatgaccttaaagatcatggaatcgcccacaatagtctggacagcgtagatcatgccgtagtcgggatcgatggaatcggccgacacagcagcgccgatgccaaagccagcgaacaagtagatcacggcgatggacaggccgccgacgatgatagccttggggatatcgcgagcgggatcggccatatcgtcggtcatggtgcagatgacctcgaagcccatgaagttaaagatgatgatcgacaggtagccaagcgcgttggtgttggtgagctcgggcaagaaggtggcagcggacatatcgttcgcaaagccgttctccatggcgtaccagatgcccaaagcgccgacgataacggcaacggcaaccttgatgatggcgccgccgttcaggacccactcggagtcggcagccttggagcgacccataagatagacgatccacacaaaggcaaggtcgataccaatcttggcaatcagattgaactcgacgccaaagaccatgcccaaaatgtccgggaacatagtggccagcgaggcaatccacagcgggtagttaacccagtagtagtacgaaatgcgggcgccccacttgtcgcccaggccatcgcgtacccagtcgtaaatgccaccctcaccgtcataggtagtgccgagctcggcaacgaccatgccataagggagcaggaaggtcagaatcaggaagatccaccagaagaactgctggttgccaatggcagcagcaggtgcggcggcctcgcaaacgaagacgacgcagatgatggtcgagatgaccgtcaagaaggaaagctttttctttccgtcgctcatgatgagctccttcgctcagtcttggacaaatcgaggtccttaagatattaaggcaattgccgggcctcggtgagcgggcgacaggagacgagcatccgccgcccgcaagcgtgcttctacgatgaagttacgcggttttaccaaaccgcgtaacggctcgacgctgcaaacgcccctaagcggcaatctgacgttcaatcgtcggtcgcgtaccgaagtacgcttccctcctctttcacgtcaccttgctcgcttaggggcgttttcgctgacctatggtcaacctacgataattccaagctgaacgagttactcgctgtagcgggtggcgatggcggctcgcaccatgccggtgctcatgaggtaggtcaccaggaagtagccgccgtaggctgccaggaagattgcacaggtgaggcccacggtgccaccgatgctcatatttccgaatatgctcaccagctcgatgatcaccttaagtgccacaaaggagtgcgccaggcccactgccagcgggaacaggaagaataccgcttgctgcgccatcaccgaatggcgaatctggcggtcgtcacagccgatctgtgccagcacacgatagctgcggctgccgtcggccacgttggagagttgctggatcgacagaatcgccgcgcatgcaacgaccaatacaaagccgatgtaaatggctaggtagctaataagaccgttcatttgcgctgcttgcgtgtacatctcggagcgtgtgatgaaggttccccacgaccccgactccttgccgtcaacgagcagattgtcgagcacagtgtatttaatgctctcgtctgcctcggttgtatccatcccctgtttgtagttaacgagcaggctactggaatacggctgcagattaagctgggacaacagctcgtcggcaacgacgacggtacccggattactgcccatcgccgagttggcgatggccgccgtatcttcgtccgacttatcggttgcgggcttgagcgtatgcccgcccaaggtaagggcatggccgccagccatatacttggtgtacaggtcgaccagctcgccgcccatatcacacgtgagcagatactggtcgtgaccgatgtgcaccggctcctcgcccatcatctgacgcagtttgttgtactggctcgccggcgtcacaaacagacccatcgtatcggcattgctacccccgaacgccttgggaagcttttcgcccatggccttgcacatttcacttggagtcaccgaaggatccgaaccgccaagcgggtaactcagatacgaatcgatctgcacatgctcaccggcaacatcggcaatattgaccttcttgccggtctcgtcgttgttgtccgccgacttgcccttacgatcgccgtgccatggatcgccgtgccatgcggagtacaaatcgaccgtactatcggccagcaccattcgatcggcctcagacggattgaaagactctttgtagaagtcgagcgtatcgggcgtgtaatagacatacctctgcgacatgtcggccggattatagcgctccagattctcgttcatcacgttggcaatcgacataccgcacgtcaccgaggtgatggccaaaaacaggagcatcgcgatgacgcccatcgaaaagcacaccgtgttgaccttggccgcaagctggcgcacggtaaacatgttgaggccgcgccaatacacgccgcgcaggctctgcagcagcttgatgagcatgcccgagagtccccagaacagggcaaaggtgcccacggtaaccatagcggtcgtaataccaaactgggtcatggcctcttgcagcttgctgtccgtcgcggttagcgggaacccatcacgtagcagacggtaataggccacgcccacaagcgccacgcccacggtaaagatggcaatcgagatccaggggttgcgtgtcttgatgctctcgttgcgacgctcggcacccataagctcgatgagtttggtacgacgcacggcgcgaaggttcaacagtagcgtgagcacgaacattacgagcatgcaggcaagggtcagattgaacgcatgcaccgagaaaaagaagtggaaattggcgatctgtgtcttaaagagcgaggccgtaaagaacgtcatgagctgggagagtcccacacccagcacaatgccggcgacaaaggccacgaccgacactatcacggtctcgagcgccatgatcgtggcgacgcgcccacgccccatgccgagcacctggtacaggccaaactccttcttgcggcgtttcatgatgaagttattggcatacaccatcaaaaaggccatgacaccggccaaaaagtacgtcaggtcgccgagcatgctgcccattacctgcgccaagccctcttcatcgattccggcgatgtcgacctgcatcgagatggtgttaaaagcatagaagaccgtgacgcccagggtgagcgtcaaaaggtagacaaggtagtcgcgaccggcgcggcggacgttgccccaagcgagtttacagagcatcggagccctcaccgcccatcatggcaacgacctccataatgcggtcgaagaactctcggcggtcggtgtcgccgcggcgcagctcggtgaagatcttgccgtcgcggataaacagcacacggctcgtgtagctggcggcaaagctgtcgtgcgtgaccatgagcacggtggcgcgcaggcggcgattgagggcctccaggctctcgagcagcaggcgagcgctcttggaatcgagggcgccggtgggctcgtcggccataatcatggtggggtcggtgacgagcgcgcgagccgcggcaacgcgctgctgctgaccgccggacatctggtagggatacttgtcgagaacctgactgatagacagacgcgcggctacatcctgcacgcgggttgagatctctgccgagtttgtgcgggcgatggtgagcggcagggcgatgttctcgcgtgccgtgagcgtatcgagcaggttggagtcctggaagataaagccgagctcctcgcggcggaactgcgaaagcttagcctgcttcatacgcgtcacgtcctggccgttgatgcggatggtgccgctcgtggcgctatcgatggtcgagacgcagttgagcaacgtcgacttgcccgagcccgaggcgcccatgatgccaacgaattcggcgcggttgacggtaaagctgacgtcgttgagcgcgcgggtcacgttgcccagcgctccatataccttttcgagatgcgcgacctccagtaccggggtcgccatgtgcgtggtttgcataccgagtcctttcttgcaattagtctacggcatctatagtcgcaagaagacgagtcggctaccatcgatatggcttacgcttgccttaccgttgtgtaaggtacgggtagctagcctgtcacgtgttgatgttgagagaggactcctgttgaagactgttcatgttgccgctgggatcattcgcaaggaaggatccgacgagctactggccgtgcagcgcggctatggcgacatgcagggactttgggagttcccaggtggcaagctcatgcgcggcgagacgcccgaggacgccgtgcgccgcgagctcatggaagagctgcaggtaaaagtcaccaacctgcgcgatttctataccgttgagtatgactaccccgattttcatctctccatggagtgctactactgctcgctcgctgataaatccgatgagccccagaagcacgaccgccagctcgatatccgctggattccgcgcacttcgcttgccacggtggaatggatgcccgccgataaggggcttatcgatgctctgattgagttgaaggaagatcggctcgaggcaagctccgccgatgacgccgcgcccaacacagccgacaaacccgccgccaaacccaagcgcgcacctaagcgccgtagcaaaaagcgccccaagcccggcctgctggacggcatcgatacctcggacctttctgccgacgagcgtgagctcgtgcgccgtcgcgccgctataaaaaagtccatgaagggcaacaagcgtgcgaacaccaaacctgagctgctcgttcgccagcgcctgcgcgccgcaggccttacgggataccgtctggaatggaaggtgcccggaaaacccgacatcgcctttcccgggcgcaagatcgccatcttcgtcaacggctgcttttggcatcgctgccccaaatgcaacccaagtcagcccaagcgcaatgttgagttttgggaggcaaagttccgccgcaacgtcgagcgcgaccgcgctgccgtggcagcactcactcaaatgggctggacacccataaccatctgggaatgtgagctcaaaaaggaccgcatcgacgccacgatggaaaaggtcatcgagcaggtgcgcaccgcagagccgcagcgctaggaacgagccatccacacgccccgcacaggcgagccacatccgcaccacaaaccttagaaagtccttaagctcaaaacctttcaagagtgttactcgatacttctgacctgcagtttcatcgtaaaaccaaaccaggttaagcctttctttagcgcttctttgcagcagccgcggcataatactgccagcgcacgggacctagcagcacaccccatgcgcaaccttttggtggacatcgaggaggccgcataagcatgcattcttccaatgccgtagcacggcagccatccctaaaacatgcagaccttttctccttccccccgacacagagaaacggcctcctcgactcccccaccacaaaagccaaacgctcaaccgaccagagccacaacttgcaagcatcgttcgaaaagctccaagcatccctagacaaaaccttccccaaccaagcccgggcatactagcccctcatcaacaaagcgcccctcgcgccccacccctttccgccccaacgccacaagggcgacgacctcgagtaggtcaacctgggagggacgagggcttagttccccaatctttccgcagggggcaaaaagcctcgccgcacgaagtgcgcagcgaggctttttgcatgcccgaggacgattggggaactaagccctcgtccctccccgggatatatagcgagtcggagtacccttgctgttactctgctttgcccacagagttgaggttggtcatgcggatcttaaccagctcggtgatctcacgcataccctccttagccggcttcttggggtcgaagcaggcggggttctcggccatgtaggccatgaagcccttggtgtaggcctgacgcagctcggtggcgtagttaaccttgcagatgccgttcttcacagcctcggcaacctgctcatcgggcacaccggaggtgccgtgcagaaccagcggcacgtcgacggcgtcgcggatggccttgaccacggactgctcgatgtgcggatcgctcgtgtacacaccgtggctggtgccaacgccaatagccagcgaggtgcagccggtacgctcgacgaactccttggcctcggccggatcggtgtaggggctctcgccctcaaccgcgggaccgtcgtcctccttgccgccaaccttaccgagctcggcctcgacgggcacgcccatggcgcggccagcgtcggcgacggacttggtcagggcgatgttgtcctcgaaggactcgtgcgaaccgtcgatcatgacagaggtatagccggtgcggaaagcctgcatgcagcggtcatagccatcgccgtgatcgaggtgcagagcgacgggcacggaagcgcgctcggcagcagccttgaccatgccgtagaagtagtccagaccagcggacttgatggtgcccggggtggtctgcatgatgacgggggacttggtctcctcggcagcggccagaacggccataacaaactcgaggttctcgacgttgaacgcgccaacggcgtaatggccggcctgagcgtccttgagcatcttttcggtggtaacaagtgccatgagcgtttgctcctctccctcgcccgcatctggacatcgggcgtagttgttcgcaaagcgttttaccttgcgttttactgcgctcattgtatgaaattcagcgtctttgcatgtgcgagatattgagcccatgcaggtcaatacagtcgtttttgaaaagtaaacggaaggaattggggctgggcgggcgtgttcgatattgaattttgggcgttcagcgtctttcttttatagaaaagataagtaatcgaaaggcgttttcttactaaaaaagaaaatgaacgaaaatagtttcaacataattcctgcaaatttcggttcaggatggagcagcaatgacccacgcaacaaaccgcgctttcgccgatgagcgtcgtgccgccatcatggaaatgctcgagcacaacgcctcggtgcaggtagcagaaattgcccaaacctttggcgtgtcctctgtcaccgctcgcgccgacctgaacgcactcgccgagtctggcaagctgcgccgcacgcatggcggcgccgtatcgctccacaaacgcctgaccgtctccacgcaggatcgccgcatcaatgtcaacgtcgccgccaagcaggccatcgcgcaaagcgccatcgagctcgtcaatgacggcgacacgctgctcgttgactcgggcaccacggcgctcgagttcgtccggctcctcgatcagcgcaacggcatcaccgttatcacggccgacattaccatcgccgattatatcgacgagagcatgccctcggtcgatgtcgtcatgctgggcggggcgctgcgcaaaggccatcgttatctgtacggtccacttaccatgcaggcgctccaaatggtccatgccgatctggccgtcatgtgccctggcgcttttgttcccggctgcggctttacgaccgactttccgcagatggccgagaccaaaacggctatgatcgccgcagcccatcaaagcgtcgccctcatggacgccagtaaggtcaacggacgcggcatgtaccgttttgccgagctgaccgatgtcgacgccatcgtgatggaccgagaccccgaaggcgccgtcgccacctcaatcgccaagaccgccgacggcgcacgtccagcactcatcatcgccgccaactaaataaaaaccaccacaaaggtgcctgtcccctttgtggtggttgagcgtcaaaagtaaacgtgtcgctacttggaaagctcgtcggcgaggacctcgatctgagcgcgcgaggcgtcgttgagcgagcccagcacggtcaccttgttctgcgccagggtgatgtccttcatgccctcgagctccttggccataaccttggcagcggtgggcgcccaggagccggcctcgacgagtgccaccgtacggttctgataggcgtgctcggcaagcgtatggataaaggtgctcatgaacgggaagatctcaccctgataggtgatggaagcgagcaccagacggtcgtagcggaacgcatcctcaacggcctcggccatgtcgtcgcgagccaggtcaaagacggagaccttctggccgcgagcctcaagcgctgcggcgagctcctcgacggcagccttcagatggccatacacgctcgcataggcgatcgtgatgccctcgtcctcgggctgatagctcgaccaggtgttataggtgtcgaggtagtagcccaggttctcggtcagcacggggccgtggagcggacagatgatctgaatgtccaggtcggcggccttcttgagcacggcctgcacgaacttgccgaacttaccgacgatgccaaagtagtagcggcgagcttcgcaagcccacccctcggggtcctcgatgtcgttggcgccgaacttgccaaagccgtcggcgctaaagagcaccttgtcggttgcctcgtaagagaacagtacctcgggccagtgcacgttgggggcgccgataaaggtcaggctgtggccacccaggtcgagcacgtcgccctctttgacgaccatcttgcgctcggggtagtcggtgccaaagtagttgaccatcatgcggaaggcgcccatgctggccacaatctgtgcctggggatagcgctccataaaggcggcgataccggcggagtgatcgggctccatgtgatggacaaccaggtagtcgggcgtacggccatcgagcacggcctcgaggttgccgagccactcgtcaacaaagccagcgtcaaccgaatcggcgacagcgattttatcgcccaagataacatagctgttgtatgccatgccgttctcggacacgtcgtactggccctcgaacaggtcaatgtcgtgatcgtcgacaccgatgtagcggatatccttggtgatctccatcaggcaaagcctcctagatagacaaaagaacccgtctatcataacactcgccttcatagccacggctatctgccagcatccttatcgattgttattgaggcggaatatatcgccattgacctgcaaaaactatgtgcgcggagctgccgtggtatgtcgaacgataagctggccgggaatacgaatggcaacggttttgtccgttgcccccgccttgggaaccgcgtgctcgaacacctcgcgtccacgctgatgcaaatcgaatcgaacggtcgtgagctcgttgtgtgccacaaaatcatcgagcgaatcgtcgacgcccaccacgctcacgtcctcgggcacgcgcagaccgctatcgcgcagcgctgcaatcgcgccatttgccatctggtcgtttgccgcgtaaatcgccgtcatggtgcgatcgtgctcggccaggtacctgccggcctcgtagccgctgttggcagaccagtcgccctcgagcggctctgccggctcgatgtgtttacgctcgagtgcatcctgccaaccggcgcgacgaaattgctcgtcgaccgagaatgacgggccgccaatatagcgaatctgctcgtgccctagctcaaacaggtgatccataagcaatagcgagcagccgtaatggtcggaatcgaccgtggtcacctgcgggtgcgcgtacatggtaacgatgaccgtgccaatgcccggcagtggatcaaacgtctcaaaatcgggcgccatgcgactcataccgatgatgatgccgtccaccggcaatgcggccatacgacgcgtggcctcggcaagcgaaaactcttcggtcttggacatctcgaccagcgtgatggcgcaattatgctcgcgagcagcgctggcgatgccgtcgatcattgagaggttgccgaacttggtcacatcgttgacgcacaggccgaccgaatggtaacggccgtcgcgcagcgagcgaccggcataactcggacgaaagccgagctcttgcatcgcggcctgtacgcgctggcgcgtctgctcgttcacattgggcaagccgttggcaacgcgcgagaccgtctgctgcgaaacgccggcagcgcgggcgacgtcggccatggagaccggacgcgaactggtatcgttggacgggcgccttgccacaggatcaccttcactcttgcgagatctgaatagcgtgaatgccggcccgggcagaaatacatcccgcgccgaggcccgctatcgtcggacgcatgttaacgtactctactttttctatcggcggttcttttgctccatatgtccatacagccacaccgttcacggccgaaaatctaccgattaccagattctcaaaaatagatatgcgttgtgttatgagtacgttaacatacccattaacgtgcggcaccgcgaccgtctggtttgtggtgctcaaaattgttaacgtactcataatgacacggaccagtctctcccgcgtcaaggaaaggaccccccatgaccacccccgacgaaaagacactcgccacgctcaccaagctgtttgaggaggagtttggcaccgtcggcgatcgccaggtgctctatgtgcacgcgcccggccgttccgagatcagtggcaaccacaccgaccacgagggcggccacgtcatcgccggctcgctcgatgtcgccgttgacggcatcgccgtagcgaccgacaccaacaaggtccgcgttgccgatgagggctaccccacctttgagatcacgctcgacacgctggatattcaagagtccgagaagggcacgtccgcaagcctcgtccgcggcatggcccatgagattgcagcccttggcgttgagccccagggcttcgacttcgccttcacctgctccgtcccctcgggcggcggtctttcgagctccgctgccgtcgaggcggcatacggtcgtgccatggagacgctctggggagcgcccgccattgagcccgtcgcactcgcccagatgagccagcgcaccgagaacaactactacggcaagccctgcggcctgatggaccaggccgccgtttgcttgggcggcctcgcctacatggactttgaggatcaggcccagcctaagacccagaagctcgagctcaactttgaggatcacggctacgcgctcgtgctcgtcaaggtcggcgccgaccacgtggccgctaccgacgactacgccgccgttccgcgcgaaatgcaagacgtcgccgccgagtttggcaaggcacgcctgtgcgaggtaaacgttgccgattttgacgccaagctccccgagctgcgtgctaagctgggcgaccgtgcctgcctgcgcgccgttcactactggtacgagaacggcctggtcgacaagcgctgggcagccctgaacgccggcgacatcgaccagttcctggtcctgacacgcgagtccggcgccagctctgccatgtacctgcagaatgtcgttgccaagctgggctccgagcagccctcgatgtatgccctggcactggccgagcacgtgctcgacggccgcggcgccgtccgtatccacggcggcggctttggtggcaccatccaggcctttgtgccactcgatctggtcgacacctttatcaccaagatgaacagctggctgggcgagggctctgcccgtcactacgctatctctgacaagggggcttacgcggcatggctgtaatgaccgacgcgcgcgaggctgcgcagaacctgatcgagtacgctatccaccgatcgatgatcggacaggacgaccgcatctgggcctacaacaccattctggagtgcatcggcgccacgggccccgcgctcaacatggcctgggcgctcaagaccgagaagatttcgctcttgcaccccgataccctgcccgattttgacctggagggcacgctcgccgcgctttccgaggccgccgttgccaacggtgctgccgaagacacggtgtcgggccgcgaccgcatcgccatgcgcatcatgggcgcgctcatgccgaggccttcggttgtaaacgaggagttcaacggccgcatgggcgtcaacgagccccgcgccgcgaccgactggttctacggtctgtgctgcgacgccggctacgtgcgccgtgccgccatcgcgcgcaacatcaaatggcgcacccccaccaactggggcgacctggagatcaccatcaacctgtcgaagcccgagaaggacccgcgcgacattgccgcagccggcgccgcaaagaacacgggcgagaagtatcccgcctgccagctgtgcatcgagaacgagggctatcccggacgctccgccgcagccgacggcggcgcccatcccgcccgccagaacctacgcgttatccccattcagctcaacgacgagcgctggggcttccagtacagcccgtacgcatactttaacgagcactgcattgctatgagctccgagcatcgcccgatgcacgtcgaccgcaaggggctgacctgcctgctcgattttgtggacctgttcccgcactactttattggctccaacgccgacctgcccatcgtgggcggctcgattctgtcgcacgaccacttccagggcggcgcgcacgagttccccatgatgcatgccgccgaggtctcgcagtttagcgtgcccggctttgaccaggtcagcggcaccgtgttgcagtggccgctttcggtgctgcgactgcgctcgcacgaccgcacccagctgctcgatgctgccgagaagattatcctcgcctggcgcgagtggaccgacgagtccgtgggcgttatcgcacacacagccgacggcgtagcgcacaacaccgtaacgcccgtcatccgccgcgtcgactcccgcggcaacgccggcggcgaaatctacgaggcctacctggcgcttcgctgcaatatcacgaccgacgagcatccgctgggcgtattccacccgcatgccgagtaccaccacattaaaaaggagaacatcggcctgatcgaggtcatgggcctggcaattctgccgccgcgcctggttcccgagcttggcgctgtccgcgagcatctgctggcagccaaggccgatgccagctacgaccttgccggtgcactcgagggcgatgatctatgccgcagccacgccgcatgggccgaggatgtctatgcccgccgcgccaacgagcttacggccgacaacgccatcgatatcctgcacgaggaggtcggcgtggtgtttggccacgtgctcgacaacgccggcgtctttaagtgggacgaagccggccgcgccgcccaacagcgctttatcgactcactgtaatggtcccttggggacggaggaaaacagatcatttcgtcttcaagacaacggcgcccgccggcaacatcaccgacgggcgccgtttttgagtgtagtcattggggtcattcttaaggggcgttcttaaacgactagtcattaaagagcgtccccaatgactatttgcgaccaaggcaacgccggtgtcttggcaacgacagcgaaaacgcccctaagcgagcaaggtgacgtgaaagaggagggcattgaccttttggtcatgcccgacgattgaacgtcagattgccgcttaggggcgtttgcagcgtcgcgccgttacgcggtttggtaaaaccgcgtaaccctacagttcagtcacgacaacgctgttgtagacctcgtcccagcggtccatgaccaggtggccggtcttgggatccatggcgttgagcttgccgcaggtattggcggtcttgagcaccgtgacgtcgtcggcaccagcagcaatggcatgcgcaaaaccggcaatggtcgagtcaccggaacccgtcgcgttcacagccgcaatcgcgggcgtcttggcgcggaacgcgcggccctcatggaagcccaccgaaccggcagcgcccatcgaaacgacaacccaggggataccggcaaaacggtcatcggcggcaagcgcctcgcgcagggcatcgacatcatcggtcgtaaaggacgtacccagcaggccgttaatctcggtcaggttgggctttacgagctcaggcttagcgtcggactccagcgcggcctccagcgatgcacccgaggtgtcgagcagcaccttggcgcccgcctcctcggcaatcttgacgagctcggcatagtagccggcatcgacaccacgcggcagcgagcccgaaagcgtcacaacgtccgcctttgctgcaagctcggcgaattttgccgtaaaggcctcgagctcggccggggcgatctgcgggccgctctccaaaagctcggtctgattaccctcgtgcagaatattcaggcaaatgcgcgtctcaccggcgatgggcacaaagtcgttcttgacgccgtcggcatccataagctcggccatataggcacccatgtggccgccgagcagaccggtcgcgagcacatcgtcgcccaactgcagcagcacacggctcacgttaaggcccttgccgccagcggtcttttcgggcgtcacgcggtttacatcgtcgatgatcagcttgtcgagctgatagcgcgtatcaatcgacgggttcatggtaacggtcagaatcatattgaactcctgtttccggggcacgacacgcgcggccccaaacatacgatagctcgttaaaggatctcgatctcaaagccgcgggtaacggtctcccccggcttggccaccaggcagccgcgcttgtgctccaggatatcgtcctcgtcggagcaggtggacaggccgccccacggttccacggccacaaagtcaccctcgggcttgctccacacaatcaggtacggcatatcggggaacgtcagtcgcacgcccttgtcctcggtcttcttggtcagcgtaaccacgcggctctcgagcacgtcaaagatggtctccgcgaagtcaaagagttcgtgggtcagcggcaggtcatggccaaccatcgggttcttgctgcgatgctcaacatcaatcaggcccgtcgagggaacggcagtacagagctcggcggcctcgcgctgctcaaaacggagctcgtagtcgtcataggactcgccctcgtcaagcgggcacttaaagccagggtgaccgcccacaaagaacggcatgtcctcggtgccctcattggtcacctcgtacgacacggccaccttctccgcatcgatcgtgtaacgagcaacgatcttaaacggatacgggtactgctcgagcaactcggcatggtcggcagagcttagactcagcgcaaccatgttgtcgctctgctcctcgagcttccactcctgtttgcgcgcaaagccgtggcgggcgaactttacctcgcggccgcccatggtcattgcgtgaccatcacgaaggccgccgcagatcgggaagcaaatgggtgcctggcccgaccagaccgaaggatcgccctgccacaggtactcgcgaccgttggctttaatcgaagtgaacgatccgccagccgtgctcagtaccacgcgaacagaaccgttatcaagaacaaactccataggagccttccctttcttacgacagcccgccaagtcaatagggctgatagaaaaccggctcgcgccccctcacagaaacgcgagccgtcaacggactagttaattacgccggatacccgctaatcgtggtattcgccgcggtcccacttctcgaggaactcgtcaaagaagtgcgggtcagcctgagcctcggcatcggccttattgcaggcatcgatcttggcgatcagggcatcgtgctcgggggtcttctcgtagggctcctccaggaaggcaagcatgatatcggccatcaggaactcgccggtgatcttgccgccaaagcccacgatgttggcgttgagctcgcgacgggcatacagggcagaggtcatatcgcggaccagggcgcagcgggcgccgggaaccttgttgacggcgttggtgatgccgatgccggtgccgcacagggccacgccaaaatcggccttgccgctggcgacagcctcgcccacggccttaccgtagatgggatagtgcgtacgggtgtggctgtaggtgccgcagtcgagcaccttgtagccagcctgctccaggcggtcggccagatagatcttctcgtccgtaacgatatggtcgcaaccgattgcgatggtcttcttcatcagaacgtcctttcgtctgaattcacaagttgaggtagaagttcgagttctcggtggctctcgttaggccatcttgttgagcatgtcgacacggatctggtgacggccgccggcgtactgggcacgcaggaactcgcgggcgatcttcttggcgacctcggtgcccacaacgcccgggcccatggtgaccatgcgcgagccgttgtgctcgcgggtcatgtaagcggaacgctcgtcggaaatgttggcgacgaccatgcccttgatcttgacggcggccatataggagccgacgccgtacttatcgaatgcgaagccctgggaatccttgtgctccagcaggtccttggcaacggcggtcgcggaatcgacaaagtccgcggcaggggtctcggaatagtcgacgacctcgtgaccgtcggcgatgagcatctccttgatggactccttcatcgacataccgtcggcatcggaagcgattacaaccctcatgacatcctccttgagagatacgcaggtgcgtagtttctgtttggaagtgttgaatcgcgttcaggtccgggcatctgaatgtgcggttcttcactgttcatgtttatttgaacacattcgaacatcaactgcaagaattatttgtttgtctttgttcttttttgaacaaataccgttcgcggatgattgctgaccgtttggaatcggggaaagcccaccctgccacgtattcaacaaacaaaagggcggccgagaacgtgtctcggccgcccttcggcggtattccccggtatatacagctgttttagctactcggactgcccgccctttttggcgtgcttggacggagcgctcagaaagcgacccgtcaaatagttcgccgggccggaaatatcaatccccagcagggtgtgccccagccacaaaaacgccgcgagcaccagcaatggaatcacgcacgaggtcacgatcatcacgatgacgccttcgataaggtcggtcacctgctgcacgatctcgtcggtcatctgcttggcaccactggttaccgacgtgaccaggcttgaggcaccgtcggcaagctgctcaagcacgttcttggactctgtggactcggtctttttcttgcttgctttggagctatcactatttgccgtacccgcagcgtcggccgccttttgctcggccgcttcgatgctcactcgatacgtttcgtcgaccttttgcgacacccatacgcttgcaggcaccaacgccatgccgatcgtggcgaccaccagcacgcgagtcgccacgcggcgcaggacggcgctcgtgctccagcgcccgtgaatgccgagcgacaccgcaaggagcaccagcgcaaacgggatcaggatgcccaggccaaccgaccacaaaatggtcagcaggtatttctcgaggtagagcacggcaagcacgatgcccaagttacccgaaagctgcgcgagctgctcggcaaccggcgttcccgtatcgcccggcagcgcagtgatacccgcagatagggcgacgcacgaggtcgtgagcgccaaaacattgcccttcttttgatcgatgacctcgatggtggagtcccaagtcttggtatcggcgaaatgcggacgagctacaaagcccgacagcagcgccagtaccacgagcgcaacgataaagccaatctgcagctttttgtttgcgcacacgacatcggacagactgggctgcagctcggttaccgtcgtgtgctcggttatctggacaggacgcccatgagccatctcgtgcgcgtctcttttttgtattgacccgttatccggcatttggatacctcctcagtccggggcttaatgcgaaaggaagtatacccaccgagcaaaaaacgaacgggaagacgaacagagcgcaccaagactgtccccaatgactatctccggatgagttgcggtggaatagggattgttttgcgcccgtcggcccctattcagtccctatttcaccgcaacttggaggaggacagaaaaagccctgccgcgggtagcggcagagcttttggaaggggacttggttgtgagggctcgttaggcgagcttggcctcgagctcggcgatgcgcttgtaggcatcgatggtaaagcgggcctgcttctccaggatcatagtggtcatgagagtgtcctgagcgtgagccatgatgaaggtcatctccatctcgccaccgccggcctcctgcgaaagcagcttggtctgcgtgtcgtgggcgccgataagtgcatcgctggcatccttgtgcagctgttcggccttctcaaaatcgccctcgcgagcagcatcgagcgctgcaagcagatcggtctgggcgtcacctgcgtatgcgacaatctcgaatccaaccatcgagatttcttctttggttgccatattgcgttcctttcacatatgaaccaatggagagcatcgcgtccgggcatacgcgctgcgttctgtatgacagaaacattaacattcaaacaaaaaagaacagcgcaaaacgtgatttcgagctatgaacggtcgcttttcgcccgtgaacggtttttaaaccaatctgaacaatatcgaacacaattagcggcaacccaaacagacctgcgcccctagcgtacatcgcgcaccgtatcgccctcgacgagcacgcccggaaacagcatgtgctccacaccgggcgcaacgccctcggcgccggcaatcttgtcgaccgcccacatgccgacgcgcttgttgtcaaagcgcaccgtggtcaggcgacggtcgggcacgatatcgcccaggctgtcatcaacacccaccacactcacgtcctcgggcacgcgctttccgcgcgactcgagcccgcgaatgcagccgtaggccatggcgtcgttggaagcataaatggccgtacaggtcggatcatccgccagggcctgacctgcggcatatccgctctgcgccgtccaatcgccacggataagtcgcggtggctcaatgccatgcgcgcgcaatgtctcgcgccagccttcctcgcgccgcatgcccgaaagcgagcgctcgggacacgagataaagtgcacggtcttgtgcccccgctccagcaagtactcgaccacctggcgcgagcaatcgaactggtcgttatcgaccgttgaacagagcgggtgctccaacatcgtaacgagcaccgtctgcatgccgggcagcggctcaaaagtgccaaagtctgccggcatgcgattcatgatcacaaccataccgtccactggcagtgcgctcatgcgcgacgatgcgctctcgagggtatacggatgcccgtctactttagtgagggtgatggcatagccgtgcttatcggccgcggcggcaaagccctccatacggtcgagattgccggtgccggtaatgttgaacatggcgacgccgacggtcttaaacttaccgcggcgcagcgatcgaccggcaaaattggggcgataccccagctcgcgcatggcggcacgcacgcgttccttggtctcggggcgcacgctgggcgaatcgtgcacggtgcgcgagaccgtctgctccgagacgcccgcgagacgcgccacatccttaacggataccgattttttaacagcggccataggtcgatctttctatgtcaacgatgccattgatggcaccttgcgcagtcatttttaccgccttcaagtatatccaacgcctcccccaccatacgctcaccacccaaaacctaccgttcaccgacatttttgcttccccaaacggcttttgtcgaccaaatgttaacgttgccattgtgcaaacacagagccaccgggcggctcaaacgtttacgcgtaaggaatcgacggttcgcaggcacaggaaccaccggttcgcttcttttttttgtgtcacaaaatggcaacgtcaacattttggcaaccgaaagtcaaaagctaccatcgttgctaacccaccgactcttaggagcattgcatggagcaactcatcgccatcatcgaaaagggccagccctttttcaacgcgatcgcccgcaacaagtacctcaaggcgatccgcgacggctttatctccgtcatccccatcatcatcttctcgtccatcttctgcctggtagcctcggtccccaacatctggggtttctactggcccgatgacatcaacaacgccctgtggaagtgctacaactactccatgggcatcctggccatcgcctgcgccgccaccacggccaagcacttcgccgacgctcagaaccgcgatctgcccaagaacaaccagatcaacttcatctcgtgcatgtgcgcggccatcatcggcttcttgctcctttcgagcgacacgatcgccacggacgccgccagcggtttcaacaccacctaccttggttccaagggcctgctgaccgctttcatcgctgcgtttgtgactggcatcatctacaagttcttcattaagcgcaacatcaccgtcaagatgcccgagcaggttccgcccaacatctcgcagacctttaaggacatcatccccttctccgtctgcatcaccgtcttttgggtttttgacatcgtcttccgcgctgcttttggcttctgctttgcccagggtgtcatccaggtgttccagcccctgttcaccgctgccgatggctacatcggcctcgctgtgatctacggcgccatgagcctcttctggttcgtgggcgtccacggcccctcaatcgtcgagcccgccatcgccgccgctctcgttgccaacatgaccgacaacctggctgcgttccaggccggccagcacgcttccgctgtcctgacccagggtgcccagtacttcgtcgtctgcatgggcggcaccggcgccacgctcgtcctggtctttatgttctgcttcctggccaagtctcaggagatgcgcgccgtcggtaaggccgccatcgtccccgtctgctttgccgtcaacgagccgctgctgttcgccgcgcccatcgtactcaaccccgtcttctttgtcccgtttgtctttgccccgatcgccaacatctggatcctcaagatctttatcgacttcttgggcatgaacggctttatgtacaccctgccttggaccgtccccggccccatcggcaccatcatgggcctgggcttccagccgctcgcctttgtgatgctcgcccttatcctggtcgtcgacttcgttctgtactatccgttcttccgtgcctatgacgcccagaagtgcgccgaggaggccgagatttcccaggaggagctcgcagccaagaacgccgagaaggccgctaagctcaacgatgccttccagggcaaggctgacgccaagagcgttgccgccggcgctgctgccgaggccgtgaagtccgacgtcgctcccgccgccaccgaggcaacgaccgccagcgacctcaacggcaagcgcgtgctcgtgctctgccagggcggcggaacctcgggcctgctcgccaacgcgctggccaaggccgccaaggagcgcggcatcaatcttgagaccgctgccgaggcctatggcaaccacgtggacatgctccccgacttcgatctggtcgtcctggccccgcaggccgccagttacctggccgacctgcagaaggactgcgagcgcgtgggcaacaagtgcgtcgcctgccgcggtaagcagtacatcgagctttcccaaaacggcgataagtctctcgccttcgtaagcgagcaactctcgaagtaagtaacgctcagggccagccgaccatccaagaccggctggcccttcgatttagacgattggatcatcatgtccgttaaccctgctagcgtcaccaacccgcctgcgcagtttcccgaggactttgtctttggcggcgctaccgctgcctaccaggtagagggcgagacccgcacccatggtaaaggcaaagtcgcctgggacgacttcctggaggcccaggggcgcttctcccccgatcccgcttcggacttctacaaccagtaccccgtcgatttggagctgtgcgaggagttcggcatcaacggcattcgcctctctatcgcctggagccgcatcttccccaacggtaccggtgagattaaccccgagggcgtgcagttctatcacgacctcttcgccgagtgccataagcaccacgttgagccgtttgtcacgctgcatcactttgacacgccgctgtccctctttgagaagggcgacttcctcaaccgcgagaccatcgacgcctttgtggactttgctaccttctgctttaaggagtacgccgaccaggtgacctactggttcacctttaacgagatctgggccgacgcctccaacacctacatcgagggcaccttccccggtggcgtcaaggcgcatctggccgaggccttccagtgcgagcacaacatgatgctcgcccacgccaaggccgtgctggccttccacaacggcggctttaagggcaagatcggcgtcattcagtcgctggagtttaagtatccgctcaacgagaacgaccccgccgacatcaaggccgccaacaacgagcacgtgctgcaaaaccagttcttgctcgacgccaccttccgcggcgactatgcgcccgacaccctcgagtgcgccaaccgcctggctgccgtctcgggcggcaccatcgagatcctagacgaggatctggaaatcatgcgcgaggccgcgctctacaacgactacctgggcgttaacaactaccagtgccgtttcttgaaggcttacgatggcgagaacgacctgcaccacaacggtacgggcgagaagggcaccggccgctggcgcgtcaagggcattggcgagcacgtgaacaagcctggcatccccaccaccgactgggactggatcatctatcccgagggtctgttcgatctgctcgtctacattaagcagcgctaccccaactacaagcagatcttcatcaccgagaacggcatgggctacaaggacccctacaaggacggttttgtggacgaccagccgcgcatcgactacatcgagcagcacctgcgctggttgctcaaggccatggaggtgggcgtcaacgtgggcggctacttcctgtggagcctgcaggatcagttctcctggaccaatggctacaacaagcgttacggcttcttctacgttgactttgaaacccagaagcgcacacccaaggcaagcgcatactggtataagcacgtggcgcagacccgtcgtctggactagtgactggcggggttgcccgctcacataacctgtccccatttctcagccgggggcggcacgtcacacggcgcgccgcccccggccttttttgggcggaccgtgtcgcacgtttgtctcgatctgtaacatctagccgagttttttggtcctagctgttacagattgagacgaacaggattgctctttccgaagaatctaaatctgtaacacgtagcccgcttttgaccgtctacctgttacaaatcgagacaaacggagtaggacctaaccccgcatgtccctaacagtcgagcgttcgaccagcgtactcggcacatgaatcgcctcgatagacgagctctctccaatcgccgcctcaaacgcaagcttaccgacaccgcgcaaatcaaatcgcagcgtcgtcagtcgattgtgaggaacaagtccctcgagtgcgtcgtcgataccaaccacgctcacgtcgtcgggcacggacaggcccgcgttctcgagcgcggcgataacgcccagcgccatctggtcatttgccgcaagcacggcagtcggcgcctgcgacccgccggcaagcacctcggccgcaatccgctcgcccatggcgtacccactgtccgcactccaatcgccacgcagcatcggagcggcatcgacatgagcacgacccagcgtatcgcgccaaccggcctcacgaaaacgcgaggaaatcgagttttccggacccgccacaaaccgcatattcgagtgaccatgttccagcagataattggtcaacagctcgcacgaaccatactggtcggagtcgatcgtcgtgcagcgcggatgcgcatacatggacaggatgaccgttcgcactcccggctggggaacaaactcctcaaaatcgggagccatgcggttcatgttgagaatcatgccgtcgacgggtcgctcgaccatgcggcgcgaggcatcggcaagtgtatagggcttgtcgccgcccatctcgatcatagtgacggcaaaatcgtgctcgcgcgccgcttgcatgataccctcgagcgtcgccaggttaccgacacgtgtgatgttgtacatgcacaggccaatagaacgatacgacccgccgcgcaacgccgctccagcaaaattgggacgaaagcccagctcttccatggcggccagcacacgcttgcgcgtcttttccgtcacgttgggcacaccgttgaccacgcgagacacagtctggcggctcacgccagcgagcgccgcaacctctgccgcgctcgccgaatgaccattccttgtctgctgagccatgccttccacgctaacctgcttcccaactattccccgcgcccatggcgcatcgtacatacatcgataacgtgctcatgatacccgagccatataccacaacatgaaaacttctgtcaatcaaaaccgcttaccgaacaaatacaaccgttcgcggctgtttgaagttgttttgtttctatacatcccagccggatgttaacgtgctcattgtcaaatgttcacgtgctcattttggttctaatcattttaagatagtgtttatcgggctttttcaccgctgaacgctaaccagggagcctcctgagcgcaaacgcacaatatcgaacagcgagacgagagggtgtatgcatatgtctttgctaaaccgcgtacagcagctgccgaagggctttgtttggggcgccgcaaccgccgcgtaccaaacggaaggttccacgaaggtggcaggcaagggtaagaccatgtgggacgattaccttgtcgcccagggtcgctttttgcccgacccggccagtgatttctacaaccgctacgaggaggatatccgcctttctgccgagcatggactcaacgccatccgtgtgtccatcgcctggacccgcatcttccccaacggcgacgatgccgagcccctcgccgagggcgttaagcactaccacgagctgttcgcctgctgcaaaaagtatggcgtcgagccctatgtgtccctgcatcactttgactcccccgccgccctgttcaaccagggcgactggctcaaccgcaagaccgtcgacgcctatgtgcgctatgccgagttctgcttccgcgagttccgcgaggtcaagaattggttcaccatcaacgagctcatcagcctctcgcactcccaatacatccaaggcaacttcccgcccaaccatcactttgatgtgacgagcggcatccagagccagcacaacgagctcgttgcccacgcccgcgccgtcaacctgtataaggatcttgacgagaccgagcacctgggcggacgcattggcatggtcaacgtcctgacgccggcatatcctgccacagactcgcccgccgaccagcacgccgccgacctgtacaacgccttctacaccgacttcatcatggacggcgccttcctgggtcactactccgcgcgcaccctctcactcatcaacgagattctgcgtgccaacaacgccacgcttacggttgaggacagcgacatggaggagctcgccaaggcggcgccccgcaacgatatgttcggcctcaactactatcagtcggcgtttatcgccgcctacgatggcgagtccaccaacagctttaacggcaccggagacaagggcacctcgtgctttaagtttaagggcgtcgggcagcaggtcgatatgccgggtatccccaccaccgactgggattggctcatctacccgcaaggcctctacgacacgctcaagcacatcagcgccacctatcccaacctccccgtcatctatatcaccgaaaacggcctgggccacaaggaccccgagcccggcgcaaacggcatcgtcgccgatcccgagcgcatcgactttgtcgaccagcacatggagaaggtgctccgggcgcgcgccgagggcgtcgacgtccagggctactttatctggagcctgcaggaccagttctcgtgggccaacggctataacaagcgctacggcctgttctacatcgacttcgacacgcaaaaacgctacatcaagcagtcggcactctggtacaaggagctcgccgacactatggcggacgcgcagtagcgcatcgcctcgctttctcccgagaggggagcggccctatgcgatacaaacccagccgctcccctctctccccctgggaccgaccccgcctgcacccgggcttttagcaagcgggagaccatataggttttcaacgtccatgccattaagatttcatgcaaagaggagcgtgaactatggaatcgatcgttaagttcttggagaaaggtcagccgtacttcgacaaggtctctaagaacatctaccttcaggccattaaagacggctttttggcagcaatgcccatcatcctgtcttcttctgtcttcctgcttatttcgaccctgccgggcgttgtcgccacggtcggcggctttacgctgcccgactggtggaacgtcgacgtcgtgaacttctgcaacaaggtttacaacttcacgatgggcgtcgtgggcatcatggtcgccggcaccaccgcaagcgcgctgaccggctccaagaaccgccgcatgcctgccggcaaggccatcaacgccacgagcaccatggtcgccgccatgtgcgctatgctcatcttggccgttacccagacgagtgccaagatcgacggcgccgatgtctcggtgttctttaccgacaacatgggcaccaagggcctactgagctcctttgtcgccgcatttgccacggtcaacatctatgccttctgcattaagcgagacatcaccatcaagctgcccaaagaagtccccggcgccatcgcccagaacttccgcgacatcttcgccttcagcttctccatcctgtttgtcgccgtcatcgacgttatctgccgcacctgcttggccgtcccgtttgccaacgtcatctccacgctggtgagcccgctgttcgccgctgccgattcctacgccggcctcgccctcatctggttcatgatcccgctgttctggttcatgggcatccacggcccctcggtcgttaagcctgccctcaacgccgcgctgtttggcaacatcaccaccaacctcgccacgctgcaggccggcggtcaccccgccctcgccctgaccgagaacttcggtaactacatcggcgaactcggcggcaccggcgccacgttcattgtcccgatcatcttcctgctctttatgcgctccaagcagctcaaggccgtcggcaaagcctctgtcgtacccgtgatgttcgccgtcaacgagccgctgctgttcgccgcgcccatcatcctcaacccgtacttcctgatcccgttcctgtttgcccccgtggccaacgtcctcattggtaagttcttcatcgactttttgggcatgaacggctttatctatgccatgccgtgggcactccccggaccgatcggcaccttcatcgacaccaacttccagccgatctctctggtcctggttgtcgtcctgctggtcgttgacttcttgatctactacccgttctgcaaggcctacgacaacgtcctgtgcaagcaggaggccgagaccctggccgaagaagaggccgaggagaccaaggccgtcaagaccgctgccgcccccgccgttgaggctcctgttgtcgagaccgcttctgccaccgaggcctccgcagctccgtccgcccttaagggcaaggatctgagggttctggttctgtgcgctggcgccggcacctctgcactgctcgccaacgcgcttaaggaaggcgccgacgagctgggcatcgacattaccgccaacgccggtgcctacggcagccactacgccatcatggaccagtacaacgtcatcgtcctggctccgcaggttcgcacctattacaacgagatgaaggccgacaccgaccgcctgggcatcacgctgctgtcgcccaaaggcaaacagtacatcgacctcactaaggatcccaagggtgccgtcgcctggatcgaggaaaacctcaaggcataagacgctgatgccacctgccgctcgcagacaaaaaatggcccgtgcatcgatgcgtgatgcgcgggccattttgtttagaccgcacccgccctcctgttcatctcaatctgtaacatctagccgagtttttggatcctagctgttacagatcgagacaaacagaacgcccgagcagaaatatctcaatctgtaatatttagctgagtttttcggtcctaactgttacagattgagacgaacgggccgaaaaaccctacgcccgcaggtcctttacgctggaacgttcgaccaacacgcccgagacgagcgtacggcttctggagctcggagcttctaggcccgcaacgacctcgttgagcgcacggacgcccagctcgcggtggcgaaacttcaccgacgtcagaatcgagttgggaatcgtcttgtaaagctcgtcatcaaagccgatcacggacacatcatcgggcacactcagacccttgtcacgtagagccatcatcacgccgtttgccatgcagtcgttagcagcgaggaccgccgtgcaatcgggtttatcggcaagcacaaggccagcggcatagccactatccgcattccaatcgccttgcagaggctcgggcggctcaatgccacgcgcctcgagcgccgctcgccagcctttcattcggcactggctcgacagcgactctttcttacccgaaacgaagtacacgttcttgtgcccgtggttcaagaagtactcgcacgccatgcgcgcgccgccctcttgatcgtcactgacggtggagcaggtaggatgttccattggtgtgataatcaccgtcttgaggtctttcggcgcctcaaaggtatcaaagtcatcgaccatctgacgcaggttgaagatcatgccatcaacaggcagctgcgacatcctgcgcgccgcatcggcaagggtcatcttctccccagcgcgctttttgatcatcgtgagagcaaagcctcgctcttcggcggcatcggcgataccgtcaatcatgtccacggcgccgcccgacaagtgaaacatcaccacgccgatgcacccgtaacggcccaacttgagtgaacgcgcggcaaagttggttcgaaacccgagcgcctccatggccgcatggaccttatcgcgcgtcgactctcgcacgctatcaggctcgttgatcacgcgcgacaccgtcttgagagaaacacccgcggcaactgccacatcgttcattgagacatttttcttgtccatcgttgccactacttctccagtcggttttgcatcgcttgttttttgtgttctagcatacactacctgcccaactgacaaatcagccgtttatcggacaatatcgaccgttcacccgtaaatccttgttgctcttccaaaaatgtcttacgttgtcattaacgaaatgacaacgttgtcatttcgcaatgccttccttacccaggaaggtttccgggcagtcctgaccatccatcgacgaccagttccatccacatgcatcgcgcatcaagcagcaaaggagctctatggacgccatcgtaaagatgctcgaaaagcatcaaccgttctttgagaagatctcgaggaacatctacctccaggccatcaaggacggattccttgggtgcatgcccatcgtccttacctcttcgatctttctgctgatcgccacgcttcccggcgtagtcggcatcacgctgccccagccgctcatcgactggtgcaacaagctctacaacttcaccatgggcgtcatgggcatcatggttgccggcaccaccgccaagaacttcacggcatccatgaaccgtcgcatgcccgccggcaaagtgctcaacgacggttccaccatggtggccgcccagtgcagcatgcttttgctcgccgttacgcagttcaccaccaagttcgacggctccgagctttcggtcttcgattgcaccagcatgggtacgcgcggtctgttctcggcctatatcgccgcgttcattaccgtgtgggtttataagttctgcgtctcgcgcgatctgaccattaagctgcccaaggaggtcccgggcgccatcgctcagaacttccgcgacatcatcccctttggcggcgccgtcatcatctgcggcatcatcgatgtggttgtgcgcaacctcatgggcgttccgttctccgagctgctcatcaagctgctctccccgctctttaccgctgcagaaacctatcctggccttatccttatccaggcagccaccgcgttcttctggttcatcggcgtccacggcccctcgatcgtccagccgggcatcgaccccatccgtcttgccaaccaggccgagaacctgcaggttctgctggccggtggccaccccgcccactccctcacctttaacatgtcgctcgtaggtgagttcggcggcaccggcgccaccttcatcgtgccgcttctgctgattctctttatgaagtccaagcagctcaaagccgtcggtaaggcctcgattgttcctgttgcctttgccgtcaacgaaccgctgctctttggcgcgccgatgatccttaacccctacatgctcatcccctttgttgccgccggctgcgtcaacgtgagcgttgccaagttctttatcgataacgtaggcatgaacggcttctccttcgtggtgccttgggccacccccgcccccatcggcatcttcatcaccacgaacttccagcttatcgccctggtatttgtcgcgatcatcatcttactggacgccatcatctacctgccgttcttgaaggcatacgataagctgctctgcgaccaggaggccgagcgcgccgccgagctgggtctcgagtccaatggtgccgctgccatcgccgccgacgcctctgcgcccgctgtcgagcaggccaccgcttccgtcgagacgaccgccgctgccgccgaaagcaagcctgtcgccgatcagcccgagcctgccgccgacgcatccgctaagaaggatgtcgacggcctgaaggtcctcgtcctgtgcgccggtgccggcacctctgccatgcttgccaacgccatcaaggaaggtgccgcgcagaccggagagaacatcgcttcctccgcaggcgcctatggtcagcacactgccatcatggatcagtacgacgttatcgtgcttgccccgcaggttcgtagctactacaacgacatgaaggccgacaccgatcgcctgggcattaagctgctcgccccgcgcggtaaggaatatatcgaccttactcgcgaccccgccggcgccattaagtggctccgcgagaacctcgactagtttcctccctctgttggtgcccggatccccagttcgggcacctctccctattcgtatcccacagaaaggatgactcatgaccaaccccatgcagttccccgacggctttgtctttggcggcgccaccgctgcttaccaggttgagggcgagacccgtacgcacggcaagggcaaagtgccctgggacgatttcctggcagcccagggtcgcttctcccccgatcctgcaagcgacttctacaacaaatatccggtcgatatcgatttgtgccagcgctttggcattaacggcattcgcgtctccatcgcttggagccgcatcttccccagtggcaccggcgagattaaccccgagggtgtcgctttctatcacgagcttttcgccacctgcaacaaagctggcgttatcccctatgtcacgctcgatcacttcgatacgcccgaggccttttaccagaacggcggcgagggtttcctgacgcgcgcgacgatcgacgccttcgtcgagtacgccaagttctgctttgccgagttcaccgagatcaagcactggttcacgtttaacgagattcccgcaaccgccgagggcagctttatcgtcggcaactggccgcacggcgagaagtaccgcctggacaaggccttccagctcatgcacaacatgatggtggcccacgccaaggctgtcgtcgccttccatgagggcggctttgagggcgagatcggcattgtccagaacctggagcccaagtatcccctcgaccccaacaacgccgccgactgcgaggcagctcgcatggccgacgtcatcaacaaccgctgggtactcgacgccaccttccgcggccactatgcagccgacaccatggaggctgcgaccaagctggcccatatcgccggcggcgagctcgacgtccgcgacgaggacatcgccgcgctgaccgccgcgctcccctacaacgattgcctgggcgtcaacacctacaagtgccagttcctgcgtgccgccgagggcgaaaacgacatcaaccacaatggcaccggcgacaagggctcctcgcgctggttcctcaagggcgtgggcgagtcatgcgtgcgcgaaggcgtacccaccaccgattgggactggatcatctatcccgagggcctctacgacctgctgctgcgcattaagaacgattaccccaactacaagaagatctacatcaccgagaacggcatgggctataaggacgacttcgaggatggctttatcgacgacgcccctcgcatcgactacatgcgtcaacatctcgcatggatcctcaaggcaatcgacggcggcgtaaacgtcgacggctactttgtgtggtcgctgcaggaccagttctcctggaccaacggctataacaaacgttacggcctgttctacatcgactttgagacccagaagcgctatcccaaggcgagcgcgtactggtacaagaacgtcgcggagaccggcctgctcatggcctagtttccgccgcatacccctgtcggccgcatgcgaatccctccacgggttcgcatgcggcctttttgttttcgcgcgggtcggcagccgtttgtctaaatctgtaacatcaagtcgatttttttgcctctacctgttacaaatcaagacaaacgggaatcactctgccgaaacgtctcaatctgtaacagatatctgctcaaatcgagtctaggtgttacagattgagtttttgatttgggaggttgaggatgggggatcgcgtgccgaaagcatggtccccggataaaaaagctcgccggccaggccgaagacatggcccacatcaaggcagacctttgcccctgctcgcccgagcaaaaagtcatgcccctcgatgcgctctgccagtccggcaccgagaccccgcaatggcggtgggatgtgctggtcggagagggcgacccgctctactgcaagtcccgagagatctaagtatccgctgcaaggtataagaacgaattggagccctggtacataccggggctcctcgtggtagtggctgtctaatgaatctggtggctaggcctcttcgccgccactggattcagttaccgtttcctcctcactatgttgcgtctctctcgtagcctcatcaacttctgttgacgaatgtgcctcttcgtatgcttcgatgttcgccttgagcatggttgcactctgttcagcaagagcgatcttcctctggtgcttgtcgtaggcatacagtccgattccacctgcgactagcgtggctacagaaccgattactccaccctggattcttccaacggaaatcccgcccgctctgatattgctgatcagcgcctgaggcccaccgagctctttcgccagatgcgacaattgcgcatagtcccaagtcgtcattgccttttcctcactttctttcacttcagcaccgcttccactggggtgctcactttcgacagtgctatcatgccatcggtaaataagacggtatatgtcctataattgtcttatctgttgttaatgaggaatgattaagacaatgtacgtccgcaaagatcgccctaaggacatttttccaaagagactcagcggtttgatggaaagctatgaaatagaaaaggggcgcagaggcattagcaatatcggccttgcgcgtctgctctatcaaaagcgtaacggtgccgatgatgcctcgctagccgatgaccgctatgcagtggaaagggagaacggccgcaaggcgattgcgagaaagatcagccgatttcgaaaaggagatcagtttcctcaatgggatgacctcgtagatctggctgacatattcggaaagccagtaggttttctcatcggggagaccgattgtgatacgtacgagctccaagatattgctgacttccttggtctcagcggcgaggctgttctgtccatcgagcgtatgacgagaaaagttagtgcggagtggcttccggaacagtctggtggcaacggcggagaccatgaggaatgggaaaaatacctcgtgaatgatatggtcgcgaaggcgaatgccgagccagaagcttgcagggcagtgctcaatcgaatgctgaccgcagcagcgtttaaagaccttgtgctctgcctgtctgaggtcggcgatgcccaatacaatctgcttatggaacgcattgcaagtgcggaaatagaactgagagacgcagacgtactcagtgacaaccacccagactccatcatggggcaaatggcggcaaaatcccgattcagggatgctgcaacacgcctgcaggaagcggaaaatgcggtgaggtccagcaggtatgcagcttatgaatgccatgtccgcatcgttgatgaaatgttctcggatattacccagactgacgcaaataccgtagccaaagagcatgtcaagcagagacagtcaggtaaccaggcgtagccgtcgtatcgatacggaagtgggtataaaccgtcctgctgcttgcatacgtggttccgttgccgcccgtcagcttgtagcagttatagaagcactgcgagtccgaaaccccgctcgaaggcagcgcccaggtggcgtcggcgtagatcgtcaccagcgacgagcaccccgagaagcagtaggtcaggtcggtgagcgcagacgggtcgaagcctcggaagtccagctcggcgggcgacgagcgcgaagcgaacgcgaaccgcacgacttgacacctgcgaggttgcccaaaccggagaccacctccagcgccgtgcataagtagaagaggtgggtcaggttcatggttgcgaacgtcgccctgtctgccgcgaaggcgatgcgctcatcggccgcctggccttcacctgctggatttcgtcgcgcagggcgtccgccacctcggcgctcttggcagcctcggccacttgcccctcaagctccttgatgcgagcctcctgcttggcgagaagcgcctggtagcccctctccgagtccactgcctgcggctcttccgcctgcgcgaccccttcttggccgcccgcctgcgctgcgacctcttcctcgtcgtcgatgctatggtcgtctccgtccatgtcggcctgcctttcgattgacataggccagcacaaacgaaccgtcccttaaccatgcaaataggctaaaggtcggtcacaaagtgaggtcatccagtccgttcggcagtttgtgaccattagcaagaattagaggcaacgcaacgagcgaacgctcgataatggtctagaatattggacttgacatttgggaggcaagatggagactgtgaaccttatccttggaattatcgcgtctatcgcatccatcgccgccgccgtcatctcgctccaaaacaagcaagagatcaagtcaatcaaaaagagtctaagcgacaactcgcagaccgctacaggtaaagttgccacaaacgtcgtaggcagcaacaactcggcgaacatccatgcttcgcgataagccaacgcagacaagccagagcgcaattggaaaggtcgccacgaacatagccggcgactccaatagctatgactcacatgacataaacatctaccagcccgtctcgtctggcccgcaccggccgcttacaaagacgctcatgtataaactcctgcaaatcatgatttcgtcgactgagccaacgggcgaagatttcccccttacgcctccgcctcctatagagaagaagctgatttacaaccacgcaccgcgttacctaaacatcatcaacgagtattctgagaactacgctcgtctcgacagcgtgatcaaggaattccccgacagcgaagccatcatccaaaggctgaacaagatgtttgtcaatgtggcagacgttcgcgatgacggcaagctgtgcgtaggaaacggcgatgcacagctcaagctcatcgagaacgagatctataacatgattgtgaatgacgcaagctttcaggctgacgaggtccccgaagaaatcatcaaccagttctgcgttgcgttgattgccgttgccgtggcaaaatgcagagtccttctgaggccaggtgatgacgatgctgctgcttgatcgcaataatgagccgacgagcacggtctattacatcgctgccgccttggatggctacatcgaccagaacccaggcttggacgccggtcaactctatgaggtaacggcgaacactctggtcaagaaagaagtgagctacgacttctttgtcatggctttggactttctcttcctcctcggacgcgtgtcaatagacgagaagggagggctacatgttcatcaagtcgcttagaattcgcaagacaacaactgacgaaatagttcgcgaggtcttattccacaagggtgccaacctcatcgtcgataccgaggactccgaatcgcacaatcgcgttggaaaaacaaccttcctcaagctcattgatatcgcaatgggcgccaaggacaggaagctcatttacacagacgccgacacgggcacggtgaccgaggagctacgcgatttcatcgtcacaaacaagatcgccgtcgacatgacactgacatcggattttcccgatggcgatgacgtgattctcacaatcgacctcttcccgaatggaaggtactacatagacggcgaaaagatggggcagaaagcttaccagcaacgactcaatgtcttgcttttcgggaacgaagcgaatgtgcccacgtttcgccaattgatcaattcatttgtccgcgtgtccgtaggcggggatgataattccttcctcaaaaccgttcccagcggcagcacatccatctaccggagtgtctacaacgctctgttcggcatctcagatccggcgctcgacaaaaagcgtgacgacctcaacaaggacttgaacaagacgcgtgagtccatcaaacgctataagaaagtccagaacgtcgatacggtcagcgagcagcagcagatacttgcagggctcgaagccgagcatgaagaagtccagtgcaagctcaacagcatcatcgacgccgatgtctacagggccaaccgcgatgaaatcgcggctacacgcacccgatacgcatctctgacactgcaactctcagacatagactacaggctgcaacgaaatgaagaggccctgcagactgctatgcaagagcgcggtagacaagccgacgttaatttgagcagacggtttttcgaggaagtctgttcgatgatcccgatggtgaatgcaactttcgaagagatggtcgcattcaacaaccagctctgcgacaacaagattgcctatttcgcgagtgtggcagaaaaactgaaggccgagcgtgcatctgtgcaacgtgaaatcagccaactgtcatcgcagaacagccaattcatgtcattggtggagcaagacctcatcgatgagtacgagtcgcttcaggcacgcctagttgagctttcgagcagtatcggcaaatgccgagaagtaatagatacgctcaacagctttgaggtagaacagaccagcattgagggaaaaatcgcatcgcttggctcgtctgatgatggcgacgagccgcaatccaacgattttgctgcaatgatgcttgcgtttaacgcattcttcactccgcttgccagggagttcaacaacgaatcgccgctgctcgtttactatgaagagtcgaacaagttccccgttgcaatacgtgataccgctggctccagcacgggcacacgcaagtcactcatcgccgcatttgatttagcgtatcagcagtttgcagaatcaaagggcatcaagactccgcgcttcatagtgcatgacgtccttgaaaacatcgagggtaaggtgttgcgtgacataatcgcacgcgccagcacaatcaactgccagtacatagtcgcagtccttaaggagaagctcgattcgtcgctgataccagccgaggagcagggtaaactgcaaatcctgcagctttcgattgacgatatgcttttcacgcgtggcaaaggtgttgcgtcgtaggagtgacctgtactctcctactcccgtatccccaccgagaactccccgccgaagttgttcacctcgaaccgctcgtcagccacaagtccctccttgctcacacggcacgcgaacggaaacaactcggccacgtcctgcagttccaggaacgtccggtaactcgaccggtttaccagcatgtcggcaaagaccaaaaaccgcgtaagctcgtcattcagttcgatgggctctgcaatcacgtagtgcccccgcctcacgcgccggacaacgccgaactgattgagcgatgccacaatcttttcggagcccttcaggatggtcatgcgcttgcgcgccgcctcaacgctcttattgtcccggcctagtcaagtacccgttgcctctcctcgaccatctcgcagaagcctcccacatccatgagccattcttgctgtgaaggcgtgtaggtggggaaaagctgggaggggatgacgagctggagcttgctgtcacgcatggcgttcgtgtagtccacgctcacggcgggctccagcgtgataaggtgcttacgctcgatgcggttcgcctcctcgagcacctgcctccagcgctccttgatggtcgtcttcgcaccgagcatcgtaaggctcgaggaggggaacccctcatcccggtagcactcgattgacggaaaaatgaagtccggcttcgactttccctcggtgtagggctgtgcggagtatcggattcccctacccttgaacaggaactcaagctggtgctcgaacgctgtgcccgcgcgggacttcctgcgctggaaggtcgacatggtggtcttcagaatgccgtcgacgtcgagctggccgttcaaatagggcgcaaggtctctctcaagcagatggcgctcaaacaccttgaacagcaattcctcgcgctcgtagcacgcgagcaggcttcgatcggggtcatccgcccagtcgagaccttcaagggttgagatggagtactccgtaaagtcgatgcccttcggaaacgtatgtccaaacctcttgaccatatcgtccaagtagatatccgcgctcaagggagcgcgcgtctcgataccaatcatgccgaggatgcgcgaggccaccgcaccgatacggttgcgctcgccctttgatacggcatagcccgagcggtcgggctcctcgaagccgaacagccacctcagctgcgactcgatggtcgagccttttttagcgaagatgatgagcagcccgaggtcatcggagttggcgaccaccatgaggtcgccagcggatgcctgcctgatggcggggttgtccttgtagtagagacggtactcggttctcgtgggatgtttgcggcgcgcatcgtaccaagtcacggtcccgtcgcacatctccggctccgcctcgtcgcacatgtaggcgaacgtggtgcggatgtcgcggatgtcgtcgtcaccgaacagcgacctcagcggcagcgtgccgttgaactcgtgctgattactcctacctgcgtcgatatcgacgtccgcgagggtcttcgagaccgcgccgtcgaagtagctgctaagcgccccgtaatccatcctgacacgctcccatcatgagcttggccaccgaccgtattacagggaccgtcaccgaattgccgaactggcggtaggcctgtgtgtcggagaccgggattatgaaccggtcgggaaatccctgcaagcgcgcgcactctctaggggtcagcttacgggggttctcgccctcgccgcgcgagaccaagatctcactaccgtccttatgatagcgtgcggagagcgtcctcgtggtgtccgatggagtgataagaccgtagccgaacccgttgccggcggcctcgtgcttggccttgtatgctttcaaatatgaccacagcttgtcggagagcacgtacctcgcgtccgcatcctcctccagaatctccgcggctttctgaccactgttcgggcagtcgaggtcgtcccaagagaactccacatcgtcgcgaaagccaacaatgtagatgcgctcgcggtgctggcatgtccaacccttggagtccagaaccttgtagtgaacgtggtaaccgagctcgtcctggaggacctgcatgatgacgtcgaacgttctgcccctgtcgtgactgatcagattcttcacgttctcgagcaggaacgccttcgggcgcttctcgttcaggatgcgtgcaacctcgaagaagagcgtgccctgcgtcttgtcttcgaagcccgtagcgcgaccaagggagcgcttcttggacacacccgcaagcgagaacggctggcatggaaagccagcgagcagcacgtcgaagtcggggatgtctgaagcggcgacctcacggatgtcccccgccggggtttcgccgtagttcatgcggtaggtcttctgcgcaaacttatcccactcgcaggagaagacgcacctgccgcccagctcctggaacggcatgcggatcccgccgatgcccgcgaacaggtcgatgaaggtgaaggcaggcttcccctcccctgcgggtgcaaagggggcgcgatggccgagggtggagatgtacttcgactcggctgcggtgggccttgtttcgcctgcctcccagcggcgcaccgttcgctcgccgttggggcccatgcctagggcagcggcgaattccttctgagtcaagccgagctcctgtctcttggcctttacctcatctgctgataattgcatgacgcaccttctggatagataacaggacaatatgtcctcattttgccacagggatgaagagataaactcgtcagaatagcaaccttgccccaaaccatgggtttctcacgtctcccacatccgacaatccatgtaccactcaaaccgcgaagacccatctaaccaccgctgcgttctatacgatagtcgttcgccaggacatttttctgccgccgcagtcattagtccaagtgaaaagcggcaagccgagaacctcacgcctctccatcatcaatcattccatttcacaaatgacgcagcggcgcaattagcaacgcggagcatggaaccatgctatacccgtccaaacgatattgtccgcgcccaacagctatcaatcaatttaccttggcctgctggcgcagagagtgcagccaagcctcatgatcatcgtaacaataaagaacatgggatcgcgaggatttgccgaggcgaatgtactccggccccttactaggacagcgccaatttgcaagggtcttcgcgcttacgccaatcaactttgctgcctcttcactcgaaaacgcaagcgggcgtacggattcaacagcgcatgtcacgccgtttgctccacccataaagaccctcagactctccgatcacacccacccgttacagattgagacaatttgacggtaccgaattcttgtcaaggcgtggtacaattgtgtcccaacgcaaaggaggtacctatgcccacctgtgtgcccgtccgagacatgaaggacaccgctgcatttaccgcgcttgttgagtccgagcgcgacgtcaccgtaactaagaacggctatgaggccatgcactgcatcagcagcgaccagtatcgtctcatgcaagacgaaatcgccaaagccaagctgctgtctcgtatgatgttggcagaagacgagatatcgcaaggcgactacagcgactacgactccttcgcgaccgcgatacgagacaaatatggcctataacgtcgtaatactcgaaagcgcacaatatgaatacgaggctattgtcagataccttgctcaaatccttatgaacccacgtgcagcaggcaattttgttgctgagtttgaatatcagcttgatctgcttcgcgagcagccgctcctacggcccctctcccacatacgagagctggcggcacgcaattatcgatcgtttaccgtcaacaaatacgtgtgtctttacaagtttgagcgcgatacgatctatatcgcccatgtctttcatcagtcacaggactacggccgcctggtctagcccacaaactgaatacttggtccgatctcccgcagcgatagctagcaaatgatctgcgtgtgctcctcgatggcggcgcggtcctcggcggcgatacccggttcgcacaccacggcgtccaagctgtccaggcggcagaaggtgtagaagtcgcgcttgccgattttactggaatcggcaatcaggtagcgcgagtctgccttgctaaaggcgagctgctggatacggccctcgtccatgttggacgtagatacgtcaccgtccaagataccgttggcaccgataaacgccgcatcgatgcccaatgcccgcagggtatcctcggccgttggccccacaaaagcggcggtgcggcgacggtacataccgcccacgaggcacaaatcacagtcttcgcgcgcctcgagcaggctaaacaccgaaagcgaattagtcacgatgcgcaggcgaaacgccggcagcatcgaggccatctgctccaccgtagtgcccgtacccaaaaagatggtcgagccttcctcgataagctccacggcacggcgcgcaatctgcagcttttcctcggcatgcttggtgcgcttttcgctgtgcgaatactcatggcgcaacatcgcgtggggacggccctgtgcactgcgtgctccgccgtgcacgcgctcgatctcgcctaggctcgcaagctcctcaagatcgcggcggatcgtcatatccgagacgcccagtgcatccgaaatctccttgaccgagaccgtgccctgctcttcgagcagctgacgaaccttatcctgtcgctctgccttaatcacgatgaatcctcgccgttctttgcgcgcatatcattcaaacagtaacgaacaaattgtatcagactcgtacccgtcaaaaatgaacgcccgcacagttccaatcatcacttttttgagaaaaatacccctgctttagtggggtgtagtgataatctcgcctgttcgcgctacagtttgtccgaaatacctcgatgttaggaaccaaatgatcacttccgagcttttcggcaccgcgccgtgcggcactcccgttcatcgttacaccctcaacgggcccgagatctgcgttcgcattatggactatggcgccaccgtgcttggcatcgatgtgcccgacatccctggcaacgtgcgcgatgtggtgctgggcttcgataagctcgaggattactttgacaaccccgcctgctttggcgcgaccatcggccctgtggccaaccgcactgcgggtgccacgatcaccattgacggcacggactggcatatgccagccaacgaaggcgtcaacaacctgcacagcgatcttgagcacggcctgcacaagcgcgtgtgggacgttgagctcgacgaggtgcacaacgccgtgcgcatgaccacctcgcttgaggatggcgaactgggcctgcccggcaaccgtacgtttacggccgtgtttaccgttacgcgcaccggcgtctttcgcatcgagtatggctgcgagagcgaccgcgccacctacgtgtccatgaccaaccacacatactttaacctcgccggtcataacgccggcatggactgtgaacacttctttgttgccaacgccgctcactacctgcccattaacgagcagaacattcccaccggcgaaatcgctccggtcgagggcacgccgtttgacttccgcgagctgcgccccgtcgcacccggcatggaggcagacgacccgcagattaagcaggcccgtggctacgatcactgtctgtgcatcgatggctatcagtacggccgcaacctgcgccgcgcgctgcatgtcgaggagatgtggaccggtcgtgagctggattattacaccaccgccccgggcgttcagctctataccggcaactggcttagcgatgagcacgccaaggacgatgccaactatgactggggcgccggctttgctctcgaggccgagatgtatcccgatacgccgcaccacccgctgttcccacagggcattgtgggcccgggtcacccctacagcaatgtgatcgaataccactttatgaggcactaagcccacaacgcgacatatcgcacagcagcgcccgccggcaccaccgccgacgggcgcttttcatcttttgggctcattttcgctgtgactgcataagtgacatatcaaaactatgtccatttactacgtttagcccgggatgctcgaccatgcaccgctttttgttacattcgcgagccgtctacctgcggttttgtttttctcaaattcgacatgctcggcgatggccgatcaaacgtagtaaatgggcattgtttttgacaggcagcatcgcacgcgtccctcgcaagggcaaaatgattcgtttttctccgtccccaagggatcagttgaacagattgccgatggggtcgggattggagctggggagatagcggatttctagttctatgccgagcttttgcagctctctgagagcagcgacgtccgcatcgtctgtggcgactgcgggcactgcgggatgcttgccctcccctgcctgcatatggccaatgctgatcttggtgatcggcacgccacccttaaccagcgcgagtgcatcggcgggtgaggccaccatgatcagaatcaattggcgcggcgttgcggtatgaatgatgtcgatggccctttgcaccgagaaaaaccttgtccaaacgccttctggcgccgccaccctcatgggtgcccattggcgcgaatccgccgcaatctcgtcgttgacgattaggacaaggttggaaccagtcgcctcgttccacagctcaacgtcttgcccgtaaatgaaacggtcatcgatacgcgtgagaagaatcttgggttgagccatggctgccccattctgtttgagacccatacgagcgggacatcacgtctccaatattagtgcatttaaagtgagaaaagccgtcagaacccttgcgcggatgtgcgatgtcccgtataataaacagccgttgacgcctcagttgcgtcaccacatggccgccagcgtagctcagttggtagagcaccgctctcgtaaagcgggggtcaccggttcgagcccggtcgctggctccattgcacaagatagccgccttcgggcggcttttttcttgccgatttaggcttataggacaaaatgtgtgtccacgttgggggcatcggcgcaggtcgatgcccggaaagaaactgcaacgcgggggaggcgaccccaatggctttctcatatcgtctttcggctcttccttcttatcgctatcgccagcatcctcggtgaccgtcgccttgtcattgccacagccagtcaggagaccggaaacacccaggacaacggtcgcgaatgcgccaagcgcggcgcgacggctcagcagcacttcattttcgagctttttcattattcatccttcctacgatccggctaccgtgccggcacacagcacatcgtagaaaggattgaacttgaattcattagctcagagctaaggctacggtaaacggtcaatgcagttgtccaagcgccgagcaaacgctctttacgcgaccgtcagcaggcaggatcaacccactgtgacggattccccggtaaaggcgctgatcgtcaacaggacaaagaacataaggtagctaacgctcagcgggtatgcgatagccaaaaagacaatccatcccacattggttttgccgtcggcgcggcgttgttcgcgacaacgatagagccagatcgtcgcgccaatggcgacaatcagcaacacgagcgccgccgcagccaatccggcaagtgcaaacatcatgccaatgctcagcacaacaaccgggagcagtaacaaaccgcacccgcaaccacccggactatatacaacagattgccgacgtcgcttcatcgtcactccattctcagcgtctttgggccctacaatgcgatggcctgctggacaggaacaatcttgtcgagctcaggtttaatccgccttttctcggcctcgagatcaaacgccatctgcgcgcgaagccaataaccatccgtcagaccaaagtaacggcaaagacgaaggtccgtgtcagccgtcacacggcgtcttcccaagacaatctgcccgatacgctgagccggaatcccggtctccttcgcaaggcgatattgagaaatgcccatgggaacaagaaactcctctttgagaagctcaccaggagtcaccggcgacagcaaatcagtcgcagcctcttcatttgtggtaatcgacgatttcgacattccaagccatcccctgtctccactcaaagcagacccgataagatgcaatcatagtatcgccttacgttaataacgtcaaacgtttctatagacttacatctctattatagcgtacatctgttcgtgttttctagaacaggtatccttcgacacttaagcaagcaaaagcagtcgtttgtaaacatcgaggcctttgagcaggatttcctcgtcaaagagcatggtatcagtatgcagggcgcttgtggcataggcggaacagccgtccgaatcgctcgggttttcttgaccctccggcacgcccgtgcccagcaggaagaacacacccggcagatgacgctgatagaaggcgaagtcctcggcaatcagcagcggctcgtccacgagctgtaactcgggcagagcgggcgcgattcgggcaaacaactcgggggcgttgtcgaccggcggatagccctcggcaaagtcgagatcgtacgtgcagcccgttgcagcgcacgcctcgtcgagcacacggcgcacgccctcacgcgcacggtcgaacatgtcgtccgtaaacacacgcagactgccggcaacatgggcctcccccgccaccgcgttgcaaacggtaccggcctgcagcaggccgaacttaccaatgcagggctcgtcggcacccaactcgtccatcaattcacgctcggcaaccaagaacttggcagccgccagcgccgcatcgtgcgattcgtgtacgggaacgccgtaggtcttggcgatatggatgcttgtcccgtgaatgtgcacgtgcgtctcgctcgaacgcgccagcagcgggccggaacaactcgccaacgcgttcgcaggcaggtcgggccatacgtggaacccgaagatacggtccgccccgtagcgctcaaacaccccgctctcgcataccgtcttggcaccaccggtcgtctcctcggcaggctggaacacaaagagcacgttgcgtttgatggcacccggctgctcacgaatcgtgcgatcgacaaaggttgccgccgcaagcgccatggccatgtgtccatcgtgtccgcaagcgtgcatctttccgggatgcgtcgaggcaaaggccgcgcccgtcgcctctgcgatgggcagcgcgtccatatcggcgcgaatcgccgtggcatgcgcggcgcccgtgccagtgtcgaagaaagcgcaaacacagctggggcagggatgggtcacttcacaggcaagcgaggcgagcacgccctcgatataggctatggtttgaggaagatcgaaatcgagctccggaatgcgatgcaggtcgcgacgatagcgacgaagttcttggagctcggtcataaaggatcctttcatggggcatttccattcacacaatattgtgatgcagaattgtgacgcccttgtttctagcatatccctgcattttttaaacgttatatacgaatactcttgtttggtaaagtgcaacgtggtagggtctttaccacttgatagaggcgcgggcacgaagatccgcgggcgagtcggcagactttgaccccgcggggaggcgaaacccgccgaactgggtttttcgggcacgaacagcctggtgggcctgcgggaaacacccgcaggactgtctgcagcaatgcgggagcgctatccggacattgggtccacgctatgcggattcgatgcgccgatggcgccgtctggatagcgaggtttacgggacatggcactgacccccaacgaggcatatgcggcaaagcggccgtttgtggacaaggagacgctcgaacacatcgtcgagcagttccccacgccgtttcatctatacgacgaggcgggcatccgtcgcaacatgcaagaagtacgtgacgcctttgcgtggaatccgggatttaaggagtactttgccgtcaaggccaatcccaacccggcgcttatctccattctcaacgaatacggctgcggttgcgactgctcgagctataccgagctcatgatcgcccgctcgctgggcatcaccggccatgacatcatgttctcgtccaacgacacgccggcagcggactttgagctcgccgataagctgggcgccatcgtcaactttgacgacatcagccacatcgagttctacgagcgcgtcgcgggccccatccccaagacagtcagctgccgctttaatccgggcggtctgttccagctttccaacggcattatggacaacccgggcgattcaaagtacggcatgaccactgaacagctctttgaggccttccgtatgctcaaggccaagggcgccgagaattttggcatccatgccttccttgccagcaacaccgtcaccaacgactactaccccaagctcgcgcgcatcctctttgaacttgccgtgcgtctggagcgcgagacgggcgcgcatgtcgcctttatcaacctgtccggcggtgtgggtatcccctacctgcccgggcagcaggctaacgacatccacgccatcggcgagggcgtacacgcggcctacgacgagatcctggttcccgccggcatgggcgatgtggcgatctgcaccgagatgggccgctttatgatgggcccctacggatgcctggtcaccaaggccatccacgaaaagcagatttacaaggactatatcggcgtggacgcaagcgccgtcgacctgattcgccctgccatgtatggcgcctaccatcacgttacggtgatgggccagccgggtggccccgacaaatccacagcccctgtcacgaacaagtacgacatcacgggcaacttgtgcgagaacaacgacaagttcgccatcgaccgcgagctgccgcagatcgatatgggcaacctgctcgtgatccacgataccggcgcgcacggctactccatgggctacaactacaacggacgcctgcgctccgcagaggtattgcttcgccccgatggctcggcggatcttatccgtcgtgccgagcgcccgggcgactactttgccacgctcgacgtgctgccgtgcggccgcaagttgctggcctagtcgcgcgccgaaagcgcccgccgtcgcgctcaggacgagcgcctagccgtcgccacccaatggaacaaacgcatccagatcgcagaagcgaaggagaagaatatggacgtccgcaacctcgagggctcgatcgtcgccctcgtcaccccgtttaagaaggacggcagcgtcgactttgatgcgcttgagcgcctggtcgatttccacctgcagaatggcaccgacgccatcctcaccctgggcaccaccggcgagagcgccacgatgaccgatgacgaggacaactccgtcgttgccgccgtggtcaagcaggtcgcaggccgcatccccgtcatcgccgggtcgggctccaactccacgcagaccatgctcaccaagtcgctcacctaccagggcctgggcgccgacggcctgctgctcatcaccccctactacaacaagtccaacgaagagggcatctaccagcactttaagaccgtggccgatgcggtggacatcccctgcatcttgtacaacatccccggtcgttgcggctgcggtatcagcgagcgcaatgtcgagcgcctggccgcacaccccaacatcatgggcatcaaggaggcctcgggcaacgtcgcctatgccgccaagatcgcgcacctgctgtccaacgacttccgcatgtattcgggcgaggacgcgctcaccgtgccgctcatgagcctgggtgcctcgggcaccatcagcgtttgggccgacgtgcagccgcaactcgtgcacgacatgtgccgtgcctacctggacggtgacgtggagcgcgcccgcgagatccagattgccggccagccgctcatcaacgccctctttagcgaagtcaaccccatccccgttaaggaagcgctcgcccagatgggtatgatcgaggccaactatcgcatgccgctgtgccccatggcagacgacacgcgcgccgcacttaccgatgctctgaagggagctggtctgcttgattaagaccgtcattatgggaacgggccgcatgggctcgctcatccgcaccaccgccgaaagcatcgttggtgccgccggtcaacccgttttcgacatcgtcgcccagatcggctttgacctggccgagctcgagagcgctccggctgccgatgtgatcatcgacttctcgaacgtcgcgacctttgatgccgtcgttgcctatgtcgagcgtacgggcgccgcactcgtttccggcaccacgggctacacgcctgagcagatggaccgcctgcgcgagctgggccagaacgcccgcgtcatgcactcgggcaactactcaatcggcatcgccgctctgcgccatctggtggcccaggccacgcgcgagctgcccggctttgactgcgagatcgtcgagacgcaccacaaccaaaaggtcgatgcccccagcggcaccgccaagctactgctcgacgccgtggtcgaggccgagcccgaggccggctatcaccccgtccacggccgcgagggcatgtgcggcgcgcgcgaccccaaggagatcggcatgcactcgctgcgcggcggcaccgtcgccggcgtgcacgaggtgagtttctttgggcaggacgaggaggtcacgctcacccaccgcgccacaagccgtcagatttttgtcaacggcgctctggccgccgctcagaagctcgtcgtccgtgatcccggcttctacaccttcgaccaggtcatgttcgcctagccaatcattaaccaagcccgcgtaaaggagaaacaagatatgagcaacgcagccgagatggatgcacaggagattatcaactacatcgccaccgcgcccaagaagacgcccgtcaagctgtatgtgcgcgagaagcccggcatgaaagtccagtggggcgatgcgcacgtctacggcggccgtcgcggcaagaccgtctttggcgactgggatgagctcaaggccatcctcgacgccaacgccgattccatcgactactacgacgtggagaatgactgccgcaactccgccgtccccatgctcgaccttaagggtatcaacgcccgcatcgagccgggcgcgatcatccgcgaccgcgtcgagatcggcgaccgcgccgtcatcatgatgggcgccatcatcaacatcggctccgttatcggcgagggttccatgatcgatatgggcgccgtgctgggcggccgtgccaccgtgggcaagaactgccacatcggcgccggcaccgtgcttgcaggcgtcgttgagcccgcgagcgccacgcccgtcatcatcgaggacgatgtcatgattggcgccaacgccgtggtcctggaaggcgtgcgcgtgggcaagggcgccgtcgtggctgcaggcgccgtatgcgtcgaggatgtccctgccggcgccgtcgtggccggcgttcccgcccgcgtcatcaagatgcgcgacgagaagaccgacagcaagaccggtctcgaggaaggtctgcgccagctttaacagttacggcgttttaccaaacgccgtaacgactcgacgctgcaaacgcccctaggcggcaatctgacgttcaatcgtcggtcgcgtaccaaagtacgcttccctcctctttcacgtcaccttgctcgctctggggcgttttcgctgacgcatgctcaacctgcggcgcaatgtcagcaaccaagctaaaaacaacaaaggccgaagccccaaccagggcttcggccttctttatctcaaggttccgtcgtattcgaccatggctggatgcttcgacaaacgatcggcagccgtcttatagacctctgaacggtcgcgtcgacctattgcaacgatctcggcaatctcaaccgttccgtcctctcgaattcgaaataccattcggagtcccgcctttctccatttaatctttttgcagccggcaagctcaccgtgaagcggcgttccgatttcatcggcgcgcgtctttaatttcgccactgcaatgcggacgagccttcgctgagaaccatctagtttttgatattccttctcgacgtctcgattcaaaaagccgacgacaaagtgcccgctcattcgaaaagaccctcatccgaaatcgcgtcggagtccatcgattcgaactccgcgagctcctcaggagtcagggtatcttcaaacggaataaactcatgcggtccgtttttgattcgatctgccgcaatacgatcaagctcaagttcgcgaaggtactgtagggcgccgtacatttcctcataggcggcgtagtcgataatcacggtatcgatatcgttatgatcggcgataaactgcggcgcgcgcttagcgcgcttgcgaacgacagataaggacttgctcgcttcggtggcagaaactacctgatcttttgtaaacaccggcttttccagaacaagtggggacatttgtacctccaaaaaaataatctggattatatttcaaagtatacttcaaaatataatccagatttctctttggaagaaactattgcgctatcggttctcgatgcttccgatgttcttgagctcgatggagatgaggccgttgggctcgttgacgaactcgatatactcggagttcgagcccatctcggccgggaagctgatctcgatacccgtatcggttcgaatcttatgattgcgcacggccgcacgctcgacctgtttacgctccacgggcacgcgctcgggcaccttttcctcggtcaatgccgcacgaacgctctctttgatgaccggctcgtcctcaaagacctcgtcgacgatatcccagggcggcagttcctcgtcgtcttcgaccttctcggctacagcggctttgaccttggcgagcgccacagccgcgttggcgccgtgttcctcggcaacctcctcgaccacgcgtgtcacggtgtcgatgacctccttgcccgatacgcccgtgtcgcactggagcaggccgtcgggaatgagcatacgatcctcgccggcaatcttgcgcttcttatccacatagccgatctccatagtgctcgcgcgcacgatggcgtagctcggcaccttttgggaaggattcggcagaatagcatagtggcgcgcgatgtcgttgcgcacctcgccctcctcgcggcccacctcgtgcataaaggcctgcttggacccaagtaacatgacagcaaaccagcgggcgtcctcatcgtcgtcaaagtccgccacaagcacgtcggtagactcggccttttcggccttggcaagctccgaggagatgaactccgcaatctgctgcgacaggtccacgaattcgcgctcgccaaagaaatagcccttgagttcaccgccgaatgcggagttctcggcaaacgtggcgcgcttgttatcggcagacgtgcgggcgcgacgcagatgcgtggtcacgaagttgcgcacggtgcgactctcgatatcgagctcgcgctggctcatgacgctgacggccgagtcaaagtccaggatatgcaggattgcgtgattgattttcatatacggcattccgttctagatcgatttcagcacgaatcagtatagcgggcgtgcccgccccaatgcaccaacatgcccctttgcaccagcgttagcgcaggagctcggactgccacgcctcgagctgctctgccaggctcttgccggcagcaggaacgttgagctcggaacgcttgggcagcagggcgcatttaagaattgcgacgacggtctgcgagatgaaacggcgcgtatctttgtcgaagctctgagcagcctggagcatcaccggcaggctctcgcgcaaattccctgcgatatctgcgaaccgttcggcccctgtggcttcaaacacggagaacaacgcatctacaaagcgctcgcgctcggcaggccccactgcaagcagcatctcgcgaatagagctatcgacgtatcgagcgccggcagacagacgctcgcaatacacaaagtcgtagtcgtcaacgacccagctaaagggattgtgctgcagcagactgaattcggtgctctcgacaatggcgtaatcttcctgcgtctcgaacatcatgccgaaaatcgaagactggggcagggtcttgtcgatgcggccggaaagacctgcgaaggcgtcaccgctcaggaactcctcgacaaagccggggccatcgtgggagaaggcccgttcgatccggtcgccagcagcgtcagagcacatcgccgcgccatacaccgccaagtttccgcccttggaatggcctccacacaagagcggaccatcaatcgcggccaccgcctcgtccacatagcgcgccgcagattcctgggccggcacaggacaccggaaagccatgttaaagtcctctttccagcccacgatcgtgctgtcggtcccccggaaggcaagataggaaaatcctgccgggaatcggaacgtcatggccgcaaactgctccgtcgttgccacgtcgctcacggcacggtatccgcacacgcgcacgccgcggtagcgcggacttgccgcaacagcctccaacaaggcgcggctctcctccggatcccacaggtcgccaatcatgtcccggtagcactcggcgcgcagtagctcacgcacgtccagtccctgccagccggcaagctccggcatatcccccggcaagcgcaaatacgacagccatgcaaacaccaggctgtccaccgcgcaaaacggccgctcctcaaacgaatcgaacgccgtctgggcataactcaaaaagttaggcgaatccgacatgcctctcccatcaacaatggtgcattggggtcaggtttgtttgcaccaatcgtgccccatttggtgcaaacaaacctgacccccttgcaccaaaaaggcgcccgggccgtggggcccggacgccttcattgtagcttgctggcaaacgagccggatttagcaggagaaatcgacgctgtcgatgatgtccttgagggccttggcagaagcggtgagctcgctctgctcggactcgttcagcggcacagggacgcggcagacgacgccgtcgcgaccgacgacggtcggcatggagatggccagatcggacaggccatactcgcccaccatgagcgaggaaacgggcagaacggtctgctcgtcacgcataacagcggtgcagatacgcttaacggccatggcaacgccatagtaggttgcgtgcttcttctcgatgatggtgtaagcggagttcttgacgtcctcggcgatacgcttctcggcagcctcatgctccagatggccgtgaagctcgcagaaggtgctcagcggcacgccggcaacctgagcgctggaccaggcgacgaactcggagtcgccgtgctcgcccatgacgtaggcctggacatcgcgcggatcgacctcgacgtgggcgccgagcatctgctgcagacgaccggtgtcgagcacggtgccggagccgatgacatggccctcgggcaggccggacatcttgatggcggcataggtcagaacgtcaaccgggttagagacgatcagcaggatgccgtcaaagccggacttcttaatctcgggaataatggacttaaagatgctgacgttcttgttgaccaggtccaggcgggtctcaccgggcttctgggcagcgccagcggtgacgacgatcatggcggcgtcggcgacatcggaataatcgccggcgtagatcttcatcggctcggcaaacgtcatgccgtgcgcgatatccagggcctcaccctcggcgcggttcttgtccacgtcgatgaggaccatctcggagaacagaccgctctgcatcagcgcgaacgccgaagacgaaccgacgaaaccgcagccgacaatagcgaccttcttctcgttaaccattagaaactcccatctctctccacaaacaagccgcccgggaacgacccgagcggcttgtcgtaatcccaatacatccaatcgggactttgattatgctcctattcgcagccaaaaatcgaccgtttgccgaaattgtttgcaggattcgtaaaataactgcacgaaatcggtttcgatatattgacgagccaaaatagctttctaatacaggcccgcctcgcgaatggcctcgacagccaaagcgatctggtcgggcggcaggaccaacgccatgcgcacgtgtccctcgcccgagggaccaaaactcgcacccggcgtcaccacaacgccggccttctccataagctcctcgcaaaacgccatggaatcggtgcgaccaccgggaagcttggcccacacaaacatggagccatgcgcgttgggacgctcccagcccaggccctcaagaccgtcgcacagggcatcgcgacgctcctggtacttcagacgctgcgcctcgacctcatcgcgaggtccattaaggcacgcgatggcggccttctggatcgggaagaacatgccaaagtcgatctggctgcgcagcttggcaaaggcagagaccacatcctctcggccgaccaaaaagccgatacgcgcaccggtgacgttaaacgacttggagagcgagaagaactcaacgcctacctcgagcgcgccgggatactgcaagaagctgccgcccggctcgccgtcgaacacgatgtccgagtatgcgttgtcgtgaacgatcagcaggtcgtgctcgcgggcaaaagcgatgatctcctcgtagacctcgggcgtgcccaccgagcccaccgggttggcgggcagcgacacgatcatgtacttggcacggtcggccacctcgggatcgatgcccgccacatagggcaggtaattgtgctcggcaaccagcggatagtactcgagcttggcatcggcgatcttggcacccgcctcaaagaccgggtagcacggatcgggaaccaaaatggtgtcacccggatcgagcagggccaggcccaaatggcccacgccctcctgcgtgccgttgcacgactgcaccatggacggcgtaatgcccgaaacgccaaagcgacgctcatagtaatcgcacacggcttgcttgagttcgggcaggtcgcgcagggcatacttccacatctcgggatcttgggctgcttgcgtgagcgcctcgaccacatggtcgtacggcttaaagtcgggcgtgcccacgctcatgttgtaaatggtcttgccctgagccttcagcgcgagaagcttgttgttgagcgaggcgaagacctccgcgccaaagcggtcgagacgctgcgatgcctgcatggtgccacctttcgatataaaaaacgcggcgctccgacaagagcgccgcgcgatacgggccatcagattgcaaaagtgtaacgcttgcaacccccgtattggttcaatttagccaaccttagtcaattggattgagcgcgtcgatctgcgcaagccacaaacgtgagctggcgtcactcggcatacgccaatcgccgcgcgggctgagcgtcaccgagcccaccttgggaccatcgggcaggcagctgcgcttaaactgctgggcaaagaagcgacgatagaacgtacgtagccacgtgtggacggtcttggcgtcgtagacgccctcgaagctcttgagcgccatgcggtagatcttgcccggctcaaagccaaaacgcagcaggtagtagaggaagtagtcgtgcagctcgtacgggcccaccaaatcctcggtcttctgcgcaatctcgccgtcgcccgtgggcggcagaagctcgggagataccggcgtatcgaggatgtcgagcaagacctcggcaatactcccgccaaagacatcagccgcatagcgcaccagatgacgcacgagcgtcttgggcacgctcgcgttgacggcgtacatgctcatgtggtcgccgttataggtagcccagccgagcgccagctccgacaggtcgcccgtgccgatgacaaaaccgccagcctggttggccaagtccatcaaaatctgcgtgcgctcgcgggcctggctgttctcgtaggtcacgtcctgcacggtctgatcgtgctcaatgtccttaaagtgctgctccacggccgcgtggatcgaaacctcgcggaagctcacgcccaggtcgcgggcaagcgactcggcattggacttggtgcgatgcgtcgtgccaaagccaggcatggacacggccgtgatacccgtgcgcggcagccccagcgcatcgaaggcacgcacggtcacaagcagtgccagcgtggagtccaagccacccgaaaggccgataaccgcagccttggtacctgtgtgggcaaggcgggtcttgaggccagcagtctgcagattgagaatagtctcgcagcgctcggccagatcgccatggtcggccggcacaaagggcgcgcgggggaagacgcggtcgatgtcgaacgcatcgcgcaggacaggctcttcggccagcacgccctcaaacgaaaattcaacggtcgtggcctccggcgcatcgtcggtacgcgtccacgtcgtcgagcgacggcgctcggcaaccagacggtcgaggtcaacatcggcgatggccatatcgcaggtaagcagtttggtcgcggcgagcttggagccgttttcgtagacgaggttctcccccgcaaagaccatgtcggtcgtggactcgccctcgctcgcatctgcataggcataggcacagtacaggcgcgcgctctggttggatatgaggctgcgtcggtaatctgccttgccgataatctcgtccgaggccgacgggttgaggatcaccgttgcaccggcaagcgccatctcggtcgaagggggcgccggcacccacaggtcctcgcagacctcaacgcccagcaccaggtcttcagcaccctcatcacagcaacggtagacaagccccgaacccagcggaaccggaccctgaccggcaaactcgacccatacgggatctgcgggcgccggagcaaaccagcggcgctcgtagaactcgccatagttgggcagatacttcttggccgtaagacccaaaagctcgcccgcgcagcacacggcggcgcagttgtagatattctcggcaaccgcaacgggaagaccgacggtgaagacaatcggcagctcgcgggtttcatcgagaatatgtgccagtgcggtctcgcaggcatgcagtaatgtgcggttatggaacagatcggccgcggtataaccggtcaggttaagctcgggcagcaccagagcacgaacgccgcgctcgacagccgcgcgaacagccgccaacgcaacctcggcattgccctcgacatcggccacgcgaatctgcggcgacgccgccgccacacgcaaaaagccatcgttcttattagccgaaacgcagcattgccttgttgatctggacactggaggccccttctaccctgagattcagtctaacggacgttcacatatctctaactagccaaagcaacctcccagtttactgagaggccaacctgtgctaagagcatgtatttcaaaaatatctttaattaaaaaaggagaaatcgataatcgacttctcctttaagtgaggcgagtaaattccgaaactaatggcagaatttatccatgtagtcctcaaagtcgaacacttctaccacgacgccctcttcctgaaactctttcagttgctccaagagatctttgttaataacgtccatgcagaaacctcctctatctaatcaattgtagtatatctgctttcatgcaattatcaaccaacttgtttaattgctcctcgcttgccgatagtccctcttttttcaaaatgtcgcgcacctcgttcttagtaatcggcttttcaaacaacgaaagcaaagcgaacgaaaaatcattaaccgcacacattctatgggtggcacaactcagcagtactcttaacccctcttttgagcgtccgacttctttcacaaacgaacttttaaccaattgaaaaccattatcgtgcattacataatcggcatcgatatttgtattcagcaatccataatgcaacagttcttctatcgcccttgtcagctcgagatcgccctgatcaaggataagagaaatgctacaatcggcctccaataaacgggccaacttaaggtataccaactgggaaacagcatagacatgatggtattcagaattatagaagtaggcaaatggctcaacgagcacgacagaggtcttggaatccagccagattcgatcagctggatttagactagtcagccgtcgctttactttggtcaaatgtcccttatacctgacagcgtgaatagaatctaggatccaggtcacctctgaaatatgaagccgctggggcaagtcaattgtgtcgctaccgtttatgacttcttgcatataaaaatcaatatgatgctcatcagataaggattttgcttcatttaaagttaaaccagtgcctgaaacataatccacttcgaggcgcaaatcctcatattgggacttcggcattacagagacaccatacttatcgggatgattccaaacatccgaccccataacgagaccaaaattcgtaaatcctctcgtggaatatggaacaccacatacctgttttgaataattcaaaacattctctgtataagctaaggtgttcagagcctcttctttagtttcggtcggaaagccaatcataaagaatagatgaacaggaatacccgcattgagacaatcatggatattgcgatcaatccaatcaactctcgtgttcttcttcattagatcaagaactctttggttgtatgactcgaggccaaactgaatctgcctacatccactttggtatatcttgttgaaaacgtctgtacttagggttggagagaacctcgtttctccatgccagaaaaacgtttttcccgatgcgtttatttcatccgcgagttgctccattcttttgccttcgaatgtttcatccacaaaagagaaaactctcgtgccgtatttttcatttaaccgacacattatttcaaatactctcgatataggcatctttcggtaacaaccaccggtagcaccgggaatggtgcagaaggcgcaatgattaaaacactgcctagaagaataaaccggcaatattaactcaggcatgaagtatttagaaagggcgaagccatcgaaatcgggaactgtatcgttgataaatgtttgctcaatccgatggtttttatatatctttccacctttagcatggcaaaggtttggaacacagtcgagattgtcatcaccagagtcaagagcctcaagaagacgtgcaagcggctcttcgccgtcatacatcattatcgaatcaatgtattcaaaaaagggatgccattctttcatgcagtcatctgctaaacgagtaatgtaattgccgcccaatgagacgtgtttaacagatggacattcttctttaatcagtttcgctaacgtaactgcagaaatcaattggaaacagccgctcaccgaaatcccaataaactcgattttttccctctgaatacgcttaagaaaggcagtttcatagaaggaaataaacggattatgcaaggtatccgcaagcgatttcattatttctggtgtcgaataataatcatagggcagatctatggagttgaacgtgtatttaactccatatgagacgtgatttatgatatagagtgcatttctaaaaatgttttcagcatattgtctttcttttagattaaagtatctcttcgatctgaaaatatcttttgcctcgtcaacattaagtgctgacttttgtatcaactcgattgttaattgaacattcgaactaaacgaatcctttgattcccgataccttttacagcactcttcgacatgtctaaaagataggaggtcatcgtaaaattccacgtttaagtcaacgatgtcaactttatattgttcaacctcttgaagatatgacttcaaaacaggcaaggcaagatacggccccactggactccatcatgggggaaatactaaaagcgttttaggcatatcaacgtcacatctttcgcaaataattcaattgagacacaactaccatcataattgaaaatacaccaagtcctgtaacgagaattgagaacatcgcgatgctcgtgaacagcgaaacaaggagtgttgaaataacaacagcaaccgattgcaaagactccctaattgaaaacaggcttatcgattcagattcgtctctcgccaaatcctgcagcgatgttatgagaagcacatcttgaatggcgtttccggcaccgacgataaaaaggaaaataaacgatatcccagacgcatagcgatagccaaacgccagatacgcaccgagcgcaagatacgtcacaaaacaatatgatttaacgcaatcggaaccactaattaaacgaccatatattgtatttccgaacaacagtccgattgtaagactactctgaaggaatccgtattgtatcgatgacgagtcaaattgcaattgcgcaatagctggcaaaagagaattcagagagccgaatgccacgccactagaaatatcgattaataggaaaccaattgccaagtgcttcgcgctaagatcactaaatgcagtcctgtttttttcatttttgcttatcccctctttatcattaacctcgataaccgacggaacatctcgcagcaaccagaacgacgcggcaaaagaaagcgcgtctaatgcaagaacagcctccgccccaaattgagcgacaacaaaaccgccggcaactggccccagaaccatcatcaaattctgcagaaacccaaacgaattattaattacgtcgcgattgatactattcgtattggctcttaacaacgagtaaaagcagggcatttcaaccgttcggcaaagcgataccgcgcacgtaatagcaaacatactccatttactatcaacaaaaatatagcaaacgaataatcccgcgcgaattaagtctgccaatctcatggcctgcagtgtcccgatacccatcttctgaggcagctgcgcgagcgcaactgaaaacagagagggggcaaatctacagcagaccatcaaagcagttgcagaaacatcgtgagttacctcgtaaatcagcattggcaaagcaatattcgcacaccaattgcctatttcgcttatccctctagcaatatataggacccgaaccggacggctagctctcaataccgtgaacatcacgattaacctcgtatttcaggcctcgctcatcccttaataggaatccataatcaaccaagtaccgcctcaacacggcataatcaggatagagctgtgacagcacacgattaacctgaagctccgtataacttgtatttaattcaaagaaagagacggtccatagcagcatgattcttttatagctttccttttttggaattgaaaccagctcgccattcttgagaaatcgttttttaaagtctattagctcatccattcacatcctccatttcatacgcatctaatactaaaaatgcatacgctttaggtcatcgcattcgacttctatattcgaactaaactcgaactaatctaaatgatttgctcaaacactcttcgaaagctcgtttttcactctgagtaaaatgcccttcccagtcagtccacgaacaggaaggcaactcacaacgagcggagtcgaagccctctgccgtcggtcgttcaaaatgcgcgataaccttttcgatatccccatctgttatcaggtcagaatgaacgacctcggtaccgtcttcgaatgtcatatacgggtacatcacgtaaaccacctcacaatcgtaaatccagtttagcatcaagctattgcaccaaagacagcaagccccccttgatgagttgatggtatctgttaaatgtcacgtacgattcacatctggtgggtaccctgatggctacatgaaacgaagcagatttacaccgggaggaccccgtatgacaaccaagtacaccgacgcgccgcgcacgcgcgtcatgacgccggcatcgctcaacaacggcgtgcacgagaaccattccatcggacagaccatggccatcgcgcccaaaaagggcctgttcgacgacatttccattccccagatcatcgccggcgccgcggctgccgccacaagcgtcgcgcttgcctccaagatcggtatcgctggttcagtaattggtgccgccgtgagctcggtcatcaccgttgtgtcatcgcaggtctaccgccactttatctctgccagcgccgaagccatcaaaggtacgcacgccgccgtcgactaccctgccggcgcctacgagcccgctgagtttaatgccgaggagcacctaggcggcgccgcgactacgcaggagatgcgccagattgcggggcgcgcgaccacggcgcgcgtcgctcccgacagcctgcgcgccaaggcggcggcagagcgcagccagacgcaaaagaaggtcatcgtcttctcgatcgccatcgccatcgtcgcggtcatcgcctgcgccggcgccatccttatcaccaccgccggcgagggtctgggcgagcgccccgagccaatcctttcgtcgcgcacgaccgagagcgatgcaaatgacaacacccagtcgcaagatcagcaggcacaagcggacggcacgcaagacagttctacctctaccgattcgtcctcgaacacccaaaaccaatcgcagggcaccgattcctctacggccaacagtggcacgccgtccggcacgaccgactcaagccaaacggctgacggttcgcagccgaacacgggcagccagacgagcgacaccacgtcgggaacgggcacagcagacagcaacaacagcaattcgagtggcaccacatcgggcacgacatctgacagttcaagccaaggcacgacatcgggcaactaggcgctgcatccccagataggcaacctgtacaacgggcgcgaaccggcaacggtcgcgcccgtttgccttgggcgccgaggtagcaagccccgcgcgatggtaagatgctttggtgtgtaaagaggagatttgccatgagcaagacaatagttaggcccacgctttcgctgggcaaccacatctatctgtatcgcctgctgcgcgacgcgattgggtgcggcaagcaaacgtttatgacgcaggtcgaggaggcactcgccgctggtgacatggccgcttatgacctgggcttcgagtccacgcgcgagctgctcgaggagctcgacgactgcattaagctgaccgtctttaagggcggtcgcctgtatgccaccgtcatcgccaacgatgcctgggatgccgcccttgccaagggcgaggacaagcccaaggcagccaagggcgctaaacagtcctacaaaaagaaaaagcgcggtgagaaggacctcaaggccgtgcgccccaagcacgttaagcgcgccgagcccgagtccgtggccgaagtcgctccggagcccgagcccgagacatggatcgaagccgctattgaggtaacggcagaagccgaaaccgaaatcgccgccacgaccgatcccgaagtcatgtcagagcaggaagccactgccgagctcaacgaggctcccaagtcgacagccgaagaagccgccaaccaacccgagacgtctgcgttccaaaacagcgatgtctttggcgacgaggccgaggacgatcagcccgacgagcccgccgatcaaggcgctactgagtcgacgccggagcccgagacgccgcagcccgccatctcgctcacggtcgtctatgaccccgagaacgccaaagccggcatcaccaccatggcatccacgcccatcgaggcaaagtcgagcgtcgagaacgagaacgcaacgcaggttaaggttgaaaccgcagctgtagacgcgcccgtcaccgaggagcccgcagattccacgatcaagccggaagcgacgccggagcccgcacccttcatcgaatccgtgcccgcctctgcttgcggccaaattcccgcaccggcaccggcttcggcacccgcagcggccccagcccccgcacccgcagcaccgaccatccccgaggacttccccgtcgatttcgcaaccgaggtcttctgccccggcccgcttctgcaccagctgtcgacctatctcccctacggcgccgacacgctcggcatcgtcggcgagtactactggatcgcccgcgagcgcggtaccatcgaggccgcgagaaaccgcgcaagcttccccctgcgctacacgcaggccggcgatcgccgcgaggttaccgtgcgcatccgccgcaacaccgccggcggtctcggagccacctgggccatcgacaaggtcgaagaacccgagcagtaacgacaaacggctcaaatccaaatcaggatttgagccgtttttatttgttgatgttacgtaaccaaaccagcaataaacctagtcacgcgtgagcttgcggtggatacgatgcggctgggctgcgtcctcgcccaggcgctcgatgcggttggcctgataggcctcgaagttgccctcgaaccaataccagttgcccggattctcgtcggtgccctcccacgccagaatgtgcgtggcgacgcggtccaggaacatgcggtcgtggctaatgaccaccgagcagcccgggaactcgagcagcgccgcttcgagcgaggacagcgtctcgacgtcgagatcgttcgtgggctcgtcgaggagcagcaggttgccgccctgcttgagcgtgagcgccaggttcagacggttgcgctcgccaccggagagtacgccagcgcgcttctgctggtcctggcccttaaagccaaagctcgccacataagcgcggctcggaacctcggtctcgccgaccatcatgtggtccaggccgtccgagacgacctcccataggttcttatcggggtcgatgccggaacggttctggtcgacgtaggagatcttgacggtctcgcccacctcgagctcgcccgaagtcagcggctccagacccacgatggtcttgaacagcgtggtcttaccgacaccgttggggccgatgacgcccacgatgccgttgcgcggcagggtgaacgaaaggtcgtcgatgagcacgcgaccgtcgaactccttgtgcaggtgatgggcctcaagcaccttgttgcccagacgcggtccaacggggatgcggatgtcggtccagtcgagcttctggcttgcgcgggcctcggcctccatctcctcgtagcgagccagacgggccttgttcttggcctgacgggccttgggcgagctgcgcacccactcgagctcggcctccatgcgcttggcgagcttggcgtcgcggttaccctgagcctcaatacgggcggccttggtctccagatacgtggagtagttgcccttgtagggatagaggtggccgcggtcgacctcgcagatccactcggcaacgttatccaagaagtagcggtcgtgcgtgacggccagcactgcaccctggtagttgtgcaggaaatgctcgagccacaggatcgactcggcgtccaggtggttcgtgggctcgtcgagcaacagcaggtcgggagcctcgagcagcagcttgcacagggccacgcgacggcgctcgccgccggaaagtacgttgaccggcatgtcggaatcgggcagctgcagggcgtccatggcctggccgagcttggaatcgatatcccagccgtcggcggcgtcgatctcgtcctggagcttgcccatctcggccatgagggcatccatgtcgcagtccgggtcgcacatctcctcgccgatcttgttgaagcgatcgaccttggcgatcatgtcgccaaacgccatgcgcacgttctcgatgacggtcttgtcgtcgtcgagcggcggctcctgctgcaggatgcccacggtgtagccgggggtaagcctggcatcgccgttggagacctcctcgatgccggccatgatcttgagcagggtcgacttgcccataccgttggggcccacgacgccgatcttggcaccggggtagaagctcagggtcacgtcgtcaaggattaccttgtcgccatgggccttgcgagcctgatacatctggtagatgaactctgccatttgcctgttttatcctttctacctgctgtttccctattcttgattcgctttagtggaaacgaaatgaggaaaccagctctgaaacttaacgaaaaaaggggcatggttgcccataccccctaatactacctgggaaaagtcccccggaacatactatgaactgcgtacgctagttttccgcaaccttaacgagcggctcgctgcgatttgcgccacagcagatacgagtagacgtagacggctccgaccgaaccaaacgccagaaccgcaatcaccgcggcgacgacttcactcgaaagcacgctgcccgccacgcccatcgcaatcaggccaacacccagcaccataaagcaggcaccgccaaagcgcttcgtacggcgccagttctcgggatcggcaagcgcccagggcgtcttgataccgagtgtatagttccgcttcacacgcggcaagtagttgcctacgccgatgaacagcagaccgacagcaccggaaatcagcacgttaaccgaaccgaccgccggcaccacgccccagaccgtaagctctcccagccagcttatggcgcacatgaacaaggtgaaggcgattacgaagccctggtagaacttgcccgaggttcgatatgcctcacctttggggtcgatgcgcggcaccacgcagaacattgcgagaagcgccagaggcagcacgccgagcgcggaggccatccagctaggaccccaaccgtcgacggcgccgttcgcgccccagtgcgtgggaatctgcgtaggcaagctcggcatcaccatgaggtgcgctacaacattaatagcgcagaccacaacaagcatggcccacacgcgcgacgatacccccgtggggtgaatgcccttgttttcgttattcatccttatcaccttccgtgtttgtaaagcccataaaccagccaattaaatcctgcatgacggtggtgtttaagctgtatacgatgttttggccatggcgctcgtcggtcaccaacccggcgtttttgagcgtcgccaagtgatggctcagcgacggcttactgatatcgaaatgctcggcaagctcccccgccgtgcaattgccctcgcgcagcaactccaaaatgcgccgtcgcgttggatcggcaagcgccttaaaaccctctcccggcataagacctcctctcatcatctctcatgacgtgcacactatactcaatatttagatgtttgtctaactatctaatacaggaacatctatagaacattcgttcgtatttagctacaatggaagttgaagcagatgggccagctccctctacccgagaaggagatggactatgagtattgacgatgtcctgacgttgttattgcttgtaatcgcggctgtggagctcggcatccacattggaggtcgaatgaaatagccgccctcgcgtaatgcgaagacggccacttctcacgctacaaacgtgtttgggagttggccaacccgcggcaacgggtgccatctgcttcatcttatgcgaatcactgcctcatttcaacaagcccctagggctcaaatggaatcgcgataatacctataatgacgatagctaaaacacgattcgcttccccatcggaggatgtctatgaccgaaaccacagccgcaacccccaacgagacacgcgacaccaagctcgagatcatcatgggccgcgaggcactcgacaaactcgccgccgccacggtgctggtgctcggctgcggaggtgtgggctccaattgctgcgaggcacttgcccgcggcggcattggtcatttcgtcattctggataaggacatcatcgcgcccagcaatatcaatcgccaggccatcgcctttcaaagcaccatcggcaagcgcaaggtcgatgttatggaagccatgatccacgacatcaatccagccgctaccgtcatcaagcgcaccgaatacctgttgagcgacaatatcgacgagttcttcgcgagcgttttggagcagacggacggcaagctcgactacgtcgtcgacgccatcgacaccatctcggccaagctcaccattgccaaatatgctcaggaccacgacattcgtttggttagctccatgggcggggccaacaagctccatcccgagtgcctccgctttgccgacattttcgatacggtacgtgaccccatgagccgcatcatgcgcaaagaatgcaagaagcgcggaatcaagagtctgcatgtactgtttagctgcgaggaatcggttaagacacagccccgcgacccttccaatatccacgagcgcaccgagctcggaaccgccagctttatgccgcccatcatgggccagatgattgccggcgaggttatccgccagatcagtggccgcggcaccgagcgcgtgcgcgccgatggccagcgcttggactagcggagcgcgccgagatggagccccggttatttgatgcacactgccatcttgatttaatggctcacccggacgccgttgccgatgaggcaacggcgctgggcttgggtctatttgattgcggcgtcgatccacgcgacttttcggccgcaaacgagcgcgctcgtcgccacccgggcatcatcgccggcgttgggcttcacccctggtggctcgccgatggccactgcggttttgccgaagtcaatctgctttgcgaagttgctgcccaagaacgctacatcggcgaagtcggactcgacttttccgcgcgctttgctggaagtgagccgctacaaatacaggcacttaaccggctctgcgatgcgctcgtgcagcatcctcttaccgggcgcgtgatatcaattcacgccgttcgttcggcaggagccgtactggacgtcctcgaatcgcatggactactcatcccaaaccccgactcccccgctatcatcttccactggtttagcggcacttcggacgaactcacccgcgcgcgtaatgcgggctgctatttttccgtcaacgaacgcatgctcgcgaccaagcgcggtcgcgaatacgcacgacagattccactcgaccgcctactgctcgagaccgatgcgccggccgagccaaacacagaaacaagcgcgcagtcgctcatcaggtcgctcacaaggacctcagaacgcatcacctcgctcaaaaactgcgacgcaaagcgcatcgagtcgatagttttaacaaatgcgcgctctttttttgaccttcgctaacccctggtgtgcaaaaaatgccaaatatgagtactgctaccggaatggatacatttcttttaactttccaaccgccagaataatcctcgattgtccgctaattaaagcttttacagtcattcatcctgcgttttcgcaaatcttaaacccctccagacgctcaaatcacgtctgaaggggttgattttgctgcgactaaattagtcacagtactcatatttggcattttttgcacacgaggtcccggggaggatcctgcacctccccgggaccgctcggctattcgacgattggtgctccgtggccccaagaaccttccatgccgcacacggtcgaggcaaacccggcagcaaagtcgagcgcgcgctcgatagcctcggcgccatcctctccacgcttggcggaatcgagatagcacatcaaaaacgaagtgaggaacgagtcgcccgctcccatggtgtccttcatgtccgttaccggtttagccagctggcggtaataacgctcgccgtcgtaagcaatgcagccctcggcgcccgccgtagccgacacaaaacgcggacccaggcccttcacccatgccagacgctcgcgaatctcgtcctcactcgcggcatccgccgcactaaagaaggcaaaatcgacgtagggtgcaatctgctcgtagtactcgtcggtggagtcgtccgaaaagtcaaaagagaccgtgacgcccgcagccttcagcttgggcagctcgcgctcggtaaagcaatagttgcccgaatgaaccacatcgaactgcttcatgtacgcaaggtcaaagcgatcgaggacatagcgcgcatcgccacggataccgccctcgttggagccgaggaagacacggtcaccgtcaacgacggtcacgcgagccgctccgttctcgccaatcatctgctcgcacttgtcaagctcgacaccctcatcctcgaggcttgcaatgacatgctcggcagcggcgtcattgccaaaaatgcccatgtatgcggaacgtgcggcaccgcatttcttggcataaacggcgaagttcaccgcgttgccgccaggatacatggtgtggatatgctcgtagcgatcgacgacgttgtcgccaaatccgagcgcgttaacgttaaatgccatggcctttgtcccttctagtactcgacaacacccatatagcgacggaaatcgggatcgtgatcaaacaccttgccgcgtgcagcacgcagctcgcagttcatggcgtagaacagcaccgggtccagataggcacggacgctcgccggcacggcttccataccgtactccttggcatcgagcaccatcagcgtatcggtatgcgtcttaaggaacgccagggcgcgctcgtccatagcacggcactcgctggagcccatctgcaggaagtaaaaaacgccatcctgagtagcctcgaaggggccatggaagtactcggcagagtggatgtagctgcagtgctgccactgcatctccataagagagcagatagcgaaaccgtaggtctggctaaagttgggaccgctgcccagaatatagaagaactcgtgctcctggcaaagcttggcaaaacgatcgcccagctcggcatttaccttctcacgtgccgggggaagaatcttatccatctcggcgataccggcatacatatcggcaagatcggcgtagccctcctgctgatcgagcagctcggccgcaagcgacagcgaaatgccagcggggacctcagcctgcggcacgccctcgccccatgggtagacccacgtggtccacttgccggagtcgatcttagatccagcgttgtcggtctgggcgatcaccgtagcgccggcggcaagggcaatctcgcagccctcaacgacctcgggggtgttgccactgtggctgcaagcaatgaccagggacttctcgcccagacgacgcggacgcatgatatcgaactcgcgagccgtatagatatacgaagtgaaggtggttgcctcgcgctgcagaagctcgtgagccgggatcaaatcgatcatggagccaccacaagcaatccagtagacgctgtcgaacttgcccttctcggcaattgcctctttgatcagatcgtgtgcgttcatatccagttcctttcttgtttgggccgcaatcaatgacgttggttgcgtggccgatagttgttttagtcaatcagatatttctcgaatgcggccatgttcttggcatcagccgccgccgggtcatcgtagtaacgaccgtccgtgatttcctggcccagcatgccgtcgaaaccatgggcgttgagtgtggcaacgaaggcgtccatatcgtgcttgccatcgccccacaccagatggccatacgggtcaccgtcgataaagtgcatctcgtgaattgccccatcaccaaaggcggcaaaccagtcctcgagcgtctcgcctgcaacgcccatcgcggttgtatcaaccatgggctgtaagtacgggctcgcgacctcgtcaatcatgcgcttcgcatcggaaaccgtcgtcacaaggttgctctcctcgggacgcaggctttccatcgtgagcaccagaccgtgctcgccggcatactccgccagaatggacaagtgctcgcggctgcgcttccaggcttcctcgcggtcctcgtcccagtcgccccagcccgagttgatggacatacggtcgcacccaagtacctcggcaagctcaatgccgtgtttaaagtacgccagactgcgctgttcatgcagcggcttgcgtgcgcagtactgccaaggatagacaacgttctcggggcacagagtacgatacctaagcccacggtctgcagcctttttcgccaggacctcagcctcaaagtagcccgtatggtcgagcgtcacatgcggctctgcgcaccacagctcaatggactcaaagcccaaacgctgctgcacatcaaggaagtaatcgagcgaccacatgatgtagtggatattcatgcccgcaatctgctcgcggcgcagcgtcggtttggattcagacatcttatgcctccttatttcgatcgaacacgatttgtccgtccgacatcgtcatatcaaccgcaagatcgcgtgcgtcgcgataatcgaggtcaaacacatcccgatcgagcacgcagatatcggcaagcttgccgacctcgagcgtacccagctcgtcttcgcgcatcagatcgtacgcgcccccggcagtccaagcgcgcaagagctcgacaagcgtcagcgtgttgacctcattcacaggcagtccgtcggcgaagaatccgccgcacgcgctgtagattgactcgcccaggctcggaatcagcagcggcaaatccgttccacagcacactgtgcatccggaatcttccatgccgcggcgattccagctgtgcaaaagtcgcgtctcgccaatttgtcgacgcatcatcgacaggcaatcctcgcgtcggtccagcgtcagaacctgcggatagacctcgcaaattccacctaacttgccaaactcgacaagatcggtcgggtcagagttctcgagatcggtaatcgcatggcggcgaagcatccgtccatgctcgtctcgaggcagcgaggcatagagcgccacggtgcgacgaacggcgccatcgccctggcaatgcaaggaatatcggaatccgtcagcatcaattgcacgcagctcgttctcaatcagatcccactctggctcctcgacgaccgtcttgccggcagcgcccgcatcggccgagtcctcatagggttctatcatctcggcaagccccgcccatacgccgcgatcggtcatacggttgaagccagaaaaacgaacgaacggtccccggaagcgctctcgtgcctcgcgggcatatgcaagatttgcaccggcacccaccggctgcgacatcatagagacgcgaaccgtcagctcaccagattcctcacggcgagccatttcgtcggcaaagccgtagtagtcatcaaacgccatctccttgatggcggtaacgccgcgttcgttaagcatgctcatgtagtccgaataccctgcacgcacctcgggcagcgcgaggaaatcgctcatcatgcgccagatcttctcggcatagcacgcctggggtgtgaagccgtatcgcgcactggcggcagcattgagaacacaggtatccgcgcccggtgtaaagcagacgacggggatatcgccaaaacactcgtcaaacacagctgctgtatttgcgctctcggcatccgatgccaacgtttcgggtaggttgtggccaaaagccgccgcgcaatccggacgatcttctttccatgcacgcaagagcgacacggcccctttggcatcagcgatgccggacagatcaggccccaacgtccgcagcgcccagcctgtatagaaggtatgcacatcgatcaggccaggcatgacggtgcggtcgcccaggtcaactacctcgtccgcctgggtcaaatacgaagctagctcacacttggtgccaacagcctcaattcgattgccacggaccgctacgaaaccttcaaacggcaggtcccccgtaccggtaaagacgctcttagacgtcaggaccgtcaaacgatcagacatcacaaccacctacgccggaagcatgccagagattgccgttacgatcaggccaaagacgaccatgaaaatgaagaacttccaaatggtcttccaccattgaccaaacgagatctttgccacggcaagaccggcaaccgtcatgcccgccacgggactgatggtgttgatggtctgattagcaaactggagcgcggtaacggcggcttcgggattgaggcccataagctcggtcagcggacccatgacgggcatggtgagcgccgcaagtccagagctcgagggaaccagcaaagagagcaggccaaggacgatatacataaacgtggtgtagacggcggcaggtgcaccggccagtgcagtagcgagcgcctggaggatggtgtcgatgatcatgccaccctctgcgatgaccaagataccgcgagcgatgccgatgacgatagcggcatacgcaaagtcggcaatgcctttaacgaactcctcggcgatcgtctgctggtcaaggccgcccaggataccggcaagcaagcccataccaaggaacacggcggaaatctcattcatgtaccagccctgggtaacaagaccccagacgataatgcccatgccgcaggcaaaatcgataagcacgagcttctgacgggtagtgaactcttcctcgatggaggcatcggtcacggaaaactcaacacgcttgagcttatcgtcctcgtacacaatggacgactcgggatttttcttgacacgcatggcgtagcgcatggcccatgcgataccaacggcagtgaagatgacccaagaaacggcgcgcagccacagctgaggattgccctcgataccaatgatgccttgggcgatcaaaacattaaacgggtcgatggtcgaagcacaatatcccaggttaggaccaaggaagcagatgataaacgccgtcatcgagtcatacccgatacccatcatgatgggaatgaagatggcatagaacggcagggcttcctcagacataccaaacgtagtgccgcaaatggacagcaacgtcatcgtgatgggaatgatgaggatgtccttgttcttgagctttttaatcacacggctcatgccggcattcaaagcgttggtcttggtgatgactgcgaacgatccgccaatcaataagacgaacgcaacgacgtcggcagcctcctggatgcccttagtaggcgcttgcaggaccgcaaagatatcctggcccagattgatggtctcgccggtctcggaatcggtgtagttcttatcaacctgttcataggttccagcaacggcgacttcacgctcgcccgccgctgtcgaaatcgtcttgcgctgatactgaccagagggaacgatccaagtcaggaccgcaaagacaacgatcagcaagaacatgatcgtatagacatgcggtaatttgaacttaaaacgtctgtttgtcttcttcgccttcgtatctgacatagatacctccaaagaactcgagactgcatcgcatctcgcttcaacgcctgcgcaaggcaaacgttctatgacgttccatagattaccagcagtttttcccatcatcaagataatttcaaactgattgccgcgacgcggctgaacggttgcgttcgcgccgtgaacggtatggaaacgcccggtgagatgatccaccgggcgcttccattcgcaatgtcctagatgtcaaaaatgtaacgagatccaacgatccgctgacgaccgatgataaacggccgccgctgctcatcgaaaaagaaggcatccatgtaaaacaggggttcgccaacgggaaccgccaacagccgagcgacctcgggcgacgcacacgcgatctcgagcgtgcacgggtcggtaaacgcgggcgtacggcccgtccggttgcgcacgaactcaaaaatggattggttagatagaggtgccgttgatagataggcgttgtcctcgtatacgtatatgttgttctcgagcatgacggggaccccatcggcagtacgcacacgctcaacgcaaatcaaatcagttccaacgggaacaccaaagaattgtgcttcggtggaatccgccggcagtatctttctcgaaatgacgcgcgcccccgcctccattccgttaacgcggcatgcgtccgaaaaactctggacgtcatccttctggcgaatcttgcgcttaagcttaggggcattgacgaacgtgcctttcccctgccgcttcgttagatagccctgctggacgagctcctcaatagcgcgtcgcacggtaacgcggccaactttatagctctcagccaattcgaattcgttgggtatccgcgcgcccgccttgtaggcaccggagctgatttcgtttttaatgatatcgataacctgttggtacagcggtatcgctgctttaccgtcagttagcccttcagtcggtggcatataccctctcccagcacaattacgtctaaaacgggcttaagggcattcaacaagcccttaagcccgcattagcattaagtatgcttgctgccgcaccaaaatgtcgggtatttactcatcagacccgaaaaacgcgcaactaccgcgctcctaagaaagcgtgagcagctccggcagctggtcgataatcttgtccgcggcatcctggctaaagccaaagcgttcctcgcgcttggcaatgactgtcagaccggctcgcttgccggcagtgatgccaggcaccgagtcctcaacgcagcagcagcgattcgcgggcagccccagcagatccagcgcatgcaggtaaatgtcgggctcgggcttgctctccttaaactgctcgccgctcaccacatactcaaaggcatccgacagcccgcatgcgttgagcacttcctcgatgctaaccatgggagacgagctggcaagcgccacgcgaacgccacggcgcggcagctctcgaatcgtatccacggcgcctgggttaatcaaagcctgatagtcgcgcggacgcttatgcgcccactcgtcccaacgggccaacgcttcctcgccagtgaaatgccccttaccggcgcgctcaaaccaatcgaccagcatacgcaggaagaactgatgcgaggtaccgacctgcccattcaactcctcttgagtcagattaagcccaagctctttggcaaacgcggcagtctcgcccaggtagtaatactcggtatcgacaatgacgccgtccatgtcaaagataacggcgtcgaacggaaacgcggacacggcaccctccctaacaaaagggcgcccgcaagcaggcgcccgaaccatgcattaatcggcgattctaacccagtagcttatccagcgccaccgcaataccatcttcgttgttattggcggtcaccatctgggccactgccttaacctcatcgacggcgttgcccatggcaacaccggtgccggcccactcaatcatggacttgtcattctggccgtcgccaaacgatacgacctcgctggcatcgatgccaagcttgggcagggcaccctcgagcgcgcgggccttgtcgataccgggcgccgtgtactcaaagtaccagtcggccgtaaacatgcccgaaagcgtctgggtaaagggcgcatacatctcctcgtaatgcgcctgcaggtaggccggatcgcccgccgtcagcagcttgtccacgggataagcatcagcaacctcatgcaggctctccacctcgcggatcttaagatcgcacgcatcgcgctcatacttgacgatattcttctgcgagccgtcagacagcgtgatcatgcaatggtacgagtcctcgacatgcagatcacgaccgagcgaaatcataggaatcacgtcaaaattacgcaggtgatcaatcaggcgatgcaattcgtcggcaggcatagcctgatcgaacagcacctcgtcggtctgagcgtcgaccacatgcgcaccattaaaggcaactagcagaccgtcatggttttgaaggtcgagctcctgcgccaaggcgtgcagcccccatgcgggacggcccgaagccaagatgagcttaatgcccaactcctgcgccgcgagcagcttctcgcgcgtacgcgggctaatcactttctggtcgttggtgagcgtaccgtcgatatccatcgcgatggctttgattgccatatatgcctccttgcatcgtttttatcgcgcactatcttatccgagccggggcacgttcgcacagcgcgcgcatgacggttgcaaaaccaccccatttgaaacaaaggcaaaaaagtacttgcaaagacgcgttccgacatataagttgataaaagaccgccgttgcggttttaagtagatcgagcatatgaagtttgagttttagcgtgtaagagaaggaagatcggcaaagtacaaccccaaacgcaatgacaacttaatgaggtaactgccacatgtgaggcacccagggcattgctgtctcgattttgagcacgatgccttccgccttgcatgggccgttccatccagcccctgcagcaactgcctcacgggctcattgaaaaccgcatagcaccccaacgtcagcacatcacccacggcaagcgcatcactcacgacaaccaacacatcaacaaacagcacgaacatcaaccgattggagaagctatgacaaaccaccacgctgaagacggcgataagaaaagcattctagatgcccgcattgagcgagcatatgcaaacgaatatgacgccgcctttgccgccgcgaccatcaagaactacgcgtcgctaccgctcgcgacgatcttggccgactaccctcaactgctgaagcgctgcacaaagatcatgggcgaccccgacattcgcaagctgacagacccctatgccccaaaacgcgacaacgattcgtacgttcttaccgtaggctgcctagcccatatgcttacggcgctcgacacgaaactcaagctcgaatgggaacccgacgagcgtcatgaactcgaaagcaaacggaacaccctgcgcaccgcactgttccttccgttggacggcctcaagcgctgcaacgtcgagctcaatacacaggcgcggcaaaagcccgggaccacggggcagaaaactccaagaccccatgcggccatcgtcgaccgcgaccgatataaccgcatgaccgcgcacttttccgccgggggagcagccataaggacgctgatcgacctgctgtgcctcctgagcatcaacgagctatttgagggctatctcgcccttgttcccgcgacggcacccaagtcggtagcaaagatcatcgagacctgcagacgccagtttgagcgccatcgcaatggcagcgagatgaacgccagtatcgcgcagtactacgcggctcattacaaaaatgacgaatgtgcccctgtcgagcatcagctgcggctcgcctacaccacgcccgtcgcaacgctccatcgctttggagcccttggcgcttgcgagccgcacgaacaggcagcctgccccacaaccgagctcgatctcaggctcggacgaaccctgtagcccgccagcccctccgcgggcaacaatcctattccacaacacaaccaacagaaaggagtcctcatggacaccaatcattcccccatcatcagccccctcaccatgcgcgaatccgcccgaggtatcacgctcaccagcatttacgatgagatgctcgcccgtcgcgagctctccgtcatgggaaacatcgaaaccccgatggcccacgacctatgtcagcagattcgcctgctcgatgccaccgaccccagccgccccatcaccatatttgtcgccagcgccggcggaagcgtgcgatcgggtcttgcgatctatgacgccatgcgcctcgcatcgtgtcccatccgcaccgtctgcctggaattcgccgcgtccatgggcgccgtgatctttatgggcggcgacgatcgccgtatggcgccccatgcagagctcatgattcacgacccgctgatcccccagggggcaggcggctcggcacttgcgctgcaggaaaccagccggcgtctcatgcagacccgcaagaccctcacgcaaatcctctcggaccgcagcggcctcacgcccaagcgcatccagtccctcactgcaaaagacacctacctttcggccgagcgcgccgtcgagctcggctttgcccacgaaatcctctcgaccaccaaggaggtcgcccatgtctaacctcgccagccgcctcgccgcatctgagtccgcatcgtccaccatcctcgccaaggatcgaacgctttcctgcgacacccgccaaacgggactcaacaacaatgcacttgtgatcggcccctcgggagccggcaagacccgaaacgtcctcaagcccaacctgctgcaaatgaacgcaagctacatcgtgctcgacaccaaaggcacgctctgtcgcgaagtgggacccgtgctggcagcccacggttaccgcgtgcaatgtctcaacttcgccgacctcaacaccgtcccggcccttgcgcccggcatcgagcgctgcggctacaaccccctgaagcacattcgccgcaaggcggacggcaggcccaaccagcaggacatcctctcggtggcaaaggccatctgccccatcgaggacaacaaccagcctttttgggatcatgcggcggcaaacctgctgtcgtgtcttatcgcctacgtcaccgaacagctgcccgccgacgagcagacgatcagctcggtcatcaagctgatcgagcacctgcaggacggtgccacgggtcgattgtttgacgacctgatcacgaccgacccccaaagctatgccctctcgctatggcggcgctacgccattacgcaaaatgccgagcgcatgcacgcgagcatcgtcggcatccttgccgaaaaggtcatgtgtctgggattcgacggtgcggcacagctctatcgtgagtgccatcaggtggacttcgcttccatgggacacaccccctgcgccctgtttgtaaccgtgagcgatatcgaccgcaatctcgatccgctgaccggcctctttattacgcaggcgtttatgggcctcattcgcgaggccgataggcagcccgacggcagcctgcccgtgcccgtgcgctttatgctcgatgacttcgcaaatctgcagatcccccagatcgacaacgtgctctcgattatccgaagccgcaacatctgggcaacgctgctgctgcagtcgaccaaccagctcgatgcgctctatggcgaggcacgcgcacgctccatcatgggcaactgcgacacgcatctggtgctggcgttccaggatcccgagagtgcccgggtgttttccgaccgcgccgacgcgctgcccagcacgctcatggcgacaccgatcgatcgctcgtggctctttgtacgcggtcgcactcccgaacaggtcgagcgctttaggctcgaagaccacccgctctacggggagctgcccgaggcgcagcgagacaccacgcaggtcgaattaacccgctaacaacgccgcgcagtccgccacattcgaccgcaaacagcaagggcccgtatcccaacggatacgggcccctttcggcaatgacctatctcagcaacaaagactacttgcggtgagcgcggtagaactcgatgagcgcctgggtcgaagcgtcctgctcggccttggcggcgtcgtcgtggaaggccggggtgatctgcttggcaagctgcttgccaagctcgacgccccactggtcgtaggagtcgatgccccagaccgtgccctcgacaaacgtgatgtgctcgtacagggcgatgagctcgccgagtgcgaacggggtcagcgtgtcgccgaagatcgaggtcgtcggacggttgccctcaaagcagcgggccgggacgatctgctcgggcgtgccctcggcacgaacctcgtcggctgtcttgccaaaggcgagtgccttggtctgggccaggaagttgcccaggaacagctcgtgcacgtcctgaccgctatcggtcgcagggttggcggtattggcgaaggcgatgaaatcggccggaaccaccacggtgccctggtgcagcagctggtagaaggcatgctggccgttggtaccgggctcgccccagaagatctcaccggtgtcggaggtcacggcgctgccgtcccagcggacatgcttgccgttggactccatggtgagctgctgcaggtaggccgggaagcggtgcaggtactggcagtacggcagcacggcatggctcttggaaccgaagaagttgacgtaccagacgttgagcagacccatcagcgcgacggcattgttctcgagcggcgtgttgcagaagtactcgtcgatggcgtggaagccctcaaggaactgctggaaacgctcggggccgagcacgacgatcagcgacaggcccacggcggagtcgacggagtagcggccgccgacccaattccagaaaccaaaggcgttggcggggtcgatgccgaaggcctcgaccttctcgagtgcggtggaaacggcgacgaagtgctttgccacggcctcggcgttctgctcatcggagccatcgatggcgccctgagccttgagctgctcgagcatccaggtcttgacctcgcgggcgttggtgagggtctcgagcgtggtgaaggtcttggagacgataatcacgagcgtggtctcgggatccaaacccttgagcttctcggcctggtcgttgggatcgatgttggagatatagcggcaatcaataccggcgtcggcatagggacgcagggcctcgtaagccatgaccgggcccaggtcggagccgccgatgccgatggacaccaggtgctcgatctttttgccggtaacacccttccactcaccggagcgcacgcgctcggcgaaggcatacatgcggtcgaggacctcgtgcacgtcggcgacgacatcctggccgtcaacgatgagctggcccttctcgcttgccgggcggcgcagcgcggtgtgcaggacggcgcggtcctcggtggtgttgatgtgctcgccggagaacatggcgtcgcggcgctcctcgagcttcacctcgcgggcaagatcgcacagcagcttgacggtctcatcggtcacaaggttcttggacagatcgaagtgcaggtcaccagcgtcaaagctcagcttgttcacgcgctcggcatcggcggcgaaccaggccttgaggtcgataccttcggcctcgagcttctcctgatgagcctcgagcgccttccaagcggcagtcgacgtagcatcgataggtgcggcaacagttgccataaagtcctcctcagcatacgggcgcacgtctccatgcgcccggacattcagatgccactattctagcgcaggtcaagactacaatcagcgagcgttgccaatccgccctcaaacggcgaccgaccaaaaagggacaggttttgacgatgtccgcgcaagcgggtattatcgaacatgtattcgataagaacatgtgtttgatgggaggacgcgtgggacacgagcgtcacacctatgtctgcatcgaccttaagacgttttacgccagcgtcgagtgcgtcgaccgcggactcgacccactcactacgtgcctggtcgttgccgacgaatcgcgcgggcgcacgaccatctgtctcgccatcacacaggccatgaaggacctggggatacacaatcgctgccgtctgttcgaaattcccgacggcatcgactacatcaaggccataccgcgcatgcagcactacatggaggtgtcggcgcaaatttacggtatctatctggaatacgtgagtccgcaagacgtgcacgtctactccatcgacgaatgctttatcgacgtgacaccctatctggacctctatcacaccgacgctgaaggcttcgcctgcatgttgcgcgacgaggtcctggcgcgcaccggcatcacggcaacggttggcatcggccccaacctattccaggccaaggtggcactcgacattaccgccaagcacgtacccagccgcatcggcaaactcgacgacgagacctttcgcaaggagatctggccccatcgccccatcaccgacatctggggcatcgggcccggcgtggcagcacgactcgaaaagtacggggtatacgacctgatgggcgtcgccgcactcgacgagaacctgctctacgacgaactcggcgtcaatgccgaatatctcatcgaccacgccttcggacgcgagccgacaaccatcgccgatatccaagcctatcgcccgcaagcaacttcgaccaccacaggacaggtgctctcgaagggttatgcctacgagcaggcctacaccgtcttgcgcgagatggtcgacaacgctgtgctggacttggtcgataagcacgtggtctgcaacagcatctcgctctttgtaggctacgcgagcgagcgcgccgacatacgccgcctcgacgccagcggcacagcgcaatatgtagacggatgcgggcatttgcgttcgagcacgtcgagcatcgaacccgccgcaaccgacggccccgagctcgcgccccgcgcgcccaagcccatccaacgcgacgacgaacgccgacgtttggtgcgagaggcacaggcgattgacggcatctttgtgggcgaacacggcggcaagccgcgtggtggctatgccgcgctctttgcgcattccaacgcctcgcgcaagctgcccgagcgcaccaattcgtttaagaagatcatgggctatttcgatgagctctgggcgcagactgtcgatcccaaacgaccgatcaagcgcatcaacctgggatttggcaacctcatgcccgaggaatttgccactatcgacctgttcagcgatgttaaggccgatgagcgcgagcgcgacctggcgcgcgccgtcctggccgtgaagggcaagtacggcaagaacgcgctcgtcaagggattaagcttcaccgccggcgccaccgcacgcgaacgcaacgatcaggtaggaggacatcgtgcctaagtcccaacaacagccgatgcggccaccgacgccttttgaacgtctagcggaccccgagggaagacgtcgatccgccgaccccaagctcaccgccaacggtgccgtgcgcgccaaccgcgccgcacagtttatgccctttgccgccctcacgggatactacgaactcgtgcgcaagcaggaaatcaccgtcgagcaaaaacgtgagctcacggaagaaaaagccctcgagctttcgcaaaagctcgagggcctcaaacgcggcgacttggtgcgcgtcacctattacgatacgtacggctatcgtagccgcacgggcattctcgacgaagcgttacccgcattcaagctgctcaaactcagggatatcgccatcaacttcgacgatatccaggacattgagctacgcggacgagcctagcgacgagaacgcttgcgcaagacgagagcaatgccaagcactgcggcagctgcaaccagcaatcccaagaccagcgtgagggtcgagtcgccagcgcgaggcagcgagccgtccttcggagtcttcttagcggtcgtcgtgacggtggtcgtggtgctgctcgactggtcgttgccacccgtctggctgccgccaggctgatcgccgccacccggctgcgaaggatcggtgggttccgtcggatccggagtaccgggatcaaccggattctccgaattctccttgcgctggatccagacctggcaaccatagaacgggttggcggtaccaaggcacagaccctggttggtcaccgcaaaggtgcgcagaccatggttatacggatcgttaaagccattggtcgtcagcgtcgtaaagttcacgccgtcctcggtcacatacatatcaaagccgcgctcggcatcgcgcaggtaacacatgcacgtaaggacactctgcaacttcttgaggttctcctcgctcagcagcttatcgagcgcatcctgaatatcgctcggcagctcggtgccataggcatcctcgtactgctgcttaaggctctcatagctatcgagcatgtcctgatactggtcggcaaaggacttgaagtacgcgatctcgccatcgatcttctggacataagcggcgtcgtcctcaaagtcctgggacatcgtcgcggcctgatcgcaaagaccgcccgcggcatcctccagcgcatcgctcagatcgccaaagcccttagcaacctcggtcttctcgtcatcgacatcgacggccttgtttgaatcatcaacctcagcagcttcgttcgaatcatcgacctcgacggcctcgtttgaatcatcgtccgcaagcgtgttcacgggaacgatggggtcgtcaggcgatttcttgtcgagcaggtgatcgagcaggtccctaaggcgctgaacctgagagtcccactcctcgggcgtcatatcgataatgtcgccattggagaactggccgatcggctcaagcaggctcgcggtatcaaaggtaccgatatacagcttgccgtcgaacttctgcatgcgccaaatgtactggttctcgtttcggccaaagcccgaagtcaggccggaaataccgccctcggggaacatgtcggtgcgatcgccaacgacgagctccatgttctcgtccttgtccatgcgatagatgttaaccgactgctcaagattggcattcacaaacgagcagtcaacgccacccatgctgctcttgccgccctcttcggtgttggatttgttgaacaggatgcgctcgagggcaatctcctcgtcgttgtattcaccgatatagaggtagtcgttgtagacgatgaggttggcagcgccagaacgggtacgggcaggatcgatgccaaagcagtactttgcaccgtccgtcttctgatcgccgacaatgggagtccacgaatagctgccgtcggcattcttgtcgccacggaccatggcaaacgactgcatggaattatcatcgggagcgttctcgggcgtaccggtgcagatggtcgcatagagatggccattgtacgagaccatatcccaaatggcgccgccgtagatgctgtcctgatagcgaatcgccggatagccaaacagcgtctccgagttggcaatctcggtgaagctgtcctgggccttcgaggggtcagacgacgtcaggattgtcgacacaaaattaccgttcgcgtctttacccacattactgatgacgagctggccatcatggacgcacatgccgcggataccggtagaaatgccctgcttgtaggcagcaccgtaatcctgcatgctcgaaaggccctgatagacaactttgtactcatccgtcttaggatcgatctcgtatacagcaggcaggccgcctttgccgtcattggtcctgacgctgccgcagaaatagagcttacccttatagctcacggcattgcggaacaaaggagcgacgccgttgagcgattcagagagtagcagcttggtctcaccggtcttggtattgatcttgaccaagatgccgccgctgtccttgtcggccgtgccgtcctccttctgctgtccatagaagaaggtaccgttaaacatggcctccagcgtcaggcgcatggtttcgacatcaaaggaatcgcccagcgtgctgttcatgagcgtcagcgtgttgcccatcgccgcatagcaggtgcccacataaagccagtcaccatagctcgcagccgcccaagtgtagctctggccgcgatcgccttcgttgttggccgtattaccatcggcgcccggaacggcaacggcaccgttaccctggtagtcgacgatgccatccggctgcgacgttcctaccgtaggatgcgagagcttctcaaaggaatacccatttcccgcattgtaggtaacggcacccgatgcgtcttcggcgtgcgccggcagcggcgataccaagatagcggcaagcgctgccaccaagccaagtgttcccactcgtctcataaggttatagcctcccctgtcctaaagcccagttttagcattcttcatttctgtccacggttaattgcaatctgagcacagcaataatcagtgtataaatatacacctgtaattttttggacgggttcatagatgctcgattggtagcgaattccgcgcaaaccgtcaccaaactccacttttgccgcatctaaaggttatttttgcgcaaatttttggatgccgatagtcacaatgggcaggaggctggtacccaccggagagggcaacgcctacattttcataacgtaatagcccgcacccctcactgccgtctcgagtgtgtcgcgatcaaccgggcgcttcgagcgcacgcgtgccgtgtggtccgcgtacgttaccgtagcccacacgccatcaagcgcattgagggcattcgtcacattccgggcgcagccgtcgcaactcatgccgccgataaggagttcctcacgataggggtagtgggactcgtcggtgtctgccaccacaacctttttggccttcttgccgctcgcaccatcgctgcagcaactcttcccgtgtgtcgaagcggcaatgcgacgcagtccaaaaaacatgccgacggcaatgacggtcagcacgatgagattcgcagggttgagcaagtcactcatgcgttcccctttcagtagcactatctagatacccccatggggtgtccccatcttaacccaaaattatgtccgttcggtcaattagttttcctcttcaaacttttttgttgaccatggcttactttcgtgtataagttttcctaggctaacagtttagatccgtaaggagcgacgtgactcgaaccatagacatcccaacgtttcaggcagcagtcgtgcgcaactgctcccccacgctcgcgggcatcaagccggcatcgctctttacctatccaggcacctacgcccacggggacggctcgaccgcaacagaaaccatcgcagaacgccgagcacgcctgctcaacgttatcgcccagtgcaaccgcgagcttgacccgcttggcatccacctgagtgttttggtctggcggccctgcggagcgctcgtgtacgtgtaccgagccaaaagcctcaccacctatttcgcggaccctcgcgccaaaacggcgctcgcctcggaaggctacgacacgagagacctttcgacatgccttgtgcatttggcatcacgcatcacgctcgcgagtaataacgtcgcggaatgcgcctgtagccagactcgatgcgcactaccccagcaagctagctgcagcaacgactgcacctgcgagtttccgcacgaaataggctacttcctaggatatccctacgacgacgtgcacgagtttatcgtccagcgcggcgagaactataaggtctttggggcctggaaggtctacgcaaatgtcgagcaggcacttgcgacgtttgatgcctaccgcgcctgcacccaatacttcacctttgtctatcagcagggctacagcttggcgcaacttgcccaggcaacccgatagaacatagaagccgtggcaacctgccgcacaactgaaaggactcaacatgagcaagatcgccgtcgtctactggagcggcacgggcaacaccgaggccatggcaaacctcgttgccgaaggtgcaaccgatgccggcgccgaggcagaggtcatctcctgcgccgacttctccgcagacaaggccgctggctatgacgctatcgccttcggctgccccgccatgggttccgaggagcttgaatatgatgagttccagcccatgtgggatgaggtcaaggagaccctcggcgacaagaaggtcgtcctctttggctcttattcgtgggccgagggcgaatggatggacaactggaaggcggacgccgacgaggagggcgtcaacgtcgtcgattccgtcatctgctacgacgcccccgatgatgagagcgaagcggcctgccgcgcccttggagccgagctcgcctagcggcaatgagctccgcccgcaacgcgcattgcaacaaaacacattcgcgtcccaacaaaaacgggagccggatcacatccggctcccgttttctgctatgtcagtcatataaagcggctacgagatattgcccaagaacgccttggtgcgctcgctcttggggtggtcgaagacctcgctcggcgtaccctcttccacgataacgccgccgtccataaagaccacgcggtcggcgacatcgcgggcaaagcccatctcgtgcgtcaccacgatcatggtcataccgtcacgtgccaggtcgcgcatgacgccaagaacgtcgcggacaagctcggggtcaagcgctgacgtggcctcgtcaaagagcatcacgtgcggattcatcgacagggcgcgggcgatggccacgcgctgctgctggccgcccgaaagctgactcggcataaagtcgatgcgctcggccaggccgaccttggtcagctcctcgatggcgatcttctcggcctcttctttgctgcgcttgagtaccttttgctgcgcaagcatgacattctttttgactgacaggtgcgggaacaaattgaactgctggaacaccatgcccagatgcgtacgtaccttgttgaggtcgacgcccttggcgcacacgtccacgccctcaacgacaatcgagccgctcgtgggatgctccagacgattgatgcaacgaagcatcgtcgacttgcccgagccagaaggacccaggactacgacgacctcgcccttgtgcacatccagatcgatatcgcgcaggaccacgttatcgccaaaggccttctggaggttcttgatactgacgacgacctcgttcgagttattggtttcgctcatgataggacctccttacagaccggcgatgtgatcggcaggcgtcgcgacaacctgtccggcgctcttggtgggacgcttctttttggtttcggccgtacccagcagcctcgcctcaagaccgctcaccaagcgcgcaagcggcagggtaatgaccagatagaacagggcggcaaccacatacggcgtgatggaccccgtcgtggccacgatggtgcgggcgttcatgacgatctcgaccacgcccacggcggcaagcagcgacgtatccttgtaaagcaggatgaactcgctggtcaacgtaggcaggacattgcggaacgtctgcggaatcatgacgtagagcagtgtctggaaggcattcatgcccagcgagcgagcagcctcattctggcccttggggatcgactgaataccggcacggaaaatctcgcacaggtaggcggacgagttcatggccatgacgataacgcccaagacgtagtcgtccaccttgacgccggcaagcggcaggccaaaaaatgcaatatagatctgcaggaacgccggcgtaccgcggatgatattcacatagatgccggcaagacaacgaaggatgcgcgacttggaaatgcgcatgagcgacagcgcaaagccaaagggaatggccaacggaaatgccacgagcacgatcgagagcgacataaggaagcccttgaaaacgatcggcaggctctgaaccaaaatgaccgggttcaagaacaggcgcaggaacatattggagttccacgcctcgacccacggctgctccttaagatcggccaggaagttatcgaatgccgtcacgcccttgatctcgacggaaggaatcttggaaatcttcttggtcgaaccgtcggcgagcgtataggtgccgctgaaggcttcatcgccgccctcgacgggaaacgtcacgccgtagacctcgacacggaaaaagccgccggcaggcgccgtctcgccaaagtcgatcttgagcgtctggccgtcagccttgcacgtgggcttcatgggcgtacgatccatgaggtcctcgcccgagagcatcgtcaatcgcgtgtcatcggtaccaaacgtcgtgccgtcgacaaacgtcagcgaaagaccgctcagctcctcatcggcatcggcttggacctcccaggtaatgcgcgtctcggtaccgccgaccacagcgctgcccgaaccggtgttgggtcgggcggtaatctttgcggtctcaagcgcctgggcggtcgtgggcgcatatgcccccgcgcaaaccagcgcgagcgccacggccatgacgcagactagcttttggagcaaggcgggcagtggaaaatgctgctccgcggcccctttgttcagtcgagacaaggtggctcctatcgtagaagttgccggcaaaacgagacgggaatgctctccgtcaagagaagcgcaaaggccctctccgccaaaacggaaagggcccgcgcgcaatcaagtagttattttacttgatgttgtacttagccatgagggcgtcaacggtaccgtcgtcggtcaggtccttgatggcctggttgatgtcgtccttgagcttggtgttgccctggttgatggcgatggcgtactcctcgccggtgctgatctgcttaatggtctgacaggtgttgaactgctcggcggtcagctggctagcaacggagcggttggtgactacggcgtcgcccttatcggactgcagggcgctgaagcactcggtggcgtccttgtaggggacaatcttggccttggggaagttctcctgggcaaaggactcggcggtcgagccagactggacgatgatggtagcgtcagcgttattgagcttctcgctgtagttatcggccgtgatgtcggtgttatcgaccttggtcacgatagcctgatcgtccatgtagtaggaatcggagaaagtgacttccttctcacgctcgggcgtgtcggtgatagccgcgatggagacgtcatacttggcgcccgaagcgacgcccggaaccagcgtgtcaaagtcgttattgacgtactcgacatccaggcccagcttgtcgccgatggccttgatgagctcaaggtcaaagccctgataatcgccgttgtcatccttgtactcaaacggagcgtactcggcagaggtgccgacggtcagcgtaccgtccttgacgagcgcgtactccttggagccgtcgaccttctcgaccttagcgtcgtcagagctgctagaaccggcatcagagccagaggtggcgttggacgagccgcagcccgtcagagcgagggcgagcgccatagcacccgtggcggcaaatgcgccaagcttcttcagcttcataatcagtctccttccaatgaccccatgtgattcagaggtctgcaaaaactgagggttattatgcacccgcttggaagaatctgcgattagaaaactgattgaaacaaaacccataacgtgaatggagcactccactttatggcagccattactgctgcaaggaccttaacagtttgatttcagccgcataacctgcaagttcgttcggtgtctccaaaatgaatggcaaggcgcgcaagcggccattcgatacaatattctgcataacctgcataccgccgccaaactcttcactacccaggtagcccttgccgatacactcgtggcgatccttatgggcgccgcaggggttcttggagtcattgatatgcacggcgcgcaggcgctcgatacccaccacacgatcgaactcgtcgagcacaccgtcaagatcgtggacgatgtcatagccggcatcattcacatggcaggtgtccaggcaaacgcccaacttggccgacagctcggggcgtttgtcggcaacgccctcgatgatgagcgccagctcctcgaagctgcggcccacctcggtgcccttgccggccatagtctcgagcagcaccgtcgtctgctgaccctcaaacatcacctgacacagggtgtcgacgatcatctgaatgccggcgtcggagccctgccccacatgcgcaccgggatggaagttgtagtagttgccgggcagcgcttccatgcgacgcaggtcctctgccatggcctccagggcaaactcgcgcgcccgctctttggccgagcaggggttataggtatacggggcatgagccacgagcgggccaaagtcgttttgctccataagctcgcgcagggccgccacgtcatccatgccaaggtctttcgccttgccgccgcgcgggttgcgcgtaaagaatgcaaaggtattggcgccaatggacagcgccgtctcccccattgcccgatagcccttcgtcgtcgaaagatgacacccgatcgtcagcatctccagctccccctcatcagttgcggtgaaatagttcctgtcgatgccctattctgccgcaaacaggaactattccaccacaagttataaaaggggcatcagagatgcgggccaccaagcactacagctacgggcgcgggcgtcatgatccctcacgcgtcagcgccaggtcctagagggctagacggattgcatcgatgatgcgcgcacagcgctgtgtggcggctaggggcatgacgggactcttgagtttccccgcccggatgagctgggtcgcatgccggatttcgccgtagaaatcatcgacctcaaacggggcatttatttcgaacattcgtccgtcggagtacttcacatgggcgagctcggggcgatggaggcgctcgatttccaacgaaccccgctcgcaggcaatcgttaagcggctttcatatgctgctttgccgtcgcacaccatatgaatgggtatgccgccgacactcatatggatctcatcggcccaatccacgcggccgcccgatacgtcacgccagcgaacttcacgagacgaaacatcgcacgcgcccgtaagcagatcctcaaaccacccgactgcatagcagcccatgtcatatagacagccgccctgcaacggatcaagcagatagcccgaaggagactcgccgtaatcgagcttttgcacgctttcaatcgagacaatacggccaagctcacccgacgcaagcaagtccttcacgcgagtgcgcatcgggcaaaaccgattcttcatcgcctccataaacagcacgccgcgctcgcgagaggtggaggcaatcgagaaagcctcttcctcgctcaaaacggccggcttttcgcacagcacggcctttccagcgcgcagcgcgcgacaggcccaacgcgtatgcatgccatgcggaagagccaagtagattgcgtcgacatcgggatcggcaatcagcgcatcataagccgcatcgccgctatcgtcagccgtggcataactgcgcgcggcgtcaatcgaaaacgccctgcaaaactcctcaacatgcgaaggagtgcgaccggcggcagccacaagccgtgccccgtccacctccttgagcgacgatgcgaatcgatgcgaaatgtgtccagcgcccaaaacgccccagcgaacatcacgcaaaccatcacatgaatcccgatagcccacgacagcccccttcagttgcggtggaatagttcctgcttggcccctattctgccgcaaacaggaactattccaccgcaagttataaaaggggcatcaggagcgcgttttgcaaaaggctttaagcgcggccgttacgggaccaggttggaaacgtcggcgcacaccgtcgagacgctcgggaatatcaatgtgctgcgggcagtgtcgtgcgcatttaccgcacttgacgcaattgctcaccagcttgggctcgcttgtgcgcaccgcgctcgccgtaaagtattgagacagccccgtaaaccaactatgcgcgtagctcgcgttgtaggcgccaaagcaaccgggaatattgatgcccttggggcacggcatgcagtagccgcaccccgtacagggcacgcgattcgatttctcaaactctcccagcacacgtgcgatggtatcgagctgctctgtcgtcatcgaatccggcagtgcgcgatccgccaatgccgcgttctcgtccacctgcgcggtatcggtcatgcccgaaagcagcatcgtgacttgaggatggttccacacccacgaaaggccccaagcagccggcgtcttcaggtacggatcgcgtacgtcatcgagcacggcgcgggcccgcggaggcagcttgcccgccaggcgtccacccaaaagcggttccatcacaaacaccgcgagcccgcgctcggcggctgccatgagtcccgccgttcccgcttggtagcgctctccggcatagttgtactggatctggcaaaaatcccagtcatacgcgtcaagcatcatgaggaaatccgccgcaccgccgtggtacgaaaaacctatctggcgaatacgccccgcagccttttggtgcgcaatccagtcctcgatacccaaagctgccacgcgctcccactgcgcaggcgaggtgatgttgtgcatgaggtagtagtcgatatggtcagtccgcaaacggcgcagctgctcgtcaaaaaagcggtcgaaatcctccgcacatttgcacgaagcgtgcggcaacttggtcgcgagcaaaatctggtcacgcagacccaggcgctcaagcgaagctcccacacaagcttcgttaccggggtagagataggccgtgtccagataggttatcccttgctccaccgcacgggagatgatggcatcggccgtcttcgcatcgggatgtcccggcgcaccgggaaacctcatgcagcccagacccagagcggatattcggttaccacttttggggtcaacacggtattgcacggcccctcccttcgccatcagcgccccggcaaggcgaaacacaatggtcacgcagccgaaacatcgtggaatcgcaatcgagaatgtatcgtaacgtagcagaaatcgagccgtcacgacaccgctttaacatcagcaaaaagcccgatgaaaggaagcgaccgtgaccacacgtgaggacgcctacccctaccccggcgagcagtacatcctctcggtcgaccgctatcagatcgaggtcatggaccatctggacgagcttcccgccacaggcgccgtcatcttctgcaccttccccaaggtgcgcgatggcgttggatatcccgcacgcgttttcgcggtctgccccgcagcgtaagctccacgcgtccattcatttaaaaatcgccaccctgcatgcacaaggtgcgctggcggcatacaatccatcaggcgccccttacgcgggcaccttttatatggggagataattcacatgcagatcaacaaggtcacctttatcggcaagggcggcgtcgggctactctacggcagtatgatcgcccaggcactcggtaacgacgccgtcgaatacgttatggatgacgcccgttttgagcgtcacgcgggcgatgcgctcaccgtcaatggcaagccctgtgcgctcaagtccgtccgcgccagcgaggcaacgcccgccgatctggtcattctcacggtcaagacgactggactcaaccaagcactcaagactatggagcgcgtcgtgggacccaatacgctcatcgcctcgctgtgtaacggcattacgagcgagcagaagattgccgagcgctttggctgggagcataccgttcttggtatttgccagggcatggacgccgtgttcctcaacggagagctcacctttaccaatgcgggcgaaatccgctttggcgcggcggccggcactgagctcgcaaccgtcaccgccatcgacgagctctacacgcgctgcggcatcgcccataccgtcgagagcgacgttacgcaccgcatgtgggccaaactcatgctcaacgacggcatcaaccagacgtgcatggcctacggcgggacctacggaagcgccacggagccgggctccgagcagcgtcgctgctttgtttctgccatgcgcgaaacgcttgcggtcgccaacgccgagggcattgagctgaccgaggcagacctgacgcagatggtgcacctcatcgagggaatcgaccccgccggtatgccctcaatggcgcaggaccgcatcgcacaacgaaaaaccgaagtcgaggagttcgcgggcaccatttgccgcctggccgtcaaacacgatatccaagcgccgcaaaacgattggctctatcagcgcatccgcgatatcgagaaaagctggtagcgcccggctcaccacgtcaacaggctcaacagcaaagccgccacaaggagcactccccttacggcggctttcatcttcatctataaccagtagtcgatgtcccgacggttagagctgcgactccgacgcctggtcctcatcgtcgcgacaaagggctacacccgcacttcccagcagtgcggccgcgatcaacgcactgaccacgatagaggcagccccacaagacccctgcatgcccacaacgagcgcggccgtaggaccaaggcagccaagcaccaatgcgacggcggcaatagcaatatctcgagcgttcacaagaccacttcctccacgagaaagaccttatttctcatgaactagtgtgccccgcgcccatatgcgcggcgtactgccacggtaagcgctctgttaactcaaacgcatacatagaacgggcgtccttacgttgccctaaagctcggtaaagacgcccgtccgtcaaatatccgtgatgcagaaaaattaccagccagtgtagtaatcggttgttccggcagcgcagccggagtcatagaccttgcactcgcccttggacccggtaaacgtggagccctgggccttatcgcccgcggcaacgacgtagtagccatcggaatcgcgccaaaagccctcggcgtcctgcgtccattcgcccgtgcggtggtgatacaacacgttgctgctgtaataagtctcgcggcggccgttatagttattgacgccgctcgagcgcgtcaggcccgagccgttcgcgtaatacgcagcagacgcgtaagacgagccggagccggcgttgtaatacgaagcctgaacggcctcagcggcctcggcttcggctgcggcagcctcgagcgcctcgcgcttggcatcctcgagcgcggagcgaagctcgtcgagctcggtcgacttggcgtcgacctcccccatcgtcaacaggctactcgcgccgtcgatgcagccctgcaacacagcgcgctcgtcatcggtagcatagtcgccatacatattcataatgatctgagcgcgcatctccagggaatcgcgcttcgcccccatcgaggcgttccactcctgcatagagccgtaaccgtcaccgcggtagtcgacgggctgcaccagcgtcgcctcggacggcgtagatccgaccgtatcggatagtgttgccgcgtgggcatcagttgcgccgacgcccgccaaaagtgccacggtcagagcggcggaaagggcggcggctttcggttttcgtgaatcgatcctcatgtagctggaaacctccgtagtgtgtttttgctgcgtttaggctgcgtgtgattcgatcgcgctgcatagtaccccgagcaaatcgcgacctgcggttttactcaaaaggcgcacgtcaattgcgtaaaactcacatcctctcaacaggagttttccacaactcaaatgcataaatcgtatcaaaaaccctgtttttgcaccctctctatgcaaaaaaggcgcctgtgcaaccattgttcgcacaggcgccttgagcaggcattttatgcagttatacctatcgagtcgcaaggggtccttgcacaagtcgccttactcgtccagcgcgacgaaggcctgcttcagatcccaaatgatatcctcggcgttctcggtaccgatggaaagacggatcgtggagggcgtgatgttctgctcggcgagctcctcggcagagagctgggagtgcgtggtggtagccgggtgcacgacgagcgacttgacgtcggccacgttggcgagcagcgagaacacctgcagatgatcgatgaacttccaagctgcctcctggccacccttaatctcaaaggtaaagatcgaggcaccgccacgggggaagtacttctgatagagctcgtgatcggggtgctcaggcaggctcgggtggttcaccttggcgacgtggctgtcaccggtcaggaactcaacgaccttcttggtgttctcgacatgacggtcaacgcgcagcgacagagtctcggtgccctggagcaggacccaggcgttgaacgggctgatgcaggcgccctcgtcacgcagcaggatagcgcggacataggttgcgaaggcagcgggaccggcagcctcggcaaacgaaacaccgtggtaggaggggttgggctcagcgatctgggcgtactttccgctcgccttccaatcgaagttaccgccgtcgacgatcacaccgcccagcgaggtgccgtggccgccgatgaacttggttgcagagtggacgacgatgttggcaccatgctccagcggacggaacagatacggggtgccgaaggtgttgtcgacaacaaccggcagaccgtgcttcttggcgacctcggaggtggcgtcaatgttggggatgtcggagttggggttgccgagcgtctcaaggtaaatgaccgtggtgttgtccttgatggcaccctcgacctcttccaggttatgggcatcgacaaacgtggtctcgacaccaaactgggagagcgtatgctccagcaggttgtaggaaccaccgtagatggtcttctgagccaccacgtggtcaccggcctgggcaagagcctgcagggtataggtgatagcagcagcaccggaggcgacggcaagacctgccacgccaccctcgagggcggcgatacggtcctcgaagacgccctgggtggagttggtcagacggccgtagatgttaccggcgtcggcaagaccaaagcggtcggcggcgtgttgggagttgcggaacacatagctcgtggtctggtagataggcacggcacgggagtcggatgcaggatcggcgctctcctgaccaacgtgcagctgcagggtatcgaaaccaaaggtgtgctcggggttgttgatgaactggctcatgatgatctccttgatcgaacaaaagtaataagagtaagagaagtgagtcgctgtctcctgatcacgccgacgggcgcaaacaggagcccggcattcgtcttggtaagcaattcatatgcgggcctcctttcgcatcccggttccgtagttggcttaattacctaccgtctttgtgtgttttgaatagtacgagcattgttttcctcggtcaatcactttaaagcgctaacctgttatcggttttatagataacactcgaaaggacgggcgccgatgaccctccaacagcttcgctttttgatcgccgtggcagagtccggttcgatcaacgccgcagcccagcgcctctatacggcacagtccaatatctccaatgccgtcaaaagcctggagcaggaacttcatatcgaaatctttacgcgctccagccgcggtgttgcactcaccaacgacggcaccgagcttttgggttatgcacgccaggtcgtagagcaggccgacatgctcgaggcccgctacgaggacggcggtaccccgcaagcccgcctcgccatttccgcccagcactacgccttttcggtcgaggcctttgtcaacgtggtcgagcgctgccgcgacagcaagttcgagttcatcatgcgcgagaccaccacagcgcagatcatcgacgacgtgcgcgcgtttcgcagcgacatcggcatcctctatctggacgactttaatacccgtgtcttgcagaaggcctttaccgatgcccgagcgagctttcatcccctctttgatgcgaaagtccacgtgttcgttagcgagcgtcacccgctcgcacgccgccctcagctgtcccttgccgacctcacgccctatacgcgctacagctttgagcagggaacctcgaactccttctattacgccgaggaaccttttagctatatcccttgcgaccgcaacatacgaatctcggaccgtggaacacttaccaacttacttatcacgtcgaacggttacaccctgtcgaccggtgtcctctccaatgaaatgcaatggggtatggcatcgatcccgttagtagacgccccgacgatgcacgtaggctatatcatgcacgacgatcgcaagccctctcccctcttgcagcaatacctcgacgagctcaaccgcatcatccatgccaaccaactgtcggaagacggggtagaaatcgtagattgctagcccccggcgggcatggcgctacaatggtcactcgcacgaaacatacccaacgaaaggaaccatgtgaaggtcatcatctataccgacggctcggcccgatcaaatccgggacgcggcggctacggcgccgtgctcaaatacaccaaccccgccggcaagaccttcacctccgagctttcgcgcggctacgccaagaccaccaacaaccgcatggagctcatggcagtcatcgtggcgctcgaggcactcaaccgcccctgcgacgtcgaagtccattccgattcgcagtacgtcgtcaacgccttcaacaagcactggattgacggatggaagaaacgcggctggaagactgccaacaagcagcctgtcaagaaccgcgatctgtgggagcgcctgctcaccgcaaagagcaagcacaaagtggagttcatctgggttaagggccacgccggccatgagctcaacgagcgctgcgacgagcttgccaccacggcggccgacggcagcaacctcgatatcgacgccggctttaacgagagcgacctgtaacggcgttttcgcacgcttttgtgtcctcccgcgctacactcatcctgtaaaccgaacggcacgagggggatacatgctgcgtatagcgaccatcggcacatccatgattaccgacgactttatccaggtcgtcaacgccaacgaccaagccgcgtttgtgggcacgctctcgcgcgatgcaaatcgcggcgccgccttcaccgctaagcacggcggcgagcgtaacttcaccgcacttgacgagcttgcgtctgccgacgacgtcgacgccgtctacatcggcagccctaacgcacttcactacgagcaggcccttgcctgcatcgctggtggcaagcacgtcatcgtcgagaagcccttctgcgccaccgaggcgcaggcgctggaagtcttccgcgctgccgaggcagcgggcgtcgtagccctcgaggccatgcgcccgctccatgaccccgctttccacgccatcgaggacgccctgggcgagattgcgcccatccgccgcgcctcattgcgctttggcaagtattcctcgcgctacaacgagattctcgcgggacgcgccaccaatatcttcgactgcaatatggcatcgggttccctcatggatattggcgtctacaccgtcgagcccatggtcgagattttcggcatgccctccggccttacgagcatggctactctgctcgaccccaccacgcgacagctcacgcacggccccatcgacggctgcggttccatcctcgccagctacggcggtggccgtatctccgtcgagctcgcgcactccaaaattacgaatgacctgcttccctcgcagatcgaaggcgagcgtggcactatccagattgaccatctgtccacgccccgcaacgtccgtatcgactatcgcggcgatgtcgtacgcggctcggcgaccgaggcgccgcgcggacagggcgacaacggccgcgtgctcgacctacccaaatcgagcaacactatggaatacgaactcacagactttatcaccgccatcggcggcatcgataacgttaaagaagagatttgggagaccccggcgggacgccacgagcttggccactaccgcgatgtcacgctcgtctcactgcgcatcatggatgccgtgcgccagcaggccggcataaccttcccggccgacgcaggcaagcaggcatagcgatgggcttcttcgatacgttcttctccagcgtcaccggcggcagtcgagagcctcaaaaaccatcaaacgtcgagctcgagctgcgccgcaggcttactgtgctcgcaagcgacgaggccactcaagacactcccctgcgctatttcctgcgctgggaggggcaagtccaaggcgttggttttcgctttaccaacaccaacctcgcgcaggcacgcgcactcaccggctgggtacgtaacatggaagacggctcagtcgagatggagatacagggagctccggcaagcatcctatctcatctcgaggcacttcatgcctcctacgagcgcatgggaacgcgttttcgcctcgtagatgcccaggcccgagccccacttgccaatgaagacggtttcagtcctcattattagtattgtgtgctaaatacggtatcatttacctacgaccgttgatagaaaagaggcgaggcgcatggcggcgcaaagaaggaataccaggcagcgaaagctggttcttgacgccgtgcgccaaagctataaccatcccaccgccgacgaaatctacaacgccgtgcgcgcgcaggatgacaaaatcagccgcggtacggtctaccgcaatctcaatctcttggccgacgccggcgagatcctctccatcaagacgccgggcggcagccgcttcgatcgcacgatcgagccgcatgcgcatatcatctgcacctcgtgcagccgcgtcatcgacgtaccgctccccttcgatgcccagctcgacgccaaagcgtccgagcaaatcggctggcacgtcacgtcgcactacaccatcttcgagggtctctgccccgactgccggtagatgttcgggacatgccttaaaatccacctttccgcgctttgcagcaaacagtacatttctaggcatgtcccgaaaacctactcggcgagcaggcggtgcagttcttcttcgaccgtgtgcacgtaacggacgcgatcgttgataccgcgcatggtggggttgcagctctccatcagatagggatggcccacgacgttgagcatgtcgcgatcgttctcattgtcgccaaatgccatcatctcatcgggcgaaatccccaggacacgaccgtaatcgacaagcgcggagcccttgcccgaaccgaaaccgataaggtccgtccatgcggttcctgacgtcatcacatcgacacggtcgccaaagaggcgctcgaaatactcccgggccgccggataatccacctcgggcgtctggaagccaatcttaatgacatcctcgtcgatgtcctcgggacggtcgaccaccgccacatcgcagtggaccacatagcgcaaatggtcgacgaacgcatcgttgccgctcatggtgtagatgtgcccctcacacgaaagggtcatgtcggtatggggatacgcaaccacggtattcgcgataaccatagcaaggctacgctccatggaacgcttgacgacggcacgcccctcgctcatcaccagggttccgttttcgcatacataggcgagctcatcggccaccggggcaaacaggtagcgcaagctcgcatattgacggccactcgccggcataaacacgataccacgacgatgcagctcatcgataagctcaaaggcctcggaacgcagctcgcgctcccccggatgcagcaacgtgccgtccaaatcgcatgcaatcagtttgattccctcaagacccatatgcttcccccaaagcctcatatcaacagcaagacggaccttgatcggtcgcccctcaaagcccgtcttgcgcatacgcgcgcttagccgcgcgccttttttacgatggtaaagtcgggagccatgctcacgacgacctccgccgcactcgacgcaaagcgccggtccgcatcgagttcacgggtaaccagcgagagccgaacaccctcgacaccccggagcatgcggcccaaaacaggctgcaccggcgtatacatgcgcacagtatgctcgtccgagtcgccccggaagagcggcgcatgcatgttgccgatctcccagcacgaatgcgcgagcgcaatcgggtccatgcggtcaacttcgaccaaataaacctcggcgctgcgcaagcgcacgacaaccgccacgggcaccatgcccgaacggtcaatggcgagcacgtcgccgtcggcaagacgaccgccgtcggcagtatccagccgaacatcgaccgtgcgccccagctccgtcacgcccacaaacgcgtatacatcagcctggtcccaatcgagcagtagctcatcgacctcaaagacaccgcccagctcccggcgaagcaaaagctcataggacgggtcgttgagatttccgaggcacgttgtcgaaaccagatttgcaggcatagcctaatcctcgacctcgacgagctcgatatcgaagttgagatccttaccggccagctcgtggttggcgtcgagcgtcacggcctcgggcgttacatcgatgaccacggcggggacgggcataccgctcggcgtggacaagaagagcttcatgcccttctcaatctgctcgatgttgggaacctgttcggccgggaaggtcagaaccatctcgggattgtgctcgccgtaggcatcggcagcaggaatgtgcacggtcttcttctcacccacctgcatgtcgacaacagcggcgtcgaagcccttgatcatctggccggcgccgcaggtgaactccagcggctcaccgcgatcgtaggagctatcgaactgcgtgccgtcgtcgagcgtgccgcgataatgagtcttgaccttcttgccctggttggacatggaaacctccgtgataagggcggcgcacaacacgggccgccatgaacatatggcgctaactataccctagtcatacaatttgaagacagtttgcaaagaaacgctgcaaccggaggaaccatggcatatcccgtatttgacctacactgcgacaccgccgaccgaatcggctgggccacgctcgatctcgacctgcgctttaccgccggcaccgacggttatttccccggcgacgaaacgcatccgcaagatttcgacctcatcgagggtaacgcctgtgccatctcgctcgcaaagatcggcaacacgccgttggcacagtgcttcgccacgtttgtccccgacgagattcccaccgcccacgccgcgcgcttccaggcgcagatcatggcgcatatgagcggccaggcaatgctcaaccacgaccgtatggtcaacgtgcgcagcgccgcagacattcgccccgcgctcaaggacggcaaggtcgcttgcatccacaccatcgaaaacgccacgttctttgccgaggaccccgcgctgatcgaagtgctcaagagcttgggcgtgcttatgtcgtcactcagttggaacgcgcagggaccgctcgcgagcggacacgatacccacgccggcctcaccgccgccggcatcgagacacttacgcagatggagcacgccggaatggtactcgacgtctcccacctcaacgatgagtgctttgacgaggttgtcgcccacgccacgcgccccttcgtcgccagccactccaactcccgtgcggtttgcggcgtcaagcgcaacctcaccgacgaccagttccgcaccattcgcgacatgggcggcatcgtcggcctcaactactgcagcgagttcctatccaacgacgcaaccgacaagaccgccgcagacgtcaccttcgaccagctggcggcacatatcgagcactggctcgacctgggcggcgaggacgtcatcgcgctcggcggcgactgggacggtgccacggtgcccgctttcctctccgatgccagcaagatgcccgagttccagaacatgctctccaagcattttggcaagaccgtgatgcaaaagctctgcagcgacaacgcgcttgccttctttgagcgttattaatttcacaccccttgagcgggccggcatgccgaacggtcgacatgccggcccgtccccaatctgaaggatcacttttgacgcagcagtttacgatttccgtatcccgaccggatgggacgcccatccccgtcgtcgttaccaaaaagcgcgtcaaaaacttcaacctacgcgtcacatcgagcggtgaggtccacgccagcgcaccgctcgacgccagccgcgagcgtatcgaagcgtttgtgaagcgcaacagcgcctggattatcagccgacttgcccagcgcgagcaacgtcaggcaacggcgcgagagccgctcagcccctcgtccatcattgcactttggggcaagcccataacggtacaagatgcgctcgaccacaactttgcatcacccgcaccgcggcccaagcaggccaccttcgcaagttttatgggtgccgacaaatcggacgaacgcccacaagccgagcggtgcgcaatcctcgacggcctgacgtccgatgagctccagacccgcatcgaccagctctatgcatccgaggtcaccacggcgctgcgcgatatggtgcacgcgtacgagatcgcaatgggcgtcaccgtggcccgcgtttccgtacgtagcatgaaaacgcgttggggctcatgcacgcccaaatccggtgccgttcgcatcgcacgagaacttgccgcttaccccgtcgaatgcctcgacatggttgtcgcccacgagctcgtccacttgctcgagccaagccacaatcatcggtttcacaccctgctcgacacgtactgccccaacaatagagcgctgtcgcagcgtctcaagcagccacccatagagacgtattagaaccggttagcgcacgcgctcgatctcgacgccgcagcttgccagaggaagaccgacgggcgcccaaggcttatcgagcttaacgtgcacgccaagcagcagggggtaacgacgtagcagcatctgggccacaccctcggctgcagcctcgatgagcttaaacgtatgctcgcgcagatagccatcgacatcgtggcataccgagccgtagtcaatcgaggcgtccaggttatcgtgctcccccgctgcacgcaggtcggcatagagcaccagggacacgatgaacttctggcccagcgcgttctcttcgggatatacgccgtggttagcaaaaacctcaagaccttcaacggtgatgtggtcggcatggcgcagatcgtcatagctcacgtggggtaccgccgttgcggtggatatttcgccccttccacggcgggcgagctcggcaccttcagtcttggttgcattctcgggcagtttcttattgctcatcgcgatcgtctccttcgtttaggaccccgaccgcgcaaactaactacacgcgaatcgacaggttctttttatcatcgctccagttgcaagcattgcgcgcggggcatgcaaagcaggcgcgcgacgctttgtcggctgcatagagcaggcgctcaagcggttggctgttcacgcgcagctttcgatggcccagaatggccgtcttaatggctgcggcatcggccggctcaaacgccacgtcatcgggcatgccgccgagaatcgcatcagcgacgcgttcgcttgcaacatcatgagatatacccgattcatactgttcatctttgccgatatcgtgaagaagtgccgtggcgtagatgacctcgcggtcaaattcgagctgttcctcaagattcttgatccacataatgcgagcgacatcgagaagatggtcaataccatggcggcagaagatgcgccccgattccaactgtgcaatgttgcccaggtgccgccggaacagcccgttggcacaaatgtaatcaatacgaggcatggcaccaaagggggccaggcccgaagccataaagccgcgacgcgacgtcccctcgtcggtcttcgatgtaaagtcgttgacgaccctcatgctaacggcccagcatcctaaagaaccgctcctcgagcgcgggatcggtctcaaagacgccgcggcgagcgagcgtcacggtcttggtgccgggcttttgcacgccgcgcatcgtcatgcacatgtgctcggcttccatcagcacaatcgccccttggggagcaagatattccatgagggcatcggcaacctgtgcacacaactgctcctgcagctgcagacgacgggcatagacttcaaccgtgcgagcgagcttagacagacccgccacgcgaccgttagggatatagccgatcgcagccttgccataaaacggcagcagatggtgctcgcacagcgagtaaaacgtaatgtcgcgctcaataaccaagtcgttcgaagcgacggcaaaggttttggacaggtgctcctcggcactctgatccataccgccggcgacctcaccatacatacgggcaacgcgcgccggggtctccagcaggccctcacgagttgggtcctcgcctatgccctcaagcaacagcttaatggcggcctcgactttttcctgatcgaccatctgggcctcacttttccgatttcacgttcgcgctatggtaccacgccctttggcatcggccacaagctacatagtatgggtcgaatagaccggatcgtcccgccaaagctccacagcgtcgcaaagcgcaacgccctcgcgcacagcacgggcgcgcgtggcgttcatatcaatcacgcgctgattgctcgagcccctaaagcgcaacgagatatcgtacagatcctgaacgaacgggccgtccaccaacatatcgaggcaggcaaggatacggtccgtcgcctcggtatggtgacgaccacccggcataagctcctcgagcacgtcgccggtgaagcaccaaatggtcttgcccgaccccgcgggataggccgcacgcacgcgttcgataaagtcaacgagccccgcctgattctcgggctccataggctcgccgcccagaatcgtcaggccatcgataaagggatgatcgagactctcgataatcttgtcctcgacggcacgatcgaacggctcacccgcagcaaagtcccacgcgacagagttaaagcaattcttgcacccacgacggcacccgctcacaaacagagaagtacgaacgccttccccatcagcaatgtcgaaatacttaatgttcgcgtaattcataggtaactctcccgggaggccgggacatatcatcccgtcctcaaacattctcggcctgcggcctgcgaaactgcgggcgggacgatatgtcccggcctcatgcaaagggtaactcaatgaacgaagcgaacatcgagcatagggttcgagatctaataaaaactgggttgcggctcaaccgccatcgcaagtaaatcgcagctgcagctcaaattatttccgctaagaacttcgaggagtgagcagaccgcatgccgcatctcagctacgtcaacttggccgccccgtagcgaggccccggacctttgctcgatatgagttccgcacgaacaggaggcgccagtggcgcctccgtcgtgagccaggactgtccgaaatagcgagtaaaggtccggggcctcgctacggggcggcctgggatggttattagagatgcagcacgcggtcgcggatctcctcggttcggccctggttccagaactgggtaccgatgtagccgcacgtacgacgagcgacgttcatcttctcctggtcgcggttgccgcaattggggcactcccacaccagcttgccatcgtcctcgacaatcttgatctcgccatcgtagccgcacacctggcagtagtcgctcttggtgttgagctcggcgtacatgatgttgtcgtagatgtactgcatcacgcgaatgacagccttgaggttgtcctgcatgttgggaacctcaacgtaggaaatggccccgcccggcgaaagctgctggaacatgccctcaaacttgagcttgtcgaaggcatcaatctcctcggacacgtggacgtggtagctgttggtaatgtagcccttgtccgtcacgcccgggataatgccaaaacgacgctgcaggcacttggcgaacttgtaggtcgtcgactccaacggcgtgccgtacagcgagaaatcgatatcgctcgcggctttccactccgcacacttgtcgttcatgcgctgcatgaccgccatggcaaagggcgtgccctccttctcggtgtggctgtggcccgtcatgtacttgacgcactcatacagaccggcataccccaggctgatggtggaatagccgcccacaagcagtttgtcgatcgtctcgcccttcttaaggcgcgccagggcgccgtactgccaaagaatcggcgcggcatccgaaagcgtacccatcagacgctcatgacggcacagcagggcgcggtggcacagctcaaggcgctcgtcgaagatcttccagaacttatccatgtcctgatgcgagctcagcgcgacatcgggcaggttgatggtcacaacgccctggttaaagcgaccgtagtacttgggcttgttcgggtcatagttcagcgcgttggccacgttgttaaatccgttgcccgaacggtcgggcgtcaggaagctgcggcaacccatgcaggtgtagcagtcgccgttgccggcggtctcgcccttcgacagcttgagctcgcgcatcttcttctcggagatgtaatcgggcaccatgcgcttggcggtgcacttggcagccagctgggtcaggtagaagtacggggaatcctcgtgaacgttatcgtcctcgagtacatagataagcttggggaatgccggggtaatccaaacgccggcctcgttcttaacgccctcgtagcgctggcgaagcgtctcctccacgatcatggcaaggtcgtgcttctcctggggcgtacgggcctcgttaagatacataaagaccgtcacgaacggcgcctggccattcgtggtcataagggtcacgacctgatactgaatcgtctggacgccgcgacgaatctcatcgcgcagacggtcctcaacgacttcgcgaaccttctcggcagacgcagagacgccaagctcatcgagctcgcgggcaacctcgccgcgaatcttctgacggctcacctcaacaaagggggcaagatgggtcagcgagatagactggccgccgtactgggaggaagcaacctgggcgataatctgcgtcgcgatgttgcaggcagtcgagaagctgtgcggcttctcgatcagcgtgcccgagataacagtaccgttctggagcatatcctccaggttcaccaggtcgcagttatgcatgtgctgggcaaagtagtccgaatcatggaagtgaatcaggccctcattgtgagcatccacaatctcctggggcagcagcacgcgctgggtcaggtccttggagatctcgccggccatatagtcgcgctgaacggagttgacggtcgggttcttgttggagttctcctgcttgacctcttcgttgttgcactcgatcagcgacagaatcttgtcgtcggtcgtgttcttctggcgcttcaggctctgaacatagcgatagatgatgtaatggcgagcgacctcgtagcagtcgagacgcataatctcgtcctcgaccagatcctgaatctcctcgaccgacacggtgtggcccgcgttctcgcatgcctcggcgacgttttgtgccgcgtaaaccacctggcggtcggtaagacgagagctctcctcgacctccaagtttgcggcgcggatggcattgacaatcttatcgatgtcaaagacaacctcggtgccgctgcgcttgatgatcttcatcctcttgcctctttcgcgtcgaaatcgtattgcgcttcagagccaaacgatgcccggcagggcttgcccctgtcttgcggcgccgtcgcgcaatctgtgttttcgaaaaccataggccctcatgcggacaatcctcgcagccaatcaaggggctcgaagatccatccaaatggggcgaataaggtcctcgttctctgtccgccatctatcatacgacaaagaggcatctatatcctgtattctttttttaggtcaaacacaacatatagtgtttcagcaggtcaaagcaattagtcattttgcagacgcattaattatgaggggttcttggcaagtcggtaaaacgttaccaacacggctacctgcatggcagttataaaacccccttagtcaagccgctgacaaatcctaccaaaaccaagccgctcacgccaaaagaatccaaaagattatgcttgaccaacatgttgcggtcacggtcggccaggacgtatgcaacctgccggcacctctacggggaccttggatcaatatttgctggcatatttgacggcgtgcttggtagcaaaacaaaacagctcagaggacatagcctctgagctgcgaacatttggtgggcgttagaagatttgaacttctgacctcttccgtgtcagggaagcgctctccccctgagctaaacgcccaaatggagcggacaacggggctcgaacccgcgaccccaaccttggcaaggttgtgctctaccaactgagccatgtccgcttacgaggattaatcttacgtgatgcccgcatcctatgcaagaactttttttgaaaagttttgcgacgctctcgcgagggcatcagtcgtcacgaaaggcgcgaacaaacgcaggctcgcagcgagatgcccctacatatcaccgagcatgatccaggcagagctgtcctgcgcgagcctgccgtctgaaagcggtgatgaggtgagcaggaccctgcccgccggcagctccacgggtgctgcaccgaagttcgtcacacacgtccagccgttatcgcggcgataggcgatgacgccgccctcagcgccctcggcaccatccgcaagaccggtgcgcccgtcaagatcgagccacgcaagatcgttggcgcacccgcgcagcttgcgccgcagccagagggcgtcacgatagagcgcaagcatcgatgtcgggtccgcttcttccttatcggcagcataatcggaaaaccatgcaggctgcggcagatggggcgccgcatcggcgtctgccggcgaaaacccaaacgatccgccatgcgcgggatcgtccgccgccacccacggcaggggcacacgacagccgtcgcgccccttctcacgcttcggtccgtgcgtattggtcgcagtagggtcttcgagtgcagcccacgggatatcagccacctcaaaaaggccgagctcctcaccctgatacacgtatgccgagcccggaagcgccagttcaagcaaaagggccgcccgcgcgcggcgctcgccgagttcacggtcctcgtcataagacgacccgtcgcgtaagagccagtcgagcgcaatctggtggtagcgcgtcgccttgatttgcggcagggcatagcgtgtcgccacgcgcggcacgtcgtggttggagagtacccaggtcgaggcggaatcggattcgacggctgccttcaagcccttctcgattgcagtgtgcatgtcatcataggtccaagtggccttggcaaactcaaagttgaatgtctggccaagctcgctgggacgcgcgtagagatactggcgctcgggcaacacccacgcctcggcaacggcgctgcgcggcggattatagcggtcgaacacgcggcgccactcgcgatagatctcgtggacctcattgcggtcccacagcggatgggtgccgtcgtcaaccatgtcatcgccctcggcgagatgccaccggtcgaggtcatcgcggtcgagatccttggcgagaccctgcgccacatcaatgcgaaagccgtcgacgcctcgatcgctccaaaacgccaggacgtcgcaaaagagcgcgtgaacctcagggcatgaccagtcaaagtccggctgctcgggcgtaaacatgtgcagataccactgaccgtccgcaacacgcgtccatgcggggccgccaaagttggcattccaattggtgggaggcagctcgccatgctcgccgcaaccatcgcggaagatataacgggcgcgctcgggagatccggggccggcggcaagagcggctttgaaccaggggtgctggttggatgaatggttgggcacgatgtcgacgatgaccttgatgccgcgcgcgtgagccgcagcgatcatgtcatcgaagtcgtcaagcgagccgagacgtgggtcgacatcgcagtagtccgccacatcatagccgccatcgacaagaggcgatgggtaaaacgggctcagccagatggcctcgatacccagccgctcaagatagtccatctgctgggtaatgcccgcgatatcgcccagacccgaaccagtcgaatccttaaacgagcgcgggtagatctgatagatcgcagcgtcggacatccatgagcgcgaagaagacttttctgtagccatggggcgtatctcccttgcaacgaggttatgcgagatgcccacgatgatacgcccaaagcggacattcgcggcaaacaacgccacagccacgccccaaaacgctcgctccctctcgggttcgagcccatgcgatggatacaaaaaagcccggctaccgtagtagccgggctgttgcgtttggagcggacaacggggctcgaacccgcgaccccaaccttggcaaggttgtgctcactccacgacgccgaagcgctcggggtcgtccacgtggtagccgaagaccgtggcgcggcccgactcggcgttctggacggcgcgcgtcaggtggcgggacaggccgttgccgtagaagatgttgtcgcccagcaccagggcgcacggctcgccggcgatgaactcctcgccgatggtgaaggcctgcgcgaggccgtcagggctcggctgctcggcgtaggagaggttcacgccgtagcgcgagccgtccccgagcaggcgctcgaagttgggcaggtcggtcggcgtggagatgaccaggatgtccctgatgcccgccagcatgagagtgctaagcgggtagtagatcatgggcttgtcgtagaccggcagcagctgcttgctggtgacgagcgtgagcgggtacaggcgcgtgccggaacctccggcgaggatgatgcctttcatataatctgtcctctacaatcgaaatgcgtttaaatcgtgcgataaataagacttagatatcctattttgctaaacgactgaggcttcggtagtttgtgtggttaggaagctgactcactaagccgcttttcttatcgacgtcgactgattccacggcagctgcggtttcgcgtccgagcatctcaacatcagcagcgctatgagattgtccgtgctcctgaagccgtagtccatcttcaccgtggcttttactcctgaagcctctaaatagttcatgtaaaagcccggcaggaatcccaggcggggactatctagtccctcctgaaaaggtccctcgtgtagaccttggccgagacgtccgcgagctcgtcgctccagcggttggcgacgatgacgtcgcaacgcgacttgaagtcctccaggtcgtgcgtgacctcgctgccgaagaagtccccagcgtccagcgtgggctcgtagaccaccacgggcacgcccttggccttcacgcgcttcatgatgccctggatggagctcgcacggaagttgtccgagccgctcttcatcgtgagtcgatagacgcccaccgtgggcgccgcggtgccggagtacacgagctggttgacgcgctggagcacctcgtcggccacgtggtccttgcgcgtgcggttggaggccacgatggcgccgatgaggtcctgcggcacgtccctgtagttcgcgagcagctgcttggtgtcctttggcaggcagtagccgccgtagccgaacgatgggttgttgtagccctcgccgatgcgaggctcgaggcacacgccctcgatgacgtcggcggtggcgaggccgcggagctcgcagtaggtgtcgagctcgttgaagtaggagacgcgcagcgcaagataggtattggcgaatagcttcacggcctccgcctcggtggagccgagcacgagctcggggatgccccgcgtgccgtcggcgttctcgcgggagcgctcctcgggagcggcgccctcggcaagcagcgccgcgaagcccttggcggcctcgaccgctgcgacatcgtccttgtcgcagccgacaacgattcggctcgggtgcaggttgtcgtagagcgcctcgccctcgcgcaggaactcgggagagaagaagattcgcgagtcgccacgctcctcgcgcagctgcgcggtatagccgacgggaaccgtggacttaatgacaatccaggcgttcgggttcaccgaacgaactgcgtcgacggccgcctcaacggagctggtgtcgaagaagttcttgttggggtcgtagttcgtgggcgtggccaccacgacgtagtccgcccccgcgtaggcctcggccgggtcgagcgtggcgcggagggacagctccctctcccccgcctccgcctcgcgcatgaagcgctcgatctcgcggtccctgatgggcgagcgccaggagtttatcttctccaccttccccggcacgatgtcgagcgccctgacctcgttgtgctgcgagagcagcaccgccatcgagagaccgacgtatccggtgcctgcgactgctaccttcattgctggttccttcctatacggttatcaagtgaaaaacaaaattgtggtgccagtgagtgctcacgccttgcggcggaacctcgaaacggtccctttgagcatgggcaagacgaagtcgagccagtagcggttaccgctggccgcaagccacgcccaggagagcagggcgaaaagcatcccgccgacgagaacctgggccgcgagcgtcgcgacacgcaagcccatgagagagccgagccagcgcaccgcgacgaacatcgcggcgccgacggcgacgaagggcaggttctccccgagccagcgccgctgggggagcatccccctcacctcaaccacctggacgacgcagacggcgacctcggcgagcgtggtgccccacgccgccccgagcgcgccgagcctggggatgagggcaacattcgcggccacgttgaccgccgccccgacgacgaccgagagcacgtaggctctgtccatgcccttggggatgaggtactgtgtcctcaggacgttggcccaggccatgaagggcatgttgagcacgagtacgcagagaaccggcacgcacgcctggtagcccggcccgaagtagaccggcgcaaggaccggagccaccccggcgatgccgaaggagaacgccagggaaaggccgagcgcgagccacatcgacacgcccaggtaacgcctcccctccccctccctgccggacgcgataaggttagacatcctggggagcatcaccgtgccgagagcggtcacgagcgtgaagggcatctgggagaccttgagggagttctcgaagaacccggtctgctcgagcgtgctcatgtggccgagcatcaccttgtcgaggaccgtgtaaagggagaccgcgacgaccgggacaaataaaacaaggtttggaactatatgtgttgtcaccccacgaattgtgggacgaacccatattattcgcgctctcagaaagggccaaagaattaatacagatacgagagtggacccactaattagcatgcaataagcaaagacggcatgctcaccgcgaaccactataaacattaaaacaaatgtgaataatttaattaagaaattacgaccgactgttaccttaaactcttcaaggccaaaaaagaaccagttaatatcaaaaatagaagagatgacgtagaatatccaagaaaatgcaatggacccaaacgaagagcttaacgagtacaacaaataaaagaatacagcaattaaacctagtaacgcctgaagcgtccagacttcccagaaagacttgctcatcttagttttgtctgatctaagcctagcgattaagcgattgccatagttattaatgccaagcatcgcaaacaaaacaaagtaataagaaacagaataggtaaatgaatatgttcccaaaccagaaggaccaactacacgtgataaatagggggcggtgattaagggaagaaggagcaatagaacttgataagctatattataaataaagttctttttcactgaaggcataaggaatcacctagtcgttaattgtcttgaggaactagtatttccttgctttgatcctcgtccgtaaaaaacaaaaaccaacaggacaatcatcaaagcataattcggcagggtaaactgcaaacgaacaaaggaaaagacgatagtgctaaacatgagtaggcaaagagagagctcgaaagatcctttattatttaaataagaaaggtaacaccagttgcaccacatgccgaataaaagcgagcctagaaatacaccgaagacaccgagatcggcgtagaaataccaaaacagacttacatatgcattagcgggaactcctgaaccgacaataatccaatcagaaactgtagaatttaccaggtcatatacctcttgaaagccaagcggcattaaaggtagccttagtagcagctgaacgggatagagaataataaaaaagaaaccacctaaggatgcttgcccaaatgaatagccagtaacgctgtcggaccatttctgaaacatgattggaggaatggctaaatcaagatagagacttctccaaacttgcatattgcgagaaagcgtcattgcgacgaacaatacaattcctaaaacaagaaccgccaatagctttaggctaattcctttttttatcctctttactttataaactttttctacatttttgttgatattgtaggcgataataccgtacataaaaaggaacagaagtgttgagcgactgccagtcgcgagcattttaatagttaaaagcagagcggtctctacaattgatctgcttttaattccttcggtaaaaaatagagctataacaacgattggggctaagctagataccggtcccgcaataaatgatccaaataatcttatcgaagatgaagatattaaagactcgatatccatagtcctgttatatctttggattgagtagagatcaatgctgccaaggtcaatgtatatcctgtataagaggtaggcataaaaaaggattgataagcatatgagtatttcaacaatctctgtcctgatatggtagctatgagtgttggcattgcgctttactgtaattggacgagcaatgccgcatcccaacgagaatccaaacaaacctaaggcgatcaagaggtatgaccgcgtctctgtttcatagagaccgtagagatgtatgtaggagaagagggagataatcatccacagtattgcgaatactcctaaaggtgtcaaaatagttctattaaaataagtcgtcaaaattatgctagtcaagcagaccaagctgataaagagcagctccattttatttatccagattaattataattgttgatatatcatcataagtatgcgaaattgaaaagttactcgcatataagaaggcagcatctgacaatctttttcgtaaactatcatcgagcagcatgtgtatctttagagccagatcattttcgtctttattcttataaagcagaccattcatgccattaatgataagctctcccgtgccagcagtatcagcaccaataaccggcaggccgcttagcatcgactcaagtgtgacccttccaaaagcttctgatgaggagcagacaagtgctgcatgcatattagctctaacttctgccaggttttcaacctgcccaagatagtgaatataatatggacttcctgcttttttcatttctgattgcagaaagtactggtctcctctaccagctataaataggctagctttgtagttcggagagtatttttcattaaataatttgacggctttgattgcctgatcttgtcctttgttcttagagagctgtccgacaattagtaggttgagactattatctacccttggtataaacttatttttaaataagctaatgtcaagtccattatagacagtctctatatcacagctcgaactaattcccttgtagtaatcacttatcgaattcgaaactgctatcaacttaccataattaagcctgttaacaaaactacttcgcggcaacagcctcctaaaattaaagtctttgtccccaaattctcttaagtgccagacatgtgcaacattggccttttgcgcagcccttgatgaaaaggtaatcgtactcgtatttgtatagacaacccctatattctcgtctttaattagtttgacaagctttcgaactgcgacttcattttgcagaagcctcagatagccacgggaaataactgcgacattgcgcgccaccgatgacctcgttggcacacatgaccaccagtaacgcattcttactacctgtatgcccagcttctccaggacatcaggcagattcccctcagtcttgtttacaagaactacaacttcgtaatctttattgaaccgctcaattagacttataatcgaacggtttgccccactcttttcattattgttatgagtaacaaagagtattttcattccatgctcgtatcattcaaaatatctttaagaacccgcaacgacttgatctcattcttgaacacgaacaggttcttctcgcgcttgttcttaaccgtgctgtttgtcgaagaatcctctgcgtgccaaatgcgcaggttggggttatagaccatcttgagacccgtctgcttcgcacgccaatagaggatgtcctcctcaaagtacaggaacgtcttatcgcagaaaccctcatacctctcgaagtacttatccgaaaaaatgagacaagccccatgaagcttcacgtcttcataccggcagttatagtcatagaacacatcgaccatcttgccagtaccagcttcctttacaagtccctcaaggtgtgccaagcacagcgcgtacttaatcattctcttgtaaataagcttgagagcttgctgacgacttgtgataagccccggcgccggactggaatccaccttgccgtcccaggtctcaatctggggtcccaatacggcaaattggctttgagcgtattcgtcgttgacgagcttctcgaagtcatcctgcaagagctttgtgtcgttgttgagcacgactacaaaacgcacacccggaatggaacgcgcaaccttgatgcccacgttgttaccgcgggcaaaccccaggttccgctcttcaagaattacccgtacatcctcatcagccttgtactctgacgcaagcaatttgccagatccgttaccagagccgttgtccaccacgacaacatgggcacctggaacatgctgtcgaatagactcgacgcaggcccgcgtatcatccgccgtcttgaagtgcagaatcacaaacccgaggttagacattcgccgcacccccaactgcagcctcgagacaatcgacaatctgtccggcacgatgctcccacgtgcactctgacggaatcgatgccgctaccttggcaggattgacgcagccaactctcaccgcagcagcaacctcgccaacaaactttacaaaggtatccggcgagccagcaaccttcacaaaatcagaaatgtcggatacgcccgcaacgctcgtagacactacaggcttccctgccgcaagatactcatagagcttgagcgggttcatgcttgccgtaaactcatcaaccttgtgggggatgagcgcgaaatcgacctcctgcagagcctcgggcaggttctcataccgcacgtcaccggtaaaactgatgttggcatagctcctcttcagcccgtcaataacatcttgttgggagtaagccggcccgatgaatttaaaactgatatcagaataagtctcgagacaccgacgcacaagatcaaagtccacacgatcctggatttttcccatgtagccaacagtaattggaccgccttcgtaggcatgtcgagccggagcgaagaagtccggatccacgccattgggaatccagttcaccgacttggtgtgtgcgtcagagaaatcgtccgcaagggctttggagacggtcgtgataacgttcgcacactcacgaatgaactcgtagctcttcaccacttgctcatggttcgacttcatctgcgggtggtgaagccagttgtctatggcatcaaacgccagtagcgagtggccaaggtgcggaacgacagcgacagacatgggattctgaagcagcaacacgggcttttcgataccgagcttggccattgcccacttgatggcctcaatcgtctttggattctccagtgcagagaaccaccacgcctttttctcgcgagcaaccctaaggaagtcgggaagcttagaatccaagcaataggtcttgtcgccaagctgcgagagggctcgagaggactcctcggcaattgctcgcgtacctggggctctccagtcctgcctcttgaccactatctccgccagggaaaccggccgttccacgacaagcatcttaccaatgcgtgggtccttctggaaatgctccacaaggtgggcatcgcgcgttcgccatccctcgctggcccacttttttgctccctggaaggggaagatgacgaggtccatctactcctccccctcgcccttgaccgccagcggcccctcgaggaacaggcgctcgtactcgtaggcgatgtgctgccagctgtaggcaatggcgacacgtgccttggcgcggcgacccagttcggaaatctcgaccgcgtccatggcatccgcacgcgcaatcagcgcggcaagattgccaggctccttggtccagtacagggccgcgccctcggccacctcatggttgaagccaaccccaagtagcagattcaggtcggtggaacccagagcctcgagcaggctcgggttcgtgccgcccacctcgtggccgtggaaatagccgtaggcctgctcacggatcttcgcgaggaggtcacggtcgtagaccgtgcccacgaacttaatgcgggagtcgcggctgtagtgcgtccgctcctcaagctcggcgaggaacttgtcgttgacgttggtaatcaaggcgaagtcgcgctcggtgctgctagacatgaactcgcggatcattgtctcgtagttgttctccggcacaaagcggccaaccacgaggtagtagcccttgggcgaaagcccgtgctcggcacaccagccagtaaaattcggggcgtcgtccgcaagcgggctcctatgtgtatccgcaccgtaagcgataaacttagtggccggtctataggtcggcgaatcgtactcctcgtggatgtacctctcgatgttcttagagtcgcagaccagcagatcgcaattgcggaccatcatggactcggagaccttccagtagcggcgcacgggggcgctccacttggcgcgcttccactcgtgcccgtctgggttcacgtaaagtcttccacccaaagcgtggatacgcttctggaagtgggcgcagaagggcccgatgcggcacgccaagacgtaaacaatcgggtgcttgacgtggttgtcctcgacgtagcggcagacgcggccgagcgccgcaacgtcgtacaagattgcctgggcgggtcccacgtcgggaaccttcacgttgaagcagcgggcgccgtgatactcgaactcgccatcctcgctggccttgcaagccacatggtacctgatgcgagggtcgccctcgtgcgcctcggtcaaccggtcgacaaaggtctcgtagccaccgtaattgcccggaatgcccttagagcctacaatgaagatgtgttgtgtttccgacattaagctgcaccttccccagagagcatcgccttcagcgttccgaatatcaaccgcaggtcctggagcagactgcgattctctatgtagcgaagatccagctcaaccatttcgttgaagcccagatagctgcggcccattacctgccagggcccgccgcagccgggctttacggcaaggcgcttcatgtcatgctcgctgtacaaggcaacctcgcgcggcaggccggggcgcgggccaatgaggttcatttggcccaagaacacgttgataagctggggcagctcgtcgatactgtgcttgcgaatgaagttgcccacgccgggaataatgcgcgggtcgtgcttcattttaaacatggggccggtggcctcgttttgagcctgcaagtccttgagcatttggtctgcgttgggcaccatgctgcggaacttatagatcttaaacaggtagaatgtgccgtctttgcgcacgcggcccacgcgccactgcgaataaagggggctggcgcccgggctcttaatgcaaatgaccatgctcagaattaccccgggtataaagagcaataccaaggctccgccggcggcgacaatgtccaccgtacgcttaacaacgcggtagagtctgcgcccaagctcgggcttcacgccggagttcgcaccgcgcagcatctcggtggcctcttcgtttgtaaggtaatcccccgcagcacccgctgcggcagggacggaattcgccatggcagcggcgcacgtctcccgtgcaccctgctccatggtcattatcgtaggctccaagagcccctcccccgatacttttttgctttcggtcgtccgcttgcgagcttgcagctaggcgatcgcttttctgtgattgcgcatgacgcgctgttcgtttgaaagcaccgcgaggccaacgcgggtggttacgcgtcggccgcacaggttgagctccagataagcagtgcatttacgtctattaatggttttgatgaggccctcgtggcccaacagcggaccagccgtcactacgacctggtcgccctcttttaaggcctcgctcatgggcaccacgcggtctcccctattggtaaaactgccaatgagctgggtctcttcttttgccaacggcacaaactgaccgtcctgggaaagcacccgggcaaagtcatccatgcgcagcaggtactgttgcacggtacggggatctgccgtgtcgcagataagataaccgggaaagagcggcttggtcgtattgacccattcgccgtgtactttgatctccgtttgatattggggataaaagagctcttgcatggcaccagccggcaccatacgctcgatgcgctcgcgcattacgtcttcgcgaccgttaatgacctgaatcacataccacacgagcaccacccccttgctgtcttacgtgtggctcacggggttttggtatggcttcgccagtgcgcttgtgcgcgaaggcgctccatattcaaaccctgagcccagtcagacaagcacgtggctctgccccaccgtgaacggtatatacaaaagcagcgctgaggttgttggcatgtatcgcaaatacaccaacgacctcagctggctgcgtgcgatccagtcaagcgaattcgaaactggaccgcacgcaaacagctgaaagactgcttcactttggcatacaagctattaatgcatcttagaattaaagcaatgcaaattaataacgtcgcatgacttctttattggagctcgtggtgtttctggcaccgccgttacggccggatgctgatcgaccctgcgctttgcaacttgctggagccgcgagcacagttgaactcatgtaacgttaggtatcctagcacaagctgttagtgaaactgatttggcttgtggaggacaacttatcgttcatttaacgtgttcaagggggttgttttgggatgttgttcacattgatgcaggttattgaggtactgacggtgattaggcgcgttcctgatgcccaaatggaacggcgatctacactgataatcgcgtttggctaacaaactatgtacagacacgggaaaaaatttgtgcaactttttgttggcgtagttggggtttgtggcgcatggtgttttggcattaaaaaaggccttcggaattccgaaggcctttgcattcacaatggtggagacgagggggatcgaacccctgacctcttgactgccagtcaagcgctctcccagctgagctacgcccccgtgacgaggtagtactataggggaagatcttcggggatgcaagtgggaattttggattgattttccgtcttacgggttttcctggggcggcggttaaaaccctgatgcgatagaccttacttgtagaggtaagcgatggcggtaccggtgtggacttggatctttgctgtacccctgacgacgttgctaatgcccatgtcggctagcaggcccagggggctgtggtcaagctcccattctaggccgtgttcgcttaccaccgttccgggggcaatggcgatgatggagaacgtcttgccttcggcaccctcgatggtccacgtctcacctgcgtgaaggatgcgggcgaccaccttgtcctcggcgatccagatgggggcatcctcatagcctgcaagcagccccagtacggaaagcgccatatccgggcggccgccggtggcgcaagtcgcaactaattcggcaccaggccagcggcggcgcacggactccaaagccaacgctaggtcggtatagtccttataggggtcgtggcgctcaacttcaaagtcggtggcggcatcgaccaacgcacgacccgcatcactcaccgtgtcggcatcccccacatacacgtcgcagcccaggccggcgcccagcagcgcgtcgagtccgcggtccacggcgacaacgtggtcgcactcccctgctagcctacgcaacagacccgcgcttgccaccacgggcgagccgcagaccactaatactttgcaagccacagccctcgcctatccctcaaacgaaagcacacggtcaaggtccagctcttcatagctgtcgataaagatatcgcagttggaacgcacctcgtcgcgcttcatgcggccgtgcgggtcatagatgcccacgcgcttaaagccggcgaccccagagctcttaaggccaaaaacggcgtcctcaaacacccatgcgcgctcaaacttgtgcccatggcgctcttccaggcggcgcagcgccagctcgtatacgtcggggaactgtttggagcgtcctgcctcgcccgtcgtggtaacaaattccatgtaagcgtcgagcccggcaccagcgagcgcggactgcaccagctcggccggcgtggacgtagccacgcacatggcaatgcccgccgccttcgcctgctccaaaaatgccaggagaccctcgcgcggcggcaccttggagtacccatcaatcaaaatctcgcccagctcgcgatacagctcctcgccattcgcgccaatgccccacgtgtcgtggtaggcctggcactcgtcctccagcgacaggtgctcaaattgggcaaagtcatccacggtcacgtcgacaccgtggcggtgcaataactcgggctgtgcataggcccaaacgggggtgctattaaccagcgtgccgtcgcaatcgaaaataaaagcaaccttgggagcggcggtatgggacataaacgaacctttcgatatcaaatggtaaacatcctgctaaaaacgttttaccaaacgtcagccaaacaattttgaaacccaaattggtaaaactgtcaagagttttaccacgtcaattctgccagtggtataaacatgtcgcttaccgattaaacgcccccgcaaatccgctttcgtccataaaactaacgcacaggtgttatcgtagtttctgccgaaagttccaccgagcacgcgaggtggaacgaatcatagaactatcgccgtcccttcgattcgtgcagccttggacctttcgcatctagtcaccaaggcaacacgctgccgcgtcatgatgggatcaaacgtgagcgatacaaagctaaagccagcaaccaaaaagcctgctatccgtaaagccgccccgcacgcgccggagctcaccaaggacgatgtctatctgtttggcatcggtacgtgggagcgcagctgggaaaagatgggcgcgcaccccgacacgcagaaccgtacgcgcggctggcgtttttgcgtttgggctcccgacgtaaagagcgtccatgtcattggtgaatttaacgactgggacgaggaagccaacccactggcgcccatgcatacgagtgctatttgggaaggttttattcctggcgccgagcagggccagctctataagtatctcatcgagaccaacgagggcgaaaagctctacaaggccgatccgtacgcctttaaggccgagtgccctccgggtaccgcgagcgtgctgtggaccctcgatggctacaattggaacgacgccgcatggctcaagcgccgcgccagccataaccacatgtcgcagccccttaacatctacgaggtgcatattggctcgtggaagcgccacggcgacgcgccgcagggcgagcccgacgagtacggcaactaccccggacccatggatcccttccccgcgcagcgcggcgagttctatacctacgacgacctgtcggtggagctcgtggactacgtacgcgacatgggctatacgcatatcgaggtcatgccgcttatggagcatcccttcgatggctcctggggctaccagacgtccggctattacgccgcaacgtcgcgctacggcaacccgcagcagctcatgcactttatcgatgcatgccacgaggcaggcatcggcgtgatcatggactgggtacccggcggtttttgcgccgactcccacggccttgccacctttaacggccacatgctgtttgagcacgagattcaccccaactggggcacgcacaagtttgacttcgcccgcggcgaggtccgctccttcctggtctccaacgtgctgtactggcttgagaacttccacgtggacggcattcgcatggacggcgtgtccagtatgctgtacctcaactttggcattgacgatcccagccaaaagaagttcaacaagtacggtaccgaggaggacctggacgccagcgcgtttatccgtcaggtcaactgtgccgtagaggcgcactaccccgacgtgatgatgatggccgaggaatccaccgcatggccgctcgtgacctatccgccgcaggacggcggcctgggcttccactacaagtgggacatgggctggatgaacgacaccctgcactacatgcagaccgattttccgtggcgccccggcaaccacggcctgctcacgttctccatcatgtacgcctttaccgagaacttcatctgcccgctgagccacgacgaagtcgtgcatggcaagtgctcgctcatcggccgcatgccgggcgactggtggcgccagtttgccggcctgcgcacgctggccttctaccagatgacgcaccccggtgccaagctcaactttatgggcaacgagatcggccagtttattgaatggcgctactacgagtccattcagtggttcttgaccgaggagtacgagacccaccgtcatcatcaggcgtttatcaaggcgcttaaccacctgtataccgccgagcccgccctgtacgagcgcggctacaccgacgatggctttacctggatcgacgcggacaactccaagcagtccatcgtgagctttgtccgtcagggcgaggacgtcgatgacgacctggtgatcctgatcaactttgacccggcgagctatgagagcttccgcgtgggcgtgccgcgcgagggcgattgggaggtcatcttcgattccgaccgtcccgagtttggcggcagcggctacgccggcgaggagccctacacctgctcgagcgagccctatccctggaacgggcagatggactccatcgaaattaaggtgcccggcctggcaggcgtggtgcttaagcgccgcggtcccagcagctataagccgcccgtggttaaagagcccaagaaggcgacgcgcaagcggacgtcctcggtaaagcccaagaccgcggctgctaagaaggctccggctaagacgaaggctgccaagtctgctgccaaggcttcggccaagtccagcacggccaaaaaggcatccactaaaaaggctgctcccaaggccaaggcagctgctgttaagccatctgccaaggatgcgtaacaaaagcgttacagctgtaattacccgccccgcgggggcgtaggatacaagtcataaccgttccgggagaaacatccccgggggaaaggaacgtatgaataagatcttcgacaacaagcaggagtttaccgagctctatcgcgatgccgtcatgagcatcagcggcaagagcgtcgaggctgccagcgatctggaccgctttaacgccctggccaagctcgtggccgagaaggcacgcaccgttgccaccaagagcgacgcccgcgtcaccgccgagggcaagaagcgcgtgtactacttctcgatcgagtttttgatcggccgcctgcttgacaactacctgctcaactttggcgtgcgcgacatggtcgccgaggcgctcgacgacatgggcttcgacctgtccgtcatcgagaaccaggagcccgatccggctctgggcaacggtggcctgggccgtctggccgcatgcttcctggattccatggcagccgagggcattgccggctacggcaacggcatgcgctaccgctacggcctgtttaagcaggaaatcgtcaacggcagccaggtcgaggccaccgacgaatggctcacccacggctatccctgggaggtccgccgtcaggacaaggccgtgaccatcaagtttggtggccatgttgagggctttgaggagaacggccgcacgttctaccgcacggtggacacgcaggatatcctggccgttccctatgacatccccgttgtgggctatgccggcgagaccgtcaacaagctgcgcgtctgggccgccgagccggttgaggagcactttgaccttgaggccttcaaccgcggcgactatgccctggccgacgccgagcgcgccgaggccgaggccatcagcgccatcctctaccccaacgacgccggcgagcacggccgtctgctgcgcctgaagcaggagtacctgtttgtctcggccggcatctacagcctgctcgacacctttgagaaggagcacggcgagaactgggacctgctgccgcagtttgtggccatccacaccaacgacacgcaccccgccatgtgcggccccgagctcatgcgcatcctcatcgacgagaagaagctcgagtgggacgacgcctggaacatcgtgacgcaggtcgtgagctacaccaaccacaccatcctgcccgaggccttggagaagtggcccatcggcacgttctccaagctcctcccccgcgtgtatcagatcatcgatgagatcagccgtcgttggcacgagtcgttcgacaccacccaggagggctggcaggagcgtttgcgccagaccgccattctatgggacggcgagattcgcatggccaacctgtccgtgatctgcagccacagcgtcaacggcgtggccaagattcactccgacatcatcaagaacatcgtgctcaaggacttctatgccctgacgcccgaaaagttcaacaacaagaccaacggcatctcgcaccgtcgcttctttgccgaggccaaccccacctacgccaagctcgtgaccgaggccattggcgatggctggctgaaggacgcctttgagctggagaaactcaaggagtttaaggacgacaccgagttcctgaaggccgttggtgcctccaagcgtgccaacaaggagcgcctggccgcctacgttaaggccgagaccggtctggtcatcgaccccaacaccgtcttcgatgttcaggtgaagcgcttccacgcctacaagcgccagctcatgaacatcatgaaggtgatggacatctacaaccgtcgcatcgcggatcccaacttccacgtgacgccgacgaccttcatctttagcggcaaggctgcctcgagctacaccttcgccaaagagaccatccgcctcattaactccgtggccgacgtcatcaacaacgacccgcgcgtcaacgaggtcatgaaggtctgctttatccccaacttccgcgtgagcaacgcccagctcatctaccccgccgccgagatttcggagcagatctccacggccggcaaggaggcctcgggcacgtccaacatgaagctcatgatgaacggcgccattacgctgggcaccctcgacggcgccaacatcgagatcgccgacctggccggccgcgagaacgaggctatctttggcctgaccgctcccgaggtcgagcagctctgggcatcgaacagctactttgcctgggatacgctcaacaacgatcgcgagcgtctgggccgcgtgatggacgagctcaaggacaacacctttgcgggtctttcgggcaacttcgagagcatctacaacgagctcatgaacaacaacgaccccgacctagtcatggcagacttccgcagctacgtggatgcgtgggagaagctcaccggcagctacggcgaccaggagacctggaaccgcaaggccctgctcaacaccgcctcgagtggctggttctcgagcgaccgcaccattcgcgagtaccgcgacgagatctggcacgcgtaaaggcgcgcgagctcccctatgccagcacggcattactcgacgggcgtgacgttgcgccgcgcccgtcgctaatgggtttaggaacatcgatgacagaaggagaaatcgatgagtaagaaagaatgcatcgcgatgctcctcgcaggaggacagggcagccgattgggggcactcacccaaaagatcgccaagccggcggttagctttggtggcaagttccgcattatcgacttttcgctctccaactgctccaactcgggcatcgacacagtgggcgttctgacgcagtatcgcccctacctgctgcatgcctacgtgggctccggcgaggcgtgggatctggacagccgcgacggcggcgtgtcgatcctgccgccgtacgagacgcagaccggtggtgcctggtatgcgggcacggccgatgccattacgcagaacctcgactacatcaaggccaacgaccccaagtacgtcctgattctttcgggcgatcacctgtatcgcatggactaccgcaagatgctcaagacgcacatcgagaacaacgccgacctcacggtgagcgttatgcccgtgccgtgggaggaggccagccgctttggcatcctgaccaccgaccccgaggacggccgcatcaccaagttcaccgagaagcccgataagcccgattcgaacctcgcgtccatgggcatctacatcttctcggccgacgtgctgatcgaagcactcgaggaggacgctctggaccagcgctcgagccacgactttggcaaggacatcatccccaagctgctcggcgagggcaagcgcctgtacagctacgagttccacggcttttggaaggacgtcggcaccatcgccagcttccacgagacctcgatggacctgctgggcaacaaccctgagttcgatctgttcgacaagcacttccccatcatgtccaacatcaccacgcgtccgccgcactacattggcccggacggccgcctggatgactgcctggtctccaacggctgcaagatttacggcaccgctcgccactcaatcctttcgaccgatgtcatcatcgaggagcgcgccgtggtcgaggactccgtgctgctgccgggtgcgcacgttaagagcggtgcgcacatatgccgcgctattctgggcgagaactccacggtcgaagagggcgtgaagctcggctctgtcgataccaccaaggatacggccgtcgttggaaatgacgtcgttatcgggaagggggaatgatccgatgatcaatcgcaaggccatcggttatatcaccgctaactactcttcgacctacggcagcgtgctgctcaaggaccgccccattgcgtccgtaccgtttttgggccgctaccgcctgatcgacttcccgctgtccaacatgatgaatgccggcatcaagaccgtcggcgtcgtcatgccgggtaactaccgctccctgatcgaccacgtgggctcgggcaaggactggggcctggaccgcaagaagggcggcctgttcatggtgcccggcaacgcgtatggcaccaccaagggcggcatgcgcttcttgctgcgcgacatcatctccaacaagacgctgttccagcgctcggacaagccctatgttgtgatgatgggcaccaacatcatctttaacatggacctcaacaccatcatcgaggcgcacgagaactccggtgcccagatgaccgtggtgtactgcaaggccacgcgcaacgtcgatgacgagaccaagctcgagattaacgagaacggccgcctgacgggcgtgagcgccggcgtcgtgtacggcgacaacgcctctatggactgctgcatcgtcaatcgcgagacgctgctcgagatcatcgaccactaccaggccgccgactatctggacctgctcgaggcactccagggcgactttggcaacatcgacgtgtgcagctacgagtacaagggcgaggtcgtgggcgtatttagcgagaagtcactgtatcgccgcagcatggacctgctcgaccagaccgtcgccgaccagctctttgatcccgagcgcccgatcctgaccaaggctcacgacgtgccgccttcgcgctatgcgaccggcagccacgcctgcaactcgatcatctcggccggctgcatcatcaagggcaccgcgcgcaattcgatcctgtcgcgcggcgttgtggttgaggagggcgcatcggtgaccaactcgatcatcaaccagagctgcatcatcaagagcggcgcccgcgtcgagaatgccattctggacaagaacaacgtggttcccaccaacaccgagcttcgcggcacgcccgagaacatcctggtgctgggcaaggctccgttaacttccgacaccaccatcgtacgttaacgttggcaccgcaacatcgctcgtaacatgtagaatagccgcccggttagcgccaggcggctattctcgaattgcaacatgggagacaatatggctgattccagcaaaaagatgcagatcgtgtttgcctcggccgagtgcgcaccgtttgtgaagaccggtggcctgggtgacgtggcgggctcgctgcctgcggcgcttgtgcgcgccggcgccgaggtcatcgtgatggtgcccaagtacgccaccatcaaggacgagtacaaggcgcagatggagcacttctccgacttttacgtgagcctgggctggcgcaacgagtactgcgggctcgagaagctcgagcacgacggcgtcacctatatgttcatcgacaacgagcgctactttgcgcgcgactatccgtacggcttctttgacgacggcgagcgcttcgcgtttttctccaaggccattaccgagagcctgcagcacctgcccgagggctttgagtgcgacatcctgcactgcaacgactggcagacggcattggcgcccgtattcttgcgcgagttctaccagggtctgccgctgtacgagcgcgtcaagaccgtgttctcgatccacaacgtggcgttccagggccagtttagcgacaccgtgatggaggacatcctgggtgtggcgcatattccggcggcagctacgcagttgcgctgcgacgcctgcagcatcaactacatgctgggcgcgctgcactatgccgatgccatcaccacggtgagccccacctacgcgggcgagatccagacgcccgagtttggcgagggcctggacggtgtgctgcgcgagcgctcctatgcgctgcagggcattttgaacggcattgacgtggcgggctttgaccccgcgaccgacaagcgtattgccgccaactacacggttgacgaccgttccggcaaggccgtgtgcaaggccaagctgcaggaagagctggggctcgaggttcgagacgaccgcccgctcatggtgatggtcacgcgcctgacgcgtcaaaagggcatggacctggtcatgtacgcgctcgaccgcatcctggccggcggcgttcaggtggccgtgctgggcaccggcgaccgcgactacgaggacggactgcgctacttccaggacaagtaccccggcaccatggccgcgcgcatcgagtttgacccggcgctgtcgcagcgcatgtatgccgccgccgacatgttcctgatgccttcgaagtttgagccctgcggcctgtcgcagatcatcgccatgcgctacggcaccctgcccatcgtgcgcgaaaccggtggcctgaaggacaccgtgcagccgtataacgagtttaccggcgagggcacgggcttctcgtttagcaactttaacggcgatgagatgggcgacgcggtgttccgcgcggctcgcctgttctgggataaccgcgaggcatggaatcagctggtcacgcaggccatgagccaggactttagctggacgcgctcggccgataagtatcttgatctgtacttctttatgcacccggagattgagcgcccggcggctgtggaggctgctgaggctgtcgaggagccggttgctgctgaggccgagcctgcggcgcccgttaaggagcccgctgctgccaaggagtccaaggccgaggagaagcccgctgccgaggccgaggttaagcctgcggcgaagcctgccgccaagaagacgacggcccgcaagacgacggctaagaaggccacgaccacgaaggccgctgcgagcaagaccaccgctgccaaggcaactaccacacgcaagcgtaccaccgcagccgccaagaaggcagccgaggccgaggccgctcacgaggtaaaggacgaggccgccgaggctaagcctgtggcaaaggctccggctaagaccccttccaagaagacgaccgcgcccaagaccgcaaccgccaaaaaggccacgactacgaagtcgacgacgaccaaggctactacgacgaaggctaccgcaaagatgaccccgaaggttgctgcaaaaccagccgtcaaggtcgaggaggcgggtgccgagcccaaggccgaggcagctatcgaggcaaagccggccgccaagaccaccgcgcgcaagcgcgccacgacgacggccaagaagaccacgaccaaggctgctgctcccaaggcggaggccaaggtcgaggaaaagcccgcagtaaaggccgagccgaccccgaagactgccgaggttaaggccgctcccaaggctaaggcaaagaccgagtccgccaaggaggccccggtctcccccgccgctccggccgaggaaaaggctcctaccaagaagacctccgtccgcaaggctacgactgcccgcaagcgccgctaatccggacgattaaaacttaatcatcaacgcaatagagggcgccccaaccaggcgccctctattgcgttgaacttctctattaaataaagggccggtttactacgacaaaatggctccggccgaccacggagagtattctatgaaattggcaacgcttctacctgcggttttaatatcatcataatgaccgtggttgagatcatccaattcatcgtagtaaaccgaggtacttttgtttaactacaaatagtatcggtatagacgtttttgaatatcgcgataatttgggtggtaaaacgattttctaggacaaccgttcgccgatggtaaacggatgttgtttatacagcctgtgtacaacagatatacttacatcctgtgcgtaaagcccatggccctcaggccgtgattctattgaactggaccgtattatgagattgattcacaacagccgtctaccgcagtttcgtactccgtttggcgctgtgaccactggaacttccgtttcgctatcggtgattttggaggatgccgaccccaaccaggcaacccttaccctgcgtacctgggtcgatgaaatcggtgagtctctgtatcccatggcgcacgagggcgacggcatatttactgcagagcttgagtgcaccgagccctgtcttatctggtacagctttatctgcaatatcgagggccagcccgaggtccgtttgggtgcaccgcagggtcgcaccggtggcgagggcgtaacctacgactacgccgaggttccatctttccagattaccgtctataagcagcgcgaaaaccgtcccacctggtacgagcgcggtatggtctaccagatcttccccgaccgctatgcccgcgacgaaaactggcgcgagcgcacgctggccgaggtcgaaaaaccacgcaacggaatccagcgccgcatggtcgaggactggaacgagccgcccgtgtacgagcgtgccgaagatggctccatcaagacctgggacttttacggcggttcgctcaagggtatccaaaatgacctacctcgcattgccgagctaggctttacggccatctacctcaaccccatctttgaggccgcgagcaaccaccgctacgatacggccgactacaccaagattgacccgattctgggcaccgagcaggactttacggagctgtgcgaggcggctgagaagctcggcatttccattatcctggacggcgtcttcaaccatacgggcgacgactcgatctactttaaccgctacggcaactaccccggcgtcggtgcatggcagagcgaggactcgccgtggcgcgatgcgttttacttccatgaggacggttcgtatgactgctggtggggcgtgggcaacatgcccgccatcaatgagagctccgagctggtacgcgagcggctcctgggcaaggacggcgtgatccgcaaatggctgcgcgccggcgcccatggctggcgtctggacgtggccgacgagctttccgacgacttcctggccgagattaaaaaggccgtgctcgccgagaaacccgatgcgctgctgctcggcgaggtctgggaggatgcctccaacaagatcagctacggccatctgcgccgctacctgcagggctccgagctggactctgctatggattaccccttccgcgacatggtcatcggctttttgatgggctacaagaacgcctaccaggcagccgaggatatcgaaaccctgcgcgagaactacccgcgcgaggcactggcctgcgcactcaatctgctttcgagccacgaccgcccgcgcattatctcggtgctcggcggcggccccgacgagtcgcagctacccgagagcgagcgcagcaagtggcgcctggacgagaattccatgggcttggccaagagccgcttttggttggcgacgctcatgcagatgaccttcccgggcgtgccttcgatctattatggcgatgagtacggcctggagggcctcaccgatccgggcaaccgccgcaccctgcctttgaaggaagacctgcacgacttcgatacgctggctatcgttaagaacgcgtctgccgtgcgtcgcgcgctgccttttatggtcgatggcgaaatcaaggcctttgcgctcaacgacgacgtcttggcctacacccgcacgggcaaagacggcgaggccgcgacggttatcatcaaccgcagcctgcgcaattcgcactgcgtgacgatcccagcgctcggcgaatgtgcgagcgacgtgattagcggccacgagtgcgagatccacaacggcacggttacgctcgacctgtacccgctgggctcttcgatcatctatcaccatgccgagaagcgcctgcaggagccgctcgatcacggcgcgggcgtcgtgtgccacatcacctcggtgccgaccgatgacggcaagcctggcacaatcggtgcgcccacgcgtcgctttatcgatcacctagccgccatgggcatgcgctactggcaggtcctgcccgtcaatcctacggactttttccgctccccttatgccggcccttcggcctttgcaggcaatatcgacctgctgcccgagagccacgaggagctggctgccgacttcgtcacctggaaggcccgcggcggcgaggatgccgacccgctgtacacggcgtttaaacatcgcaatgccgattggctcgagaagtactgcgtctacatggcggtaaagaagtactttgaggggctgtcgcgccacgattggccggcgaatgtcgcgcgctacaacgagcatctgatcgatgacaagcgcttccacgacgaggccgagctgcaggcgtacatgcagtatcgctttgaccttgcctggtgcgagcttatgaactatgcacacaagaagggcatcgaggtcatcggcgatatcccgatgtatgtctcggacgattcggccgacgcgtggagcgagcccgaaaacttctggctatccgacaccggcaaggcgattgaaatttcgggcgcgccgcccgacaactttgcgcccgagggccaggtgtggggaaaccccaccttccgctgggatcacatgaagaagaacggctatcgctggtggatggatcgcctgcgtcgtgcgttcgcgctctacgaccgtgtgcgcctggaccacttcctgggtttccacagctactttagcatccccgccggcgaggcctgtgccgacggccgctggcttgcgggaccaggcaaagacctgttccagaccgcctacgacgagctgggtccgctcaactttatcgccgaggatctaggctatctgacgcctggcgttcgcgccatggcttcgacctgcggtttccccggcatggacgtgctggagtttagcaactacgacgttcgctgcggaattcatcccacgcctggcaagatcctgtacacctcgacgcacgacacctcaacgcttgccggatggtgcacgcattcctttgcgggcggcgacgacccgagcggcattgcattggcaagcgagctcatgggcgatgccctggcaagcgatgctccgctcgtgatgatgccgctgcaggacgtgctggggctgggcgacgatgcacgtatgaacgtgccgggcgtggccacgggcaactggacctggcaggcgcaggaggccgacattgctgcggctgaggagaaaactgcggagctcctgcgcagcacccatagattctggggcgaagcgtgataaaaccccggatatagggtacagttacagctgtttgaatttttgcgggcagagtgatctgcccgctttgtgctgaaaaggaagtattatggcgcgctacgattacaagtgcacgagctgcggcaacgtgtttgaggttgagcatcccatgaccgagacgcccgaggtcgtatgccccagctgcggtgccccggcatccaagacgttctcggccagcggcattaagttcgacggcagcggtttctacaacaccgaccagcgcagtggtggctccagcaccagcgccaccagtggctgttgcgccaactgcccgcataaccactagtgacaagcggccccgcgatcaactccgatcgcggggccgcttctttgcgctatgggtcgataattatttttaaaaattagtatattttaaaatccgcccataccagcagaatagggatcgtcacaggtaccatcgctataccaatgagtagaccccacataattgccattttcgtcataaacatccagagttttaatgactactttaccgccgccgttagaggagcctcccgaatagccgcttccaccagaataattattaccgctataagaattgttggaataattattttgctgagaagcctgctgctgagtctgcgccacttcctcttgagtcttcgcctcagcctctgcttttgccttatttacatcatcaatacgagtttgataacgactaatctgttcattgatttgatcaatgaacagattagaatcctttttggcatcttcaaaaataagcttctgattatctttattagaaatatcattaagaagaccattgaggctattaatatgctgttggagagagtcagtatcttcagtagaatttacatcaaaattaacatggtcagttacagaagtattccactcattattttgagccttacggcagcctttaataatggaatcgtatttattgagcaacttcgtccaatcaggggaagtgccatccgcatacttaaaactgtcattagagatttctttattcaaaatctctttattattttgagcatttttaatggtatcaagacgttgctcaaaagttagtagcccaggatcaaccttaaaggcagcaacactatcgctagcctttgaatacaaaacttcaacctgctgattatgttcactacatgcttgtttgtaattgtaaccagcataaccaccgacacaaccagcaatgagcaaagcaacaataccggcaccaataattacccgctttttaatcgaagaattctcaacctcttcattttcctgagtattatcttcaggattgtcaatcttgtcactattaagttcgttcattttaacccctcaatattaaatctgcgagcggttcatgcatccagaaacttaccaaacccaaccgcttactttcatacccgatttattaatcccagttccagaaaaatcttccttatgagttgcggtgaaataaggactgtttggcgggcagaagccgctattcaatccctatttcaccgcaacttagtagttacttgtggaccagacgagcgcagaagtgaccgtcgtaggagtcggcgtttacggggacgctttggaaaagtccacggtcgttttggcgtacggagacgagcttcttggcttgttcgaactcgggtaactgcagaatctgggcttcggagaggggtgccacggtaaagccggcaccctcgggagaagcaaggaaagcgtccacgacctgcgtgttctcctcgtcgaagaccgagcaggtggcatagataagctcgccgccggcagccacgcgcgcggctgcttccttgagcatcgtcagctgcaggcggggcagctcagtcgtaacgtcgttctcggtcagacgccacggaatctcaggatgacggcgcatagtgccggtgccagagcacggcgcatcgataaacaccgtgtcgaacagggcaggctcgccgagcatggcatcaaaggtcgtgagcacctcattgagctcgcaggcatcgcccgacaccgtacgaacacccgagatacccgccttgtgcaggcgcgcgagattctgatcgcacttgcgatcgtgcaaatcgagcgcggtatgctgacgctcgtagccggcacgcttggcctggcacatcatcacataggtcttggtgccgcgaccggcgccaatctccaggcagcgaccgggacgtgtcgcggcagtagcgataagctgggcgttaaggtccgaggccacggccgccgcgcgttcaaacacacccgacgcaacggtggcctgcgcatcgaccggcgcatggcagcccgggaataccggcgccacaagctgcgataggtacggatcaggcttagttgcaaaggcattctcgtgcaaagcgagcggcgcgggcgccagatttccggcaaagttgagcgcgccctcgggcgtatcaaacgaggccataatgcgagcacacagccagcgcggcatacccatcagacgagacaggcgaaccaaacggcgctcggactcatcggcacccgcggcggcggcaaagtcctcaacgttgtccgcgaccttatacagcacggcgttcgccagaccggcggccgacttagcgccgctacgaaccagctcaacaccctgactcacggcaacgcgacctggggtatgcaggtagagcatctcgaaggccgagattcgaagcgccatgcgaacgcgcggcgcgacctttttgggcttatcgagaaactgatcgagcagctcatccaaaattccctgcgtggcggcaacaccgagcgccaaacgcgcggcaaaagcggaatcgcgctggtcaatggccttggcggaagcacgggaagacaacacgtcgcgtgcgtatataccgcgacggtcggcctccatcagcacatcgagcgcgagcttacgcgcgggggaaagcttgctcatgacaaagcaccccacgtcagatcggcgccctgcaggccggcagcccaggcagaagcagccatagcgcgcttgccatcgggcttaacctcaagcagctcgaccgcaccatcggaaagtcccaggtagacacgcttgctcttaacggcaacagcgccctcgccaagcgacacatccgccagcgcagcatcgagcacgcgaaccgacttaccggcaatcacgcagcgagcgggtgcagtgtcggacgaagccaacacgtgacgcacgcaatcgagcgccgccatctgcggatccagacgcatctcctgcttggaaatcttggcagcatgcgtgacgagcgactcatcctgctcggtccacaccgctgtatcatcggcaagcgagggcagcgtatcggccagcagcttaccgcccagctcgccaagctccatcgtcagtgcctcggcatgcttgccggcaaccgacgtggaagcctgagcacaataagcaccagtatccacgccatgcccaatgcgcataatggaaacgccagcaacctcatcaccagcaagaatggcacgctgaatgggagcagccccacgccaacgaggcaacaaggacgcatgaacattcacaataccaagcggcgccatatgcagcacttcatcaggcaaaatgcaaccgtacgcggccacacagaaaatatcagcccgcgcagcctggagagtatcaactacctcaggcgtcatacgattagcctcaacaaccggcaggccaagctcgagcgccttggccttaacaggagacggctcaagcttcttaccacgcccacgaacagcatcaggacgagtaatggcaagcgcaatctcattcccagcctcaacaagcgaagtcagcgaaggcacagcaaaatcaggcgtacccataaacacaatacgcataaaggacgtctcccctcaaccaaagccgagacggctacaaataacagcggaaagccaattaccaagcccatccgcaataacaattcaacaagaacaaatatacccaaaaacaaagaaagagccgcataaaagcagccctcccaataaagcacctatcagcgaagacgcccctccctggcccgacggcacccgggcgagacaagcagcgtcaacgtagtccctgggatgggcccacacatatcgtcccgcgcgcagtttcgcagcaaagcgagaatgtttgagcacgggatgatatgtgtgggcccatcccagggacggacaattaacctattcagtctcgcccggtcgagcgccgcgggccagggcgtcctggtactccttgacggccttgatcctctgcatgggcttgagtcgctcaaacatggtattgccgtgcagatgatcgatctcgtgctgcaggcacacgcagaacaggtcgcccgaggcctcgtagcgaatcaggttggcatccaggtcgtacgcctcgacgacgacatggtcgggacgctcgatctcgcagctaataccaggaatggaaaggcagccctcgctaaacggcaccagatggtcgctctgctccacgatcacgggattaatgagcacgtacggatcgtagtcgctcttgtcgctgtagtcgcagtcgatggtgaccagctgaatgagctcgccgatctgcggggcagccaggccgcagccgccgttctcgaacatcatcttcttcatcttctcggcaagtgcctcgatcgccggggtgatctcctcgatgacggcgcactcctggcgcagacgagggtcaggcgacagtacgattccgttggcttccatggccatcctttcgggttgttacatcaaatcataggcgtcgacgtcaacgctcacgctcacgccgcgcacggagcccacctctttgaggcaggcgtcgatatcatcagagacatggtaccccacgggcgacttcacaagcagatggaagcggtaacggtccttggctctctcgattacacacgaagccgggcccagcacctgcggcacggtactccccgcccgcaaaaagtcgggcgcggcggcatgccagcggcgcttaagaagctttgcgatacgtccgatgtagttctgcgcgtcgtctcggttcgccgaccacaccaagatgttgaccaggcgaacaaacggcgggtacagcgcgtcgcggcgctgatccaggtcgtagtcggtaaagatcgaacgatcgtgctcagcgacggcgcgaatgaccggatcctcgggcaggtaggtctggatgataacctcgccggggcgatcgccgcggccggcacggcctgcaacctgctccagcagatcgtaggcgcgctcccccgctctaaaatcgggcagctttagcgcaaagtcggcattgaccacgcccaccagcgtgacctcgggaaagtcaaggccctttgcaatcatctgggtgcccagcagcaccgcgcaatcggcggcatcgaactgctcgagcagctttttgtgcgcgtccttgccgcgcgtggaatcggcatccatgcgaatgatggcgacgtcgtcgggcagcatctggtgcagtgcgtcctcgatctgctgagtgcccaggcccatttttgccaggtagcgactgccacatttggggcaacggctcgtggccgccggatagggctgcacgcgccaagacgaaccgcatgtgtgacactgcagcgtgtgtgtgcgctcgtgatacgtaagcgcggtggagcagtggttgcaggtggggacgcagccgcactcgcggcacatcaggaacggcgcaaagccacggcggttatgcagcagcacggccttctcgcggcgctcgaccacacgctcaaggccttctgtaagcggttttgagaacatggagcggctaccgtgcgagaactcgcgacgcagatcggcaatgcgaaccgtgggcaacacggcgtgtcccgggcgctcgggcatctcgacgcgcgtccaggtgacaccgttatacgtgccacggcggcagcggtcgagggactcggcagatggcgtggcggagcccaacacgagcgggcagcggtagcgccgcgccatctcggctgccacctcgcgcacgtggtagcgcggactggagccctgcttatagctagtctcgtgctcctcgtcgatgatgatgagaccaaggtcgctgagcgggcaaaagagcgccgagcgggcgccgacgaccacgcgggccgcaccgctggcgaccatatcccactggtccaggcgctcgccggccgaaaggcgcgaatggaacacggcgaccgtctcgccaaagcgcgaacggaagcggccgacggtctgggccgtcagcgagatctcgggcaccagcacgcaagccgaacggccggccgccagcacgcgctcgatggcggagaggtacacctcggttttgccggagccggtgacgccgtcgaccagcaccacgtcgccatgagcgtccagacgggcgcgctcaatctgcgcgagtgcctgcttctggccgttggtaagggagaccggcgccttgccgcttgccgaggacagcgtggtctgctcgctgcagccacgccacgcacgacgctccttcaccacgacgacgccgcgtttttcgagcgccttgatggtcgccgacatgctgttatagagaaggttgaggtcgcgcgtcgtgaccgggccgcactggagcgcctcgatgagctgacgctgacgaacggcggtcttgggcggcgtatagtcgaaaccctcaggcgtgagcatgacccagcggttttgaataggcttgacggctgggcgctcaaccgtccacgccccgtcatcgcccttcacgacacgcgggctgccgcccggaggcaaaaacagacgcaggcattcggaaagcgtcgcgacatactcgcggctcatccaacgcgcaatgcgggcggcctcggcgccaaagagcggtttgctgaggatggcctcgacgggcttgatgcgcactggatcaaggacggtgtctccttgcagctcgcccagcccagacgcaatgtcgacgatatagccagcggccgcacggtttccaaaatgaactaggacggtggagccgatctgggcctcattggcaagggactgcggaatgccgtaggcaaaaggctcggacagcgcacgggtgggaatgtccaggaccacgctcgcgtaggcggcaatgggctctggcgcaggctcaggtttggcctgctcggccgtgcgggcatgcttcatgggagcttgctccggttcgggcgaaccaaacagcgacagttgctcggccatggcgccagcacctcctatcccatacgtctacagaaacaagagccccactcgcggtgagcggggctcggatacatacgtttgcgcagcgattacagcgccatcgtgcgggcgcggtcgatgcgcgccaggcagtcgtcgcggccgacgagcgccatggtctcgcccagcggagggctcaccatgttgccgcagacggcgacgcgcacggcctggaacaccacgcgcttcttgaggtccatctgctcgggcagcggctcaagcgcggcatcgatggcctcggccgtccactcggtaacaccctcaagcgcggccttggcggcatccagaatggcacccatgccctccttggccaggcccttgttgacagacttctcgtcatactcgagcgtctcggccgtggcaaagatgggagcggcaacggtcacggcgtcggccggcatcttggtgcgcggcttaacgatggcggcaagcgcgtcgatccagtcctcgccgtactcgacgttaccctcgatgagacccgcctcgtgcagctcggggaccatgatctcgtcggcaaactgggcgtcagacatgccgttgatgtactcggcattgacccagtcgagcttcttagggtcgaaggtcgccgggttcttggaaatgcggtcgagcgagaacttgctggccaggacgtcgcgcgggataatcgtggtctcgccgtcgagcgaccagccgagcagcgccaggtagttgacgaaggcatcggacaggtaaccggcgtcgcgatactcctccaccgaggtggcgccgtggcgcttggagagctttttgccgtcggcacccagaatcatggagatgtgggcgaacgtgggcacgggcgcgccgagggcctcgtagaccatgacctggcgcggggtgttggacaggtgatcgtcgccgcggatgacgtgggtgatcttcatcatggcgtcgtcgacgacggtcgcgaagttgtacgtgggcgtgccgtcggagcggaagatgacaaagtcgtcgagctccttggcatcgaaggtcacctcgccgtggacggcgtcgtggatgacgacgtcaccgcggtcctcgggcaccttgatgcgcaagacgtaggactcgccggcctcgatgcggcgacgggcctcctcgggatcaagatcgcggcaacgacgctgatagccctggaaggggtccttgcgctcttgcgcggccttacggtcggcgtcgagctgctccttggtgcagaagcagggataggccttgccctcgtcccaaagcttctgggcggcctgcttatacaggtccaggcgctcggtctgggcgtaggggccatagtcgccgcccacctcgggaccctcgtcccagtccaggcccagccaacgcatggcgcgcagaatgatctgcgtgttctcgtcggtggagcgggtggggtcggtgtcgtcgatgcgcaggatgaacgtgccgccgtttgagcgggcgaaagcccagttatagatagcggtgcgggcgccgccgatgtgcagcttgcccgtcggtgagggtgcaaagcggacgcgaacgtctgatgccatggatatctcctcgattgcaggatggatgtctaactgcaccagtataaagcatcaaagcaacctccgcacaaagggcaccgacccagtcattgggtagctaattttgggacggggcttttttagctaccctatatcgagattggtcttaggctccgaagactccggattgggtagctaaaaaagccccgtcccaaattagctaaccaatggctcggtgcggaaagggtgtgaatgttggatttacgcgctatgatgtgcccttgcatacagagcccggcggaatggtaacggtcgccgggacacgttattcgaaaggacaatcatgtcagaagagcttcgttccatcccgccccaacacggatcgtttgtgtttacgtcggagtcggtgaccgaaggccatcccgataagatcgccgaccagatcagcgacgccgtactcgacgcaatcctcgccaaagaaatagagctccaggagcagggctatattgcgcccaacggcgtgcctgccaacgtggagaacgtccgctgcgcctgcgagaccctcgtgaccaccggcaccgtcatcgtcgccggcgagattcgcacccaggcctacgtcgacgtgcaggaaatcgctcgcggcgttatccgccgcattggctacaaccgtgccaagttcggttttgactgcgatacctgcggcgttatgagcctcatccacgagcagtcgcccgatatcgcccagggcgtcgacgagtccttcgagacccagaccggcgctaccaccgacccgatcgacctgatcggtgccggcgaccagggcatgatgttcggttatgcctccaacgagaccaagaccctcatgcccatgccacactacctggcaagccgcctggccgagcgcctggccacggtgcgtcacgacggtaccctcgcctatctgcgccccgacggcaagacccaggtcaccgtgcgctacgaggacggaaagcccgtcgaggtcacgaccattgtcatctccacgcagcacgccgccgagatcgaggacatgggtaagatcaaggccgacctcatcgagcacgtcatcaccccggtcatggccgccgagaacatgccgtgggataatgccgacatctatgtgaaccccaccggtcgctttgtcgtgggcggccccatgggcgacacgggcctcaccggccgcaagatcatcgtcgacacctacggcggctatggccgtcacggcggcggtgcctttagcggcaaggactgcaccaaggtcgaccgctccgccgcgtatgccgcgcgctgggtcgccaagaacgtggtcgccgccggtctggccgaccgctgcgaagtcgagcttgcctacgccatcggcgtttccaagcccctctcaatcatggtcgacaccttcggtaccgcacatgttgccgaggacaagatcgtcgaggccgtagagaagaccttcgacctgcgcccgggcgcaatcatccgcgacctagacctgcgccgccccatctacgaaaagacggcagcctacggtcactttggccgagaagacgccgacttcacctgggagaaaaccgaccgagtcgaagaactcaaagcagcctgcggcctgtaattgggaaccgctaaggtcataacaacatatgcactttcaaaagaagtaccggtcccaaacggtacttcttttttatttaaaggtggtgaagatgagcctacctgggacatggaataaatcacaggccgataaattttgcagcagagcgactccaaccatgtatcctaagttccgagggctttagtatttggtcgatcgcgagttccgcacgagccggaggccacttaatgtggcctccgtgcgagcaggactgtccgagcaggcgaccaaatactaaagccctcggaacggcgggacagagtatgccccgcccctcgggacgacgggatagataaggagcacccatggcaggcaagccgcaaacactagctacgacctcggcattcgagatcttgggccccgtcatggtcggccccagctcatcgcacaccgccggcgccctgcgctgcgcccaagttgccgccagcctgctggaaggccgcatcaccaaggtcacctttggcctgtggaactccttcgcccacacctaccgcggccacggcaccgatcgtgcgctcgtcgcgggcatcctgggcctcgacaccgatgacgagaacatcaagcaggccttcgacctcgcgcgcgagcagggcctcgaatatcactttgacatcaaaggcgacgacgcctccatccaccccaacaccgtcgacatcgaaatggtcgacgacacgggcgccaccgcccaggttcgcggcgagagcctgggcggtggcaagatgcgcatcagccgcattaacggcgtcggcgtcgacatctcgggcatgtattccacgctcttcgtggcgcacaaggacgtccccggtgtactcgccgcgctcaccaacctactcgcctacgcccacgtaaacatcgccttctgccgcacctaccgcaccgaagtgggcggccaggcctactccgtctttgagaccgacggcgcgcccgacgacaccgtcgtccccatgctgcgcaagctcgacaatgtcgattacgcgacctttatcgagctccccggttctgcctcgtcgctctcccccggcgtctcggcaaaggagatcttcgacgacggcgagcagctgctcgatgcgtgcgaggaactgggactcagcatcggtgccgtcatggccgttcgcgaggcacgtctgaccggcgaggcccacgccgtcgccgccatgcgccgcgtgctcgacgtcatacgcgaggagacaacggcccccatcgccaatccgcagcgctcgctcggcgggcttatcggcggcgaggccaagctcgtcgaagcaacccgctgcaacgatttgagtgaaagcctgatgggccccgtccagaccgaagccgtggcccgcgccatggccgtgctcgagcgctccgccaccatgggcgtgatcgtcgcagctccgacggcaggatccgcgggtgtcgtgcccggctgcgtgctggcgctcgccgatcaccttcagctcgacgacgagcaagtcatggacgcgctctactgcgcagccgccatcggcctcaacctcaccacaagcgcctgcgttgccggcgccgagggcggctgccaagccgaggtcggaagcgccgccgccatggcagccgccgcgctggtgcagatgctcggcggcacgcccgagcaggcgcttgacgccagttccatcgcgctgagtaacctgctgggcctcgtttgtgaccccgtcggtggcctcgtggaggtgccctgccaaaaccgcaacgccatcggcgtggcagcggcctttagctcggcacaactcgccctcgcaggcattaagagcctggtgccgtttgaccagatggcacatgtcatgctctcagtgggccacgcgttgccggccacgctgcgcgagacggcaaagggcggcatcgcgcaggctccggccgcactttcggcctgtgcaaaatgcggtgtgtgcggatagcggcaaagaacgactcaaaggtgggacaaatgtcccacctcttttgaatgccaccgtttccgtaccacaaacagcagggcaatcgctataatgcaagcccagtaaaaacacgatgaaccgcaaggcgaaaatcgaaggatatgcatacgatgtcgcaaaacgatcgaactcaactgattcccgatccgcagcagccgagcaggcacaccggcggcgttcagtcgccgcgtcctatcgcgccgagccacggtcagcagcgtggtgcggcaaacgcttcccaacgcccgaaccaacagcgacagcagcgtcaacaacgtcagcagcgccaggcaaacggcaatgcgcccaagcaaccccccacgcacgctcgaggcgatcgcggccccgcgcgcaaacccgccgagaacaataagtcgggcaaaaagacgacgctctttgtcgtcttgggtcttatcgtcattgtctatatcgtgggcgtcgtagcgttttcgcaggtagcctaccccaacaccaccatcgccggcgtcgacgtctcgttctccaacgcttcgtctgccgcaaccaaggtcaactcggcatggaagcactataagctcaccgtgacaggcgatgactttagctggacctatcagcccgactccgatgagcccatcgtcgacggcgaagctgccgcaaaagagattatcggccacaacgaggcctttatatggccggtccgccttgtggaatccttaagcggcaagaccaaaacaaccgctacctccaacgaagtcgatcttgatcaagacgtcgacctgtccatgatctccggcacctttgaccataagaaatttgagaaggatctgggcgccgccatcgacgagtttaacgaggggcgttcgggcacgttcgaggccaatagctcctatgacgagcaagcgggcaagtttaccgtcgagaaggcgcgctccaacgaaaaactcaaccgcgagcacgtcattaagtatgccgagctcgaacttgcctcgctggccgagaccgtagatctttccaagctcggcaacgatgcctatgagccgctcaatggaacgctgaccgatgatcagattcaggccgcatgcgatgccgccaacaacttcctaggcgtcaacgtgaccctcaagctcaacggcgaggatgccggcaaggttgatggcagctccgtattgcagtggatcagctttgccgatcccgccaaccccacactcgatacgacgcagatcagcagctgggcagccgagctcgccaacggctttaataccgtgggctccactcgctggtggacgtgcgccgatggcaagcagtgcgccgtcgaaggcggtgactttggttggtccatcgacagcagctcgctcgccaagcaggtcgaggacgccattaacaacaaacagaccggcgaaatcgagatcaagtactcccagaaggccgacacctttaccgcaaagggagagcccgactggaaggcgtatatcgacgtcgacctgtccgagcagcacgcgcgctactatgacgagaacggtaatatcgtttgggaggccaactttatttccggcaaaccgggcgaagacgcaacccccgagggcgtgtggcagatcaacagcaacgacggcggcagcaccctgattggagccaaggaccccgaaaccggtaagcccaaatacgagagcccggtgagctactggatgccgtttgagggcaacatgatcggcttccacgatgccacctggcaaaacgacaagagcttcgataacgccgagtcgtacaagtggtgcggcagccacggctgcatcaacctgcgcctggccgacgccaaggcacttcacgactgcatcaaagtcggcctgtgcgtggttgtccactcgtagtgcaacgcgcgcattcctacaacgtggaactgctgcgaccaatctaacagttccgaaagaaaccgtcctatgcgcccgccccaaccggtgggcgcttataattatcgaggtttttctataaaggagacgctatgccgaatgtccccacgatcaccccgggcccagatgataccgagtgcacgcccgaaggtgccaccgaaacgattcctctgattacaaacgtacatgccgacaagcagagcgaacgcacgaacgatacggccgagatttccgatgaagaggcatatgccaagctcaaggcaaaacgcgccgaacgtcgacacaaaaagctgattcgacacggtattgccgccggcgtcgtaggtgccatcgcactcattgccattgtcgcaaccttggttatcaatgcgcagccacagggcgctagcggggctgtgaccgacatggtgaccgagggcacgtttagcacaacggtcgaggcgaaaggccagctcaaacccatttcatcctcagtggtctccccttctgtcgacggcacggtcgattcgatcaacgtgcaggcaggccaatccgtcagcgagggcgacgtgcttatgaccattaaaaacgacgagctcgatcgcaacgttgccgaggcgcagcgtgcagttgcagccgcccaggaagacctcaccaacgcgcagaaagccgccgctgtcgcgcaggccaccccaacgacggacgtcgatggagcttccgcagcggctggcgtctccgctgcatcagtggacacgaacgccgtatcggccgcgcagcgcagcctcgcttcggcccaggcaaacctagaccaggcgaacgccaaggccgccagtcgcacggtcacggccccgagctcgggtagcatcgtggagctcaacgccaaggtgggcgccacggtaacaggcggcatgatcatgggcgaaagcgatacgagcggcggcaagcagtgcatgcagatcgccgacctatccaagatgaaggtgaccgtgcaggtgggcgaaaaggacatcgccaagatcgccgttgggcagagcgccaacgtcacgtatcccgcttttcccgatatcgtgagccagggcaccgtcacggctatcgcgtcggtggcaaactccgacgccgccaacggcggcggcagcgtgacctttaacgtcgacatcctcatcgaggcgcccgacgcgcgcctgaagccgggcatgacggccgaggtatcggtggtgaccgagcagctcgacgacgtggtgatggtgccgacgatggcgctcatgaccgaagacggcgaacactattacgtcaacgtggcaaccgatgacgaaggcaaggaaacgcgccgcgtcaaggtgaccgtcgtgacgcaaaacgacaacgaagccgtagtcggcaagacacaggtcaagcgcgacgaccagggcaacgagatcaaccccaacgtaccggttaccaagctgcgcgatggcgacacgctcgtcatggacaccggagcggacgcaacggctgacggcggctacagcgcggattcgggcagtatgtctgccgatgaggacatgtaatgcgtcccgttatcgacatccgcaacgtgcaccgcatctttgagagcgaggcgggttgcgcccacatcctgcacaacgtgagcctggcggtaaatcccggcgaattcgtcgctatcactggcccctcggcctcgggcaaatcaacgctcatgaacatcctaggctgcctggataagccgacggcgggcgactactacctgcaagggctcaacgtggccgagcttgacgatgacgagctcaccgaagtccgcggcctgagcattggctttgtctttcagagcttcaacctgctgccgcgcctgtcggttatcgaaaacgtgatgctgccgctggcctacaccaatgtgccccgtagccagcgcgaaatgcgcgccgtgcatgcgctgcaggctgtcacgctgcccgtcgaccactgggaccaccgcatatccgagctctcgggcggccagatgcagcgcgtcgcaatcgcgcgcgccctcgtcaatgacccgcccatcattctggccgacgagcctacgggaaacctggactccgctaccggagcgcttgtgatggagaccttccataagctccagaaacgcggcaaaaccatcgtgcttatcacacacgaccccggcatcgccgccgaggccgaccgtgccgtgaccatccgcgacggtcgcattcacgacggcgcgtatattccacatgcaccgcggaccctgcgcagcgccgtagatagcctgcccatgatttccgcctccgccaacccgccgaaaggagtggtggcatgagcgcccgcgatctcatccaggaagcccttcactcgctcgaggccaacaaggggcgcagcctgctcaccattctgggcattgtcatcggcatcgcctcggttatcgccatgacttcgctcatcggcggcatccaaaacagcctggtcaacagtctgggcctcaatgcggcacgcatggtgcaaatctattcgtcgcaagaactcaccgagtcggacatcgagaagcttcaaaaactggtgccgcagatagagcagatcggcattgtcgacagcgcgtataccgagtataagaccggcgataaaagctataccgtcatggcacagggtgtcgatagcgacatgctcgacgccgtgggggccagcaagctcgttgcggggcgcacctattcccaggccgagtcccaatcaggctcgcgcgtggcgctcatcagccgcaacggcgccgatcagctttacggcaacgaacaggatgcgctggggaaaaccatcaaggtgtccaacggcgaggtgcagattgtaggcgtgattgatggcggcagcgactccatgggctcgctcacgctgtatatgccacgcgaaactatctccggactgtttggcgacgagaatccttcattccccagcgtgacggcacttgccgccgagggcacggacatggatgagctctgcaaaaccatcgagtccaaggtgcgcgcgatgaagggcatcgaggaggaggacgagtacgacagtgtatcggcaacctccatgaaaagcgctatcgatgcactcaactcctttatgggcgcattctcgctcatcatgggtgctgtcgccagcatctcgctgcttgtcggcggtatcggcattatgaatatgatgctcaccaacgtatctgaacgcatccgtgagatcggcatccgccgtgctctgggcgcaagtcgtcgcgatatcaccgcgcagtttttggccgaatcctcggcgctgtgcgtcaccggcggactgctaggtgtcctgattggctatctgctggcatggggcctcgcgatgtttgcctccggatccgggattcttggcgagctcggtgccagcgggcaaatcacaccgagtttttcaatcgccacggtgatgctggccttcgccgtctccgtcggcatcggcgtgatctttggcttctaccccgctcgccgcgcggcgaagctcgacccggtggagtgcctacgctaccagtaagccaccaccaacaagttgcggtgaattagggactaaatatgctatctagcagcaaatacagacactatttcaccgcaacttattgaagggctgcttgcgccagttccgggcgtcgtcctcgagctattggcggatgacggtcttgtacggttcgagcttgctcggggcgctcctcctcgcaggcgggagggcacgcatgcgcggcgagcacctagcgcgcgaactcccgtaagagcgcgtctttcacttcccgaagcgaaagggccccgcctccctcggcgggacgggcgaccacgatacagcgcgctcccacgtcgtgcgcggaggcgatcttctcggccgtgccgcctacggttcccgagtccttggtcacaagccactgggcgcccacctgccgaagcatcgccacgttgagctcgcgggtgaagggcccctgcatgccgatgacgtgcgacggcgaaaaccccgcgtcgatgcacttcgttatagcaccgggcagcgggagcacacgcacgaagaagcgctccgcgaaatcggcgacgcgcgtgtagggagcaagctccttgctccccgtcgtgagaagcgcgcgacccgggttctcggagagaaagcgcgccgcgcaggcgatcgactcgaccgagacgacgcctttgggcagcgcctcgaccgggcgcgcaaggcgcaggcatcgtgcacccacggcgagcgaagcggcccggatgttgccgctggcgagcgtagcgaaggggtgcgtggcgtcgacgacgatgcgcgcgccggaaagctcgcgctccatgtcggcctcgtcgagcctgctcgcatgcacctcgatgcccggaagctcgcccaaaagctcgcctccgtactcggttgccgcgtaggcacgggcggggatgcccgccccgctcgcccattcgcacagaaggcggccctcggtggtgccggcgaagatgcgcagcgccggcgcagatgcgggcgccgtcacttcgggccgcctgggcgcgtgatctggtagagcagcgcgttcataatggcggccgccacggtcgaaccacccttgcgacccctcgcgacgatggccggcgcgcgtcgcgcgagtagctcctctttcgcctcgaccacgttcacaaacccgaccggcaccccaacgacgagcgcgggcgcgatcttcccctcgtccatgagctcggcgaggcgcagaagtgctgtgggagcgttgccgacggccacgatgagcggaccctcgatgccgcaagctttgtccatgctcgcaacggcgcgagtcgtgcccgcggcgcgcgcagccacggcgacatcagggtcggccatgtagcacacggccttgcagccgagcttcgcgagcgcaggcttgcttatgcctgcgagcgccatgttcgtatcggtgagcaccgtggcccctgcgcgcagtgcgtcgagcgcacagtgcgcggcgtcatgagtgaaaacgagggaatcggcgtacgagaagtcggcagtggtgtggatgacgcgcttcacgacgggttcttcgagcggcgggaacgtgcggccgccgagctcttcggtgatgatctcgaagctgcgccgctcgatgtcgccgggcgccatctccttggaatccatctagtactccactccttcccttgcacatatcccctgctcgtaggggtgtttctcgcaccgcatctcggttatgtagtcggccttctccacgatcttgcgggaaggcgcgcgcccggtgagcgctacttcgacgccgcgcgcggacatatcgagcgcgcggtccacgagcgcctcgtcgacaagccccttcgaaagcgcatcgagcgcctcgtcgagcacgagcagcccctcctgcgcgccctcgagctcggcaagcgcggaagcgaggttcccatcgtgcagctcgcacgtagcggcaagttcttccgacgacatcgaccaggtaaacttgtccgacaccttccccgcgaacacgggcacgccgaaatgctcggcgagcaggcgcgcctccccgctttcgccgtctttcaggaactgcacgacgacgacgcggcggcctgcggcgagcatgcgaagggcgaggcccatcgccgccgtggtcttgcctttgccgtcgccatgatacacgtgaatcatacgccctcctcgataatgcggtagacatactccatgtcgagcgctccgcgcacgacgtcggccaggcggtcgaactcgcgcgcacggtgatcggccgcggacgccgcgcccgcagcacccacgacgctctcgggcaggccgcgcatgcgcgcgagcgagcgcgcgagggcgagcgccacccccggttcgtcgaacaggccgtggagataggttccgaacacgtttccgcaggccgcgccttctggtttgccgccaatcgtgcccgcaggggcgcaggagacggtcgtttcgccgtcgtgaatctcgtacccacgcgccgtcatgccgttccacaccgagaacgcgccttgggcgcccgtgatgcgcagctccgactgggcgaggcgcttttcctccttgaacaccgtacttgcagggatgagcccgagcccgcgcgcggtgccagcgccttccctgccgtgcgggtccgaaagctcgtctcccaaaagctggtagcctccgcatatgccgagcaccggcgtgcccgcgcccgaaagcgcgcgtacacaggctccgatgccgctagccgcaagccagcgcgcgtcgtcgaccgtggacttcgagccgggaagcaccaccaggtcgggtcggcccagatcggtcgtcgaggaaacgtagcgcacgcccatgccgggcacgcgcgaaagcgggtcgaagtcggtgaagttcgacagatgcggaaggcgcacgacggcgacgtcgatgacgccgcgcgcctcgcgggcagttaggcgcggcgcgagcgagtcctcgtcgtccaggtcgagcgtaagatacggcacgacccccacgacgggaaccccgcacattttctcgagcggagccaaacccggacgcaggatttccacatcgccgcggaacttgttcaccataagcccccgcaaaagcgcgcggtcctcgggcgcaaggagcgcgaccgtgccgtagagctgggcaaacaccccgcctgggtcgatgtcgcccgcgagcagcacgggggaggacacggcgcgcgcgagccccatgttgacgatgtcgttttcggcaaggttgatttcgacgggactgccggcgccctcgatgacgatgacgtcgttttcctccgcgagcgaatcgaacgcctccaaaatctgcggcatgagcgccttctttcgcgcgaagtagtccctcgcagcgaaggctccctgcgccttgccggccacgatgagctggcttcggtgatcgctttcgggcttgagcaggatggggttcatgcgcacgtcgggcgcgatgccgcacgcctcggcctgcatgatctgagcgcgccccatctcgagcccgtcggccgtgacaccgctgttgagcgccatgttctggctcttgaagggagccacgcgcaggccgtcctgcgaaagcacacggcacagccccgccgcaagcaggctcttccccgcgttcgacatggtgccctggatcatgatgggcttcgccctacccacgggtatcgacctccttcgccgagcctcggccatccgcgcccgccatagcgccgctgcaagaagcgccgccccgttcgtcgggttcgccttcgcccgatgcgccttccgcccgaagcgcgcggctgaacgccatcgcaagccgggcattctccttgtgcgtgcgcacggcgacgcggcaccagaaacgggacagtatcgaaaacgagtcgcacgtgcggaccaaaagcccctgtttatacaggcgctcggggatgtctttcgccggcgtgcggactaaaaggaagttcgcatccgacggcacgacggaaagcccgagcgaggagagctcgtgggaaagccacgctcgctcgcccgccaatacatcgcgcgtgcgcgagacgtattcgacgtcttccagggcggcgatgcccgcggcctcggcgaccgaggagacgggccacgcctgccccgcccgacgaatcccctcgatgagttgggcgtttccgctgatcagataccccaaccgcaaccctgccattccgtagagcttggtgaacgcggagagcacggccacatggtgcgaacacgcggcgcgtgcggccacgctcctttcgcgggcgtcgggcgcaaatccgaggaagcactcgtccacgacgagcagcgcgcccacctgctcgcagcggcaagccgcggcatcgatcacgcgggggtcgacgaggcgccccgtcgggttgttcggattgcagaggtacgccacgtctcccggcccctcgatcgcgcgggcgaaggaggcgggcacgtcgaagtcatccgcctcggagagcgggaactcctgcacgcatgcaccgtagtacgatgccgcctccgcatattcagagaacgtcggcgcgcacacgacgatgcgtttcgggcgcaccgccgcggcgagccgccagatgatgtcagacgcgcccgcgccgcagacgatagtatcttcgggaatgccctgggcgcgccctagggcgcgaacgagtgcgaggctttccctatcggggtaggcgtcgattcgagaaagcgccttgcaagctgcggcgacggcgcgcggcgaggggcctgccggattcacgttcaccgagaagtcaatgaggtcggaggcgcccccctcgcaagcgatgccgagcgattgcgagctgcccccatgcgtacgggcgcgcaggattcccccggcagcctggggcgcggcgtggtcttccctcatgccatcgcccccacggcgagcacgaccgccgcgcgcgcggcgccgaagacgacgagcgcgcatacggacgcggcgagcatgagccttgtcgcccgtgcgatgtcgccccactcgatttcgcgggacgcgtcgcctatcgtcggtttctcaacgagcttgccgaaatacaccgcgggtcccgccaggcgcagcccgagcgcgcccgcgcacgctgactcggtctgcgccgagttggggctcgcatggcgacgcctgtcgcggcgccagatgcgcgccgccccgcgcgcgtcgagcccgacgatcgggcacacggcgatcatgagcagggccgataagcgcgagggaatccagttcaccgcatcgtcgaggcgcgccgaggcgcagccgaagtcgatgtagcgctcatttttgtagcccaccatgctgtcgagcgtgttcaccgccttgtacgccatgcccaagggcgcacccccgatcataaggtagaaaagcggcgcgatgacgccgtcgctcgcgttctccgccaccgtttccacggcggcgcgcgcaacgccctgctcgtcgagaacagacgtgtcgcgtcccacgatgagcccgacggcttcgcgagccgcgacaaggccgcccttcgagaacgcgcgggccacggccaggctctggcggcgaagctcgcatgccgcgagaatctgatagcttgcccatgcctcggccacgaagcgcaagccggagtgaaccatgccgcaaagatgcaggattccccaggtcaaaagcccacacgcaagcggaagcgccacggcgagcacaagccctgcggcgcgcgtgcccgcggacgtttgcgggaatgcgccccgcaggcggccttcggcccacgtgatcgcgcgccccatggcgacgacgggatggggaagccagcgcgggtcgccgaaggcaaggtcggccgctaacccggcggcgacggcaagaatcgtcatcaccgggcatcgccccccgaagcgggccgaacgtcgcgaaggcagcgcccatcccaggtggcggcccatgcaccacccggctcggtatgcacgtcgaagtatcccattttcgggacagctagctcggagagcagcgctttcacggtacccgcgtgaacgacgaagacggcgcgcccactcccctgggcgcgctccgattcgcacgcctcccgaaacgccgcgacgacgcggcgggtgaaatcgctcttgccctcgccatgcgggcagcgcgtctcacaccaggagtctacccaggcgcggtaacgcgcatcctctttaagttcggcggcgcttcgcccctcgaagtcgccgaaatctatctcgcgcagaccggggcacgccataagctccgcgttcgggaagagaatgcgtgccgtctggtcggagcgggccatgccgctcgtgataacacggaacacgtcacgatcgcacgcgaggtcgcgcaaagcgcgctcgcccgcgctcgacaggggctcgtcggtgcccgccccgctgtagcgatggtcttccgtgcccgccgtggcaccatggcgcacgaagatgacttccaaaggcgcgcccgcgcccagcgtccctcgaggcgcatcggcaaggtttcctttgatgacctggggaatcccgcacgtcatgcgcacgacgacgtcggcgcgcgcagcgagcgcgcatcccaggcgccccgcgcgctcgcgccattgggcgtcttccgcacgcatagggacgacccccgagccgaccaaggtcagaatcactgcgtcgaagccaatcagccgctcgagcgcccggtcagcgtcgagcgtgcgtacgagttcctcagcacggtacgcgacacggccggcaaaaaccgcgggcacgacgccctccgcaagctgcgccgcgtcgacgaaatcgtccgccgcgaacccgagcttttcgcgcacgaaggtcctcttccccgaatgcgcgccacctaccacgagcatcataggagcatgccccccgccaccagcatggcaagcatcgcgagctcggcccattgcagaaaccatccggccaaatcccccgtcaccccgccgaagcgggacagggcaacatggcgataccacgcgagcgccaaaagccccgccaccgccataagggcgccgacggcccgagcgcacgcgaccatccctgcagccgaagccgcagcgaaagcgcaaagcggcacgacgatcgccgcgcgcttcttcgaaggcgagagtcccgcggccatgccgtccgcccgcgcggcaggccagcattcaacggcgagccccgaaagcgcgcgggagaacacgagcgagcacagaagcgcgaggaacgcccccgccgtaagcggcagcgcggtgaacagggaaaactgcagaataaggtacacgacaacaccgatgaccccgaaggcgcccgcccgcgggtcgtgcatgatctcgagctttcgctcgcgcggggcccaacttgcaagcgcatcggaggtgtcgcagagcccgtctaggtggatgccacccgtcaccgccacaggcagcgccacgagcacggccgcgacgatggtcgcgggcacgacaagcaggttagccacgtacccccacgccgtcatgaggaagccttccgcaaggcccaccaggggaaacgcggcaagcgcatgggttgacccgaaatcggtccaggccgatttcgggacggggatgcgcgagaacgttccgaacgccgcgccgattgcctctgctatcttcaccttgtaggtccttcgcctttcatccacacgggaatcccgcataccacttcgactgcgcggtcggccatcgccgtcacgccctcgttcacgcgcgcgagcgcgcgcctccacgcctcggtcccctcatcgtagcgcatcccatcggcgaacacgtcgacggtgaccaccaccgtatgcacagcggcctgagcgagccgttcgatgcctccgagcacctcgcgcgccgcagcatcggggtcacgtgggggcaagccgccttccgggaagagctcgttcgcaaccaggttgcccacgtcctccaaaagaagcgtgcagccgcgcggaagcccgggcactgcggcgcccacgtcacgcgtgcgctcgagggtggaaaaccccttgccctcgcgcagcgcccgatggcgcgcgatgcggcgggcgccctcttccccgaagggctccatcgttgccaggtacacgcggggcccgtcgtgcccgaggcacagggactcggcgtaggcgctcttgccgctcgcggcggcgccgataacgagcgtcaccgtcatttccaggcctcgaaatgctcgtaagcagccatgccggtcgccgtgaacgtcttcccatcccggtacacgcgcagcgccgaatccagaaggggcagatacgccatggcgcccgcgccctcgcccaagtgcatgcctgcgtcgaggggtgcctttatgccgagctcgcgaaggagctcctggcttgcgggttcacttgatgcgtgggtgcccacgaggtagcccaaggcgttggagcacaggcgcgccgcgcacagggccgccgtgcaggatactaccccgtcgaggagcgccggagccttcgaggccgcggcccccaggtagaagccgcacatcgccgcgatgtcgaagccgcccaccttcgagagcacgtcgatcgggtcggcgggatcgggcgagttcgcgtcgatagcgcgctcgaccacgtcgcgcttgcgcgcgagtgaggcgtccgagagccccgcgccgcgcccgacgaggctccgcgcgtccgcccggaggagcactgcggccaccgccgccgaggtggtcgtgttgccgatgcccatctcgcccgcgacgagaaggcgcacgtcggcgcgggcaagcccgcacgcgacggcgattccgacctcgattgcgcgcacggccccatcgcgagacatagcggcgccgtgcgcgatgttgtcgctcccccgccgcacgttcgcgcgcaccatgcgcgcgtcttctatgccccgggccatacccacgtcgacgggcacgacctcggcacccgcgaacgccgccatgcggcaggcactcgtggccccctcgcacatgttgcgcgcgacggctcgcgtcacgtcttgcccgctttgcgacacgccttcggcaacgaccccgttgtcggagaagaataccgcgagtgcacggggaaactcggccacctcggcgctcccctgagccgcggcgatacacgcgacggcgtcttcaaagtcgcccaatccccgcaagggatgcgcgatggagtcccactcggcgtacgcggcggcgcgggcgcactcgtctgcgggcgcgatccgggagagcgcggcttcgagcacggcgcccggcgccgacgagaacgcgcgctcgacttcctcgcggatgcaggccaacgcggtttcggttgcttcagccatgccgtctcctctctgcgaacgacgctgcggcagacgcgaacgtgcgcgcaacgtcggggttcgcaggatagtacacatgcgggaagcccgcaaccagggacggggtggtcgtcatgcacggccagcccttgtcgcgccggggcttctgcgcccagaagtcgccgcccgggcaggtggactgccagtagtggaactcgtgcgcgcggatgcgtgtgccgcgcggcccgtagagcccgtcgcgttgggaagtgagctccacgtacccgaaatgggacagccttcccccgttctcgcttgcgccttcaagggcgcccgcaacaggccagcgccgcccctcgctatcggcgatttcacgctgcaggtacagaaacccaccgcattcggcgaccgtcggcatgccggattccaccgcgcgccgcaccgcctcgcgcataggcgcgttctcggagagctgccgcgcatggagctccgggtagccgcctcccagatagagggcgcttgtcccccggggcaactcactatcacacaaggggctgaaaaaggccagctcgcaacccaggtcctcgagcgcgcgcaggttctcctcgtagtagaacgagaacgcctcgtcacgggcgacggcgacgatgggccgcgctcccgcgatcggctccaaccggtaaggttcctcgcggatatcgggtgccgtcgccgctgtttcgagcaagcggtcgacgtcgacggtcttttccaccagctcggccatcttgtcgatgcgcgcggagagctgctcgacctcgtcggcggtcacaagccccagatgccggctttcgagcgagaacgcctcgtcggcggggatattccccaaaaccgcgacgcccgtgtgcttctcgatcgcaggcgccgcgtaggcgcaggcagcggcgctcgtcttgttcaacacgacgccgcgcacgttcgcacaaggcaggaactcggcgatgccgcggattacggcggcgagcgataaagacgccccgcgcccgttcaccactaaaacgaccggcgtttccgtgtcgcgcgcaacctggtagctgctcgcgtcggccacgccgggcgccatgccgtcgtagaagcccatgaccccctcgagcaccgcgacatccgcactcgcggcgccgcgtgcgagcagggcgcgcagcgtcggggcgtcggtgaagaagccgtctaagttgcccgagcgcgcacccacgacgcgacgatgaaagagcgggtcaatgtagtcggggccgcatttgaaggccgcgcatgcaaggccgcggcgtgcgagcgcgcgcaggagcgcgcacgtaacgaccgtcttgccgctcccgctcgagggcgcagcgaccatgaagcgcgggatggtcgtgctcaccgggcgccgccttccccacctgcaccacgcgcgctgacgaggaacacggggttttgcgccttcataagatggtgcgagcctacagcctcggcgcgggcggccgacacctggcacgcctcgaaccccttaaagcgcgaacccgagaggagcgcgcacgcctcggtgagcgtctcaacggtgacgcatggcacacacaggcgaacctgcgagtttttctcgagcgccgcctccacgatggagggaagctcacccgcgctcccgccgacgaacacggcgtcggggacgggcagtttcgcgagcgcttcgggggcgacaccggggaccgcatgcacgttgccgcagccgaatgcatccgcgttctctcggatgagccgcacgccggccgcgttgcgctcgaccgcccataccgaccccactcgcgcgacgagcgccgcctcgatcgacacgctccccgtgccggcgccgacgtcccacacggtgtcggtcgcggtaaggcgcagcttcgcgagcgcgacggcgcgcacctcctgcttggtcatgggaacgtcgccgcggatgaagagctcgtcgggaatgcccgaggaagcgtacggccagcgggagctcgcggcgcgggatgcgcccgcagagtccgccgcggaagaagccgccgtgggcgcagacgcaccggcaggcgcctcagaggctacgctagagcccgcgggcgagccggcgccgcctgcgaactcgataagcatcacgttcaagtcgtcgaacgtctgacctgcaatttcacttgcggtcgcgcaggtgatgcgctcctcggggtacgacaggcgctcggccaccgtcacgcgcgcgtccccgaagcccgcatgcacaagctcacccgaaagccgcgaggggtcttccccgcccgacgtgacgaggaagagttcacctgcgcgctcggcctcggccacgatgtcgcacgccacgccgtgagcgctcgcgaagcgccaatcctgccatggacgcgcgaggcgcgcggcgagatacgacgctgagcttatgccgggaatgacgcgcacgtccacctgcgcgtcgccggagagcgcctccaccaggcggcgcgcgccactgaacagccccacatcgcccgtcatcacgaccacggcgcgctgccacgacgccgcatcggtgagcgcggcgacgatgtccgccgtcttcacgagctcgcatctcaccacgtcgggcggcacgtcgatgccggcaagcgcgcgatgagcgccgatgaccacatcggcgatgtcgatcgcgtcgagcgccgcgcgcgagagcaagtcggggtttccgggccccgccccgattatcgttacctttcgcatggaatctcccgatacccgcgcggcgtgaccatacggccgcctacgcgcttcgtgtccgcgttgccgacgaacacggtggtgaacatgtcggcgtcgagctcccccagctcggagagcctgcacatgcccgactgctgcccctcgcgcccgatgttgcgtacccagccgcagagcgtgtcgggggccttccattcgagcataatcttcgccgcgcgcgagagcctgtcggcgcgctttctgctgcgcgggttgtacaaacagatgcagaagtcggcgctcgccacggcggcgagcctgcgctcgatgacctcccacggcgtgagcaggtcggagagcgacacgaccgcgaagtcgtgggcaagcggggcgccgagcaccgccgacccgctctgagccgcggtggccccggagataacttccacgtctacatcggggtagtcctccgcaagctccagcacggggctcgccatgccgtaaacgcccgcgtcaccgctgcacacgagcgccacggcttctccgctctgcgcgcgcgaaagcgccagacggcaccgttcgacctcgtgcatcatcggcgtcgcgagatgcgccgcgtcgggcacggcggcaagcgcgagctccacgtatttcgtgtacccaacaacgatgtcggccgcctcgagcgcgcgccgagccgcaatcgtcatgccgtcggggccgcccgggccgatccccaccacgaagagctttcccatcaccgctccttaaacgaaagttcgatagatactttggaaaacgcgacggtcacgccgccgtgagcgagcttcgggaagataagtttgcccccgcccgcgagcgccgcgcgctcgcacacattgtcgacccccaccgtcgcgcgcacgaaatcagatggcgaaacgctgccttcgacctgcgacaactcctctgcggaatacgtcgcaagcgggatattgcgcgcgcggcagaaggcgagcagaccctcctcgtgcgccttcacgtcgatcgtcgccgcctcgcgcacggccaaaggcgagatgcccgcctgcccgcacgcgagaagaaacgcctccccgatcgcttcggcgcacgcaccgcgacggcaccctatgcccgcaacgatacagggcacgacaaggcgaagcggctcgggcgcaggcgcctgcacccgcatgcccgccggcatccccgtctcaccggcgggcacgacctcgtccgttgtctccgccgcgcgaacgaacgcgcctgcattcgcgccagcgaacggcgacacgatgatatcggcccgagcgcggtcggacgcaatgtctaccccctcaggcggctgtcccgaaatcggcatgtcggaatagagtgccacgcgcccgcccgaaagcagccgcgccgacactcgcttgatggcctcgggattcgaaacggcgagccccgcacagcgcgcccacgtatccaccgcccacacgccgcggacgtcggtcgccgtggtgatgacggggatggcccctaccgcgcgggccacagtttgcgcaagctcgttcgcaccgcccaaatgccccgacaaaagcgggacggcaaagcgccccgcctcgtcaatcaccacaaccgcggaatcggttgccttcgaagcgacatgcggcgcgatcgcccgcacggcgatgcccgccgcgcccacgaacagaagcgcgtccgacgcttcccacgcgagcgccgtccatgcgcgcaggtcggccttcccctcgccgaacccgcgcgaaacggaaacgtcccagccagggtcgtcttcacctgtctgtgcgcaatcggaaagcgcgtgtgcggtgcgcaccgccaacgcataccccctctcagtgaacgctatgcaggaaaccctcatctagcgcaccaccatcgtcgagaagtagctgccccgatcgggcacatcgtcgagcgagcggtacacgcgctcgcccggaagcccacagtcctctacaagctcggcaccgtcgaaggcaccctcctcgcaaaggaagcgcttcgtgtccgcaagcgagcggcgcgccttcatgaccaccttcgtccccggccagccgattgcacggcgcaccccgtacagaacgcctttactcatacgtcgcccccaatttcccgataactgcatcggcgcccgacgtgcggaaaagctcgcggcgctcggcgtcgaacacgaccgcggcgatgtcgcatgcgcccgccgcgcggcggcgcaacctgtcctcgattgccgcagcgagcgaggcgcgcgcagcgtcccccacgccggcggcctcgattacctcgagcgccgccgtggtcgtgaccgacgacaggatctcacgcacggtcttcgcgcccgcgccggccaaggccgcgtgggcggccagaatctccgcgcggcagtcggcggtacgcgaatgggtgtccatgatgccgcccgcgaccttcaccaacttgccgatgtgtcccacaagaaggacattagtaaatccctcgcgaacgcagcaatcaatcgcatcgcccacaaagttggagataaagaccaccggcgcaccgtttaggtggaaatgccccgagatgaactgcccgccgtagttgccgggcgtgagcacgactccgcgccgccccatagccgcatgctgccgaatctcgagctcgatgctgtcgcgcaaagcagcgaggctgcgcggctcgacgatgcccgtcgtgcccaggatggagatgccgtcctttatccccaggtgcgggttgaaggtcttttcggcaagggcaacaccctcgggtaccgaaatcgtcacagcaatatttccagaaaagccgtgcgcggcgcacacctcgcgcaccgccgaagtgatcatcgcgcgcggcgtcgcgttgatggcggccgcccccaccggctgctcgagcccgggcaacatcacgcgccccacgcccacgccgccatcgacggaaacttccgattcgcgcgcgggcacgcccttgctgcccgcagcgcccgcgcccgagcccgcatgttccacgcgcgcgtacacgagcacgccgtcggtcacatcggcatcgtcgcctgcgtcctttcgcacggcgcactgggcgcacccctcgccgatgcatgcgtcgaccacgtccacctcgacgggcagcccgccgggggtgacgatcgacacgcggccgacgggctttcgcgacaagagcatctcgcaggccgccttcgccgcgagcgcggcgcagctccccgtggtgtagccgcagcgcaggcgggtcgtcccggtatatatgtagtgctcgaaggccacgctagctgctcgccttccgataccccgtggcaaacgaagggtcataaagcttgctgcgctcgtaggactccgcttgcgcgccgtcgtgcgcaagtccgccgcgagctccgagcacgcggcccaccaccacgagcgccgtgcggtcgatgccctctcgcgcgcccgcatcggcgagcgtgcccactgtgcatcgcaccacgcgctcctcaggccaggtcgccttgtacacgagcgccgccggctcattggagctgcggcccgcggccaaaagctcggcggaaagctcggcgagcatacccgagctcaggaagatgaccatagtcgagccgctttccgccatggtgcgcatgccctcgcccgcgggcatgggggtgcgtccggaaagccgcgtgatcacgaccgactggctgattcccggcagcgtgtattcctggcgaagcgccgccgcggcaccgcaaaagctcgacacgccgggcaccacctcgtagtccacgccgcgcgcgtcgagcgcgtccatctgctcctggatggcgccgtacaggcacgggtcgcccgtgtgcaggcgcaccacttcctcgccccgtgcatccgccgcgcacatcacgacgagcacttcctccaaggtcatgtgcgcgctgtcgtagacgacgcaggattccttgcactcggcgagcagctcggggttcacaaggctccccgcccaaacgaccacgtcggccgcgcgcagaaggcgcgccccgcgcagcgtgataaggtcggcggcgcccgagcctgcgccaacgatatgaatcatccgagccttcccttcccgtttctcatcgcaaccgtttacgccgccattcgcgcagcggacaaaacacggcgcctgcggcggcaatcggcgcaaatacgcaggcaggaggcgcaatgccgcccgccctgactttgacacgttcacaagtgccctctatcatagtaaaagtttcggcaacgagcatatgacaatcggataaaaggaaatgaccggcgcggcgcccgcacagcccgcgctggcttgcggagggaaccaggtgggaatcctgggcaagggacattactgtgtaggacgcgcaggcgaaccgtctcgcgccccaagccagactgcttcgccttttcctcacggcatcgccgtggcgttagctccttgtgaaccccgaggggcgcgcttttctttcgcttgtgccgacaagcaactgtcgccgggggaccggcaaaccgaggaaaggaaaaaccatgtccgaccagatgtcacgccgcggcttcatgggcgccgcagcaaccggagccttcgcgctcgccggagtcgcgctcgcgggctgctccagcacctccgcgagttccgagaaatcgagcgaaaaggagaaggccgtgaagccggtcatcctcgtcacgagcttcggcacgagctacaacgactcgcgccacatcaccatcggcgccatcgaagacgctatccgcgagaagtactggcaggactacgacatccgccgcgccttcaccgcgcagatcatcatcgacaagctgaagaagcgcgacggcatcacgatcgacaacatgaccgaggcgctcgaccgctgcgtggaagacggcgtgaaggaaattgtcgtgcagccgacgcatctcatggctggcctggaatacgccgacgtgaaagacgagctcgacaagtacgccgacaagttcgacaagatctcgctcggcgacccgctgctcacctccgacgacgactacaagaaggtggccgcagccattaaggagaacatggcgtccttcgacgacggcaagacggcgctgtgcctcatgggccacggcaccgaagccgattccaacgccgactatgccaagatgcaggaagtgtttaagaacgagggcttgacgcagttcttcgtcggcaccgtcgaggctgagccgacctgtgaggatgttatcgccgccgcgagcgccgcagggtacaagaaggccgtgctcgcgccgttcatggtggtcgcgggcgaccacgcgaacaacgacatggcagacgagaccgaccccgacagctgggctgcaaagttcgtggccgctggcttcgaagtgacgtgcctgctccagggtctgggacagaacgccgcggtcgacgacatctacgtctcgcacgtggacgacgccatcgccaagctgtaaactcgccgcgcacgggggcgccggtcgcgtccccgtgcaacgggcatgcgccttccccgaccgacggcgcatgcccgttgcattcgcatcccgcccgcccaccgcacggcgcgggcggtcgaagcgattgaaaggaaccccctccatgttgaagaaaaccctcgccttcgccctgtcggcggcgcttttcgcgttctcgctcgccggctgcggcggaaattcaatcgacagcgcaaaggcaagcgatgccgattcccaggaaaagaccgaacaggcggccgatgcgcccgagggcgcaagcgctgcccccatcaccgccgacaaggtggccgacggcacctatccgatcaccgtagattccagctcgaacatgttcaggattgtggacgcccagctcatcgtggaaaacggctccatgcactgcgtgatgacactttccggcacgggctacggcaagctcttcatgggcacgagtgacgaggctgccgccgcgagcgaggccgacttcatcccctatgtggaaaacgcggaaggcaagtacacctacgacgtgcccgttgaagcgctcgacgaggacaccgcctgcgccgcgtggagtattagaaaagagcagtggtacgaccgcacgctcgtgttcgaatccgccggcgtcgatctgcgcgccgacgcactgaagtaacgccatgcggtcgattcttcccaagggggaaaacagaaagcgccgcagcatcgcggcgcgcgcgatcgcctgcgttctcgtcgccctgctcgcgcttcccttcgcggggtgcagtgcgagcccgaacgcgaccggtgccacgacgggctctcaggaatacactgtgagcgtctcgctttccggcgggtcagggcgcgcaagcatcgcctcaccaaccacaattgtgaaggatggcgacacctacaccgcgaccatcacctggtcgagttcgaactacgacaagatgaccgtcgacggcgtggactacgcgcccataaacgacggcggcaactccacgttcgagatacccgtcacgctcgacgaggacatcgccgtgtcggccgagaccgtcgccatgtcgacgccgcacaccatcgactacacgatccacttcgactcatccaccatgaaggagaaatcgggcgacgaagcaagcggcggctcccctgcgggaacggcttcaagcgccgcggccgacttccacaacgccgatttgggctgcggctggaagccgacggggacgcttcagcttgaatacgccgaacacttcactgtcgacgagttcgaaggcggcctgcggcttatctgcatttcgaacggggagcgcttcctcgtggtgccgcaagatgcgaaggtacctgatgggttgagctccgacatcgcggtcataaggcgccccgccgacaaggtgtacctcgtgtcgtcggcgacgatgtgcctggtcgacgcgctcgatgcgaacgacaatatcatcatgtcgggcacgaaggccgacgattgctcggtcgcgggcttcaaaagcgcactcgaaagtggggcgatcgcctacggcggcaagtacagcgagcccgactacgagcgaatatcggcctcgggctgcacgctcgccatcgagaacaccatgatcaaccacacgcccgatgtgaaggaaaagctgcagaagctcgggctcgtcgtgctcaccgaacagtcgtcgagcgagcccgaagcactcgggcgcgtcgagtggattaagcttttcggcgtcctgttcgacaaggaagacgaggccgcgcacctgttcaacgagcagaagacccgcgtcgagcaaacgtcggggctcgcgtcgtcaggtaaaaccgtggcgtatttctacattaactcgaacggggccgccgtcacgcggcgggcgggcgactacgtggcgcagatgatcgagcttgcaggcggcagctacgcgctcgatgacgcgcagacggcgtcgacgtcaggttcatcagtaacgctcgaaatggagcgcttctacgcgacggcgaaggatgccgacatcatcatctacaacggcaccatcgacgaatcggttgccaccttgaacgacttcgtaggcaaaaacgcgctattgtcgcagttcaaagccgtgaagaacggcaacgtctgggtcacaagcgccgacatgtaccagcagatgacttctaccgccgacattatcgacgagctgcacggggcgttcaccggcgatgacgcgagcgacttccattatctgagaaagctcggctagcgccatgagaagccggctttccatggcatacgacgaatcggggcgcgccgcgcggtgtcgcgtcgtgacggcgctgctcgctgttgccctcatcgtgctcgtcggggccaacctgtgcatcgggagcgtgctcgtgcccgcagaccacatccccggcatcctttcgggcggcgcggccaattccatggaaagccaagtcatctgggagattcgcctcccgcgcgtgctttcagccgtgcttctcggcggggcactttcgctctccgggttcctgctgcagacgtttttcaacaaccccatcgccgacccgttcatcttgggcgtctcctcgggcgcaaagttcgtcgtcgcgcttacgatgattgtacttctgggcgcgaaccaggccatgtcctccccggccatggtggccgcagcgtttctgggctcgcttatcaccatcagcttcgtgctcctcatcgcacggcgcataagttccatggccatgctcatcgtggcaggcgtcatggtgggatacatctgctcagcggcgacgaacttcctcatcgccttcgccgacgaccagtccatcgtgaacctgcacaactggtctttgggtagcttctcgggttcgagctgggacgacgtcgcggtcatcgcggtcgtggtgatcaccgtgaacgcatgcgtattcgcgatatcgaagcccctttccgccttccagctgggagaagcctacgcgaaaagcgtcggcgtgaacgtcgcacgcttccgcgtggtgctcgtccttctagcgagcatgctctccgcctgcgtgaccgctttcgctggtccggtgtcgttcgtaggcatcgcagttccgcatctcgtgaagtcggcgctgaagtcgtcgaagcccatccgcgtgattcctgcgtgcttcttgggaggcgccatcttctgcgcgggctgcgatttgatcgcgcgcacgctgttctctcccgtcgagctttccatcagcgccgtcaccgccatcttcggcgcgccggtggttatcgcgctcatgttgaagaaacgagtgaggtagatgggggaattcatgccgcggcccaaaacgctcggagggggcattccatgcttagacagtcctgagctcgcgcgaaagcgccagaaggcactttcggctcgtgcgggactgcgcgcggaacgcctcctccgagcggagtcgaacctcgaaaccccggtcgaaacgcaggctgacggagcaccgcttttccgcataagcgacctgtcggcgggctacgacaagaaggtcgtagtcgaaggcgtcgatctggaggttcgcgcgggcgacgtcgtggcgctcatcgggccgaacggctcgggcaagtcgaccatcttgaaaaccatcacacgccatctggcaccgcttgccggcgcggtcgagctcgacgggcgggagatttcccgatggaagacggcggagttcgcaaggaaccttgccgttatgctgacagatcgcccccggaccgagctcctcacctgccgcgatatcgtagaggcaggaaggcatccctacaccgggcgaatgggcacactcttgcccgacgaccatagtcgggtcgacgaggccatgaaaaccgcacatgtggaagagctcgccgagcgcgacttcatgcagataagcgacgggcaacgccagcgcgtcatgctcgcacgcgccatcgcgcaggatccgcgtgtgctcgtgctcgacgagcccacatcgtatctcgatatccgctaccagatcgacctgctgcgaatacttcgccaccttgcgaaatcgcagaatgtggctgtcatcatgtccatccacgaactcgagctcgcgcagaaaagcgccgacaaggtgatttgcgtgaaggacggtcgggtcttccgcgccggcgcacccgaggacatattcacgcgcgagacgattggcgagctctacggccttcaacatggcaccttcaacgagcgcttcggcagcgtggaaattgggcgcccgcacggcgatgcgcacacgttcgtcatcgccggcgcgggtacggggtcggctgtgtttcgccagctcatccggcagggcaaggcgttctacgcgggcgttctgcacgaaggggacatcgactgtgagctcgcgcgcgacctggcggcggaatgcgtggccgagcgcgccttcgagcctatcggggataaaaccatagcccacgccaaagagctcctcgtccactgtgcgcgccttatcgtgtgccccgccgccttcggcaccataaacgcccgcaacgcagagctcgtcgagttcgcacgctcgcatggtatcgaggtcatgcgagcgtgcgaaggcgcatcggaggattcccaattggagtgggaaggataaactggacttttttaaggatcctcaggctacagctcctacgccggcgaggtctccaaggcgccggagaacctcgtgaacaggaatttccacgccgacgagcccaactaggcctaatccaagcgagattccagactcgaaaggccgttgagcgtgaggtcgttggcaacctccgagacgcgctcgataggaaccgagccatcagacaatgcccacgtgcgatagataccgataatacccgacagcaaaaacgacagataatagtcgaacatctcgtccttgagaccttgaggcagcagatcgcgctcggcaatctcgtgctcgagcggcgcacgaagacgagccataaaatcatcgagcggaatgttctcgataagttgacgattaagcaccaagttgttgcacagtgcctcgttaacggttttaaagaaggtcgccgccgcgccaagagcgcgctcgttggtgtcgccgtccattgaagcaagcgttttctcgaccgagtcgacaatcatctccaccacatcgacggcaatggcatcgagcaggccgtcaaccgtaccaaagtgaacgtaaaaggtcttgcggtcgacattggcctcgcgcgcaatagcactcaccgtaatgtctgccagcggcttttccatgagcaggcgctcgaaagccgaaaggatggcattacggctgcgaacgatgcgacgatcaagacgcggtttgctggttgccatgggcgtgtcccttcgatatgcgagcattcatcaacagatgagagataatctacgtaagaggattatcccccatacagcacaaatatgcctcgcatcatgaagaacgcacgactgccctactgcgacttagggtgcttcttcttattgagtgccgacggagatacgcgaataccgtctcctgtctgacgcacataggccttatgagccggctttgcggtcccagaagccttctgagcgtgcttcttgggatcaacggtaacagcattcgtggggtgcggcttagtgggcgcagagggcgtctgaggcgtgcggccgagcttgcgcatcacgcgatcccagcgcgcatggatgctctcgttgtgggcgctcttaagtcccagcaggggcgcagccaaaatggtaggcgcaataaacgtaatgagacgccacagcagatagccggcggtcgaagccgaaccgaagaaatgacccaagaacaatgcaaagccgccctcagcgccaccagttccaccgggcaagggaaccgcagagcttaacagctggacaaaggcgctcgcggccatgaccgagaaaaagtcgacctcgtggtggccaaaggcaagcatcaggaaatacggaaccagatagaaaaacgcgagctgcagcatggtgataaacacggtgagcagcatggaagaaaaatgtccggccgaaagcttgaacttctcggagaaggagtagatctcgccatcgacaaacgtgcgccaaccctcgatcttagtggccgagacaccaatgcgctcgagccaattgatgatgcaatgggcgacgcgcgtgacggtcttaggcatgagcgcgacggcgaagatgccaagcaagatgcagcagtgtccaccaaagctaaagacgcacagcagcgtcatgtcgccgtagcgttcggcaaaaaacggcatacgggcgagcagcaggatagcgccccaggcgaccaggccaaactggtacacgataaaacgcgtgaattgcgtggcgccggcctcgcccacgttttggcccgccttggtcaggcggtagatctgggcgggagtcgagcccatcatcatgggcgtcaggttgccaaagaagatgccactcgcctcgaccgagatcaggtcgcggatgccgacgggcgaattgggatcgagccagacggcgatcgcataggccacaatgccaaagaacaggtacatgaacatgcaaagacacgcgacaacgagccatgacgcctggacgctcgacatagcggcccagaactgccccatctgcccggttaccaccagatagacgatataacctaccagcacgacgccgataaagatggcgccgcggcgtgcgctcttattgtcatctccgcccgaggcctcaacctcgacctggggcttagacgtatgctgagaggactccgtcatgagactccttctaacagtcaaaatatcttggttattgtacccgtaagggccataggcagaacgcaaagctctggttcaaacgggaattgcagacggttgtttgaaaataaaaaacccggccttccatgggaagcccgggtatcaaatgcgtggtagcccgtaccagattcgaactggtgatctccgccttgagagggcggcgtcggcggaatcggctaaagtgcgatggcgaaattggttgtttttacagtagcgctaacacctggtgaggcccgccccgtaggacgacgtcccctccatcgcgatgcaggccggctccccggccgccgcgatcgccccggcgagcgccgcgtagcccgccgcgtcggcggggaactggcgggacaggaccttgcggcccctccagtccaggacgtacagccagtgcgagtcggcgtgggtgtcgaccccgcagaagaccggcccgcgggcgtcgggtgtcgattcgttttgcatgtctcgctccgttctttccgtgctcgcctggaccgggcagacggcacactgacggggcgcgatagaatgcggctgttcgggtccgcggtatcgctccatgctcctattaggtcatgcggcggtctcggctcgccgcggcccgcgcgggacatgtcaggaaacgagggcagccccatgggcgccagcggaatgtggggtcaccgcgcggtccgcatctgatggtgtcgacgtcaatggtatacgggtgcatcatcgacgtcttcaatacagaagatatcagtgcggaaatgttccggagagaagccccgtcacgcccccggattccctgcgtttacggccttgaggtcggcgggcggagaaggacgtggttgatagggatacgtgtccccttcgctgtttcgcgctttgcgcgaaaggcgcgctactttggaatgggtggggaacgtggttgttgcggcaactggtcccagccataaattacctttggcatacttgcgcgaaagcctgctggtgctacacttgcaattgctgtttcagggcggggtgaaattccccactggcggtaaatcgggcggtgtcaaagggacgccgtggcgcgggcgagatatctgcgtccgagctgatgagtccgcgacccgtgtgtgcgttggttcgcatgccggctgaactggtgagatcccagtaccaacggttagagtccggatgaaagaggcaggtgatcttatgtctgaacagtcgcagcatatccattttgagaacacgaataggtggagcaccaaacagctcgttaccatggcgctgatgtgcgccttgggtgccctgtttatgtacgtgcagctgcccatccttccttcggcgccgtttttgacctacgacccgtcgctggtgccggcgatggtgtgtgggtttgcatatggccccggtgccggtaccgctgttgccgctatggcgatcgttatccatgcgcttaccacgggcgactgggtcggcgcgcttatgaacttggttgccacgatgggctatattctgcccgcggctatcgtctaccagaagatgcatacctataagggtgccatgattggcctggtgctcggcgtctttgccgccacggtgctgtctatggtcgcaaaccttactattggcgtatggttctggtatggctcggtcgatgtgatcgccccgctcatgattcccgccgtgctgccgttcaaccttatcaagaccgtgcttaactcggtattgacgcttgcggtgtataaggcggtctccaacctcatcacgcctaaaaaggaccaggtcaaaggccgcgcatgattgagtgtcggggcgtttccttttgctatgacggtgctgcactggcgctcgatggcatcgatctgaacatcgaggagggggagtttttctgcatcctcggcggcaacgggtcgggcaagtcgacgtttgccaagcatttgaacgcgctgctgcagcccgatgcgggaacggtgtgcgtcaacggcttggacgcgtccgatcccgagctggtctacgacattcgttcgaccgcgggcatggtattccagaatcccgacgaccagcttgtggcgacgcttgtcgaagatgacgttgcgtttggtcccgaaaacttaggggtcgaatcgcccctgatcgcgcagcgcgtgcgcgaggcgctgaaggccgtgggcctggcgggctttgagcgccacgagacccacgcgctctcgggtggacaaaagcagcgcgtggcgcttgccggcgtgctcgctatggagccgcgcgtgctcattttggacgaggcgtcctcgatgctcgatccgcgcgggcgcaagggccttatgaaggcctgtcacgcgctgcacgaacgcggcatgaccatcgtgatgattacgcactttatggaagaggccgctgaggccgatcgcgttgctgtcttccaagcgggccgcgttgccatgctcggtactcccgatgaaatcttgacgcaggcggacgaacttgcacagctcaacttggatatgccggagtcgtgccgtttgggcatggcacttcgtgagaagggtatgcccatttgcgcgaaggtgcgcgaggcggatatggtcgccgatatagcgcaggcttatgccgagcggagtaggacaggcatcgccgggcggcctttcgcatccgatcctcgtattcccgacaacgtctcctctgcaatcgatggcgcagacgcgctggagcccgtcatcgaggtttcgcacctttcgtatagctactcgctgagcgcccgcgagcgtcgccgttggcacaagcgctcagccgtcgagggcgcatcgaacaaacaggctctctggggcaacgaccccagcagtccgtgggcactgcgtgatgtatcgctgacggtgcgtcgtggcgagttcctgggccttgcgggccataccggttcgggtaagtcgacgctggttcagcatctcaacggtctgattcgtccccaggagggttccgtttacgcgttggggctcgacctggtaaataagaaagatgccgccgcggttaaggcaaaggtcggcgtggtgtttcagtatccagagcgtcagctgtttgccgagaccgtggcacaggacgtggcgtttggtccgcataaccttggcttgtcgcaggccgaggttgcccgccgcgttgagtcgtcgctcgcgcgcgtgggcctcgatctggccacggtgggcgacaagagcccctttgagctttcgggcgggcagcagcggcgcgtggcgtttgccggcgtgctcgccatggagcccgaggtcctggtgctcgatgagcccatggcggggctcgatccggcggcgcgcagtgatttcctggagctcatcgatcgacttcaccatgggggcctgaccgtcgtcatggtctcgcacagtatggatgaccttgccaattgctgcgaccgtattgtcgtgatgaacgagggcacggtgtttgccgagggtacgcccgctcaggtttttgcgcatgcggatgagctcaagtcgattggcttgggtgttcccgctgcccagcgcatggcgctggcgcttgcgaaggcagacgtgccgctgcgctttgacggcctctatacggttgagtcgctggcagacgagttggtggacctgcttatcggtcgctcggacggttcttctgacgtctcggacaaagccaaatccgaaacggtcgcgcgagaggagggctgctaatggaggcgttttcgtttggcagctactatcccggcgatagtgcaatccaccgcctggacccgcgaaccaagttgctcttgggctttgtgtttctgatcacgacgctcacggtcagcagcttccgcggactggtcccggtcgcaatcttcgttgtcctgatctataccgtgtcccgggtgccggctcgtctcgtcctgtcatcgatggcgccgctgctggcgattgtcgcggtggtcgcggtgctcaacctgttttccgaccagagcgggcgcattctgtggcagctcggctttttgcagataagcgagggctcgctgcattccgccgcctttatggcgtgccgcctgaccttgatgatggccggtatgagcgctatcacgctcaccacaccgacgctcgacctcaccgcgggctttgagcgcctgctcgcgccgtttgcgcgtgtgggacttcctgcgcacgagctcggcatgatcatgggtatcgcgctgcgctttatgccgcagtttgccaccgagatgaagcagacggccgatgcgcaggcgagccgcggtgcgcgcgtgacgggaggcccgctcggcggcgtgcgtatgctcggcagtgtggcgattccgctgttcacgggcgtgttccgtcatgccgaaacgctgtctgccgccatggatgcccgttgctatcatggcgagcagggccgcacacgtctgcatgcgcttgcatttggccgcggcgacgcgttggcggcggtggtgacggcgttgctgctcatctgcgtcattgtcatcaatcttcaacttgtttaggcgcgattcgagcgcaggaaaggggtccctatgaccgacaacgatcgcacggcgcagctcgagcgcgcctgttcgtatcttaggcgtattccggcgtggtatctcgccacgatcgacgtgacggacggacatcagccgcgcgtgaggccgttctcgtttgccatggtcgatgatggcaagctgtggttttgcacctcgcgcgataaggacgtgtgggccgagctcagcgcgaaccccaagtttgaggtttcgggttggaaaccgggggagtgttggattgtgctgaccggcgaggccgcgctcgaggacgacgcggtcgtgagcgaccgggtgcgccaagccggctttaagcacatggtgggcatcggcgagaatcacgagagcgccaacgacggccgccttgcgtttttctcggtgcgcaatatcgccgtccgcttctgtgatatcgacggcagcgaggagcgtctggagctctaatttcccaaattgacttcccattccaaaaagactggtcaggtgacaggaggaaacgtggacggattgaatacggttttggagtatctgacgtcggtgccggcgtggtatttggcgacgagcgttgacggacagccgcatgtgcgtccgttttcgtttgcgcagatccaggacggcaagctgtggtttgtaacggcgcgcaccaaagacgtgtggcaagagttgctgcaaaatcaacgctttgaggccacgagttggtggccgggccatggctggctcatcttgcgcgggcgtgcgggtcttgatgaccaggccgctcccgatatgcgcgaggcaggctggaagcacctggagcgcctaggcgagcactacgagggcgcaggcgatcccacgctcgtcttctttagcgtggaggaacccgaggcctttatctgcaaccatgacgaatgggtgccggtcgagctctaaacgagtctctcagcaagcttcgacaattcaaattctcgcatgtagcgggccccacattgcaacgtcaccgtaaggtgcgctgagcaatatggggcccgtattcatttgtcaattccttcgagtgaatgtgtcgggactgtttcaatgcatgaatatgtaaaagatttgcgtatatatgcatcttttggtgataaagtttcaacccacttcataacgacggctgcgagatacgtattggtgcataactgtgcgggcaaggagtctgatatgtctttaaaggttggaatcgtcggtgcggctggatatgccggcgccgagctcattcgcctcgtgctcggtcatcccgagtttgaacttgttgccattacgtccaacgccgatgtcggccggccgctgtcttcggtctatccgagctttgccggcgtgagcgatctggtttttaccacgcacgacgcccccgagctcaagagctgcgatgcggtttttcttgccgtgccgcacacggctgccatggcacaggtgcccgcgctccttgccgcaggcgtttcctgcttcgatttgtctgccgactaccgtctgagcgatccggccgtgttcgaggcgtggtatgccgccgcgcatacgagccccgagctgctcaagacgcgtgctttcggcctccccgagctgttctgccaggacttagagaccgctgcttccagccatgccgctggcaagtccgtgctggtcgcctgcgccggttgctatcccaccgcaacgagccttgccgccgcgcccgccgtgcgcgctggctgggttgcccagagcggccccgtgatcgttgatgccatcagcggtgtgacgggtgccggcaagtcctgcaacgctcgcacgcatttttgcagcgccgacgagaacttggaggcctacggcgtgggcaagcatcgccacacgcccgagattgagcaaatccttggcctgaccgatcgcgtcgtcttcaccccgcatctggcaccgctcaagcgcggcctgctctccacggtgacgctgccgctcacgccgcaggccatcgactccctggctcttgaggatgtcgtcgactattacaagcagttctacgctggacgcacctttgtgcgcgtgctcgacgccggccagcagcccaagacggcttcggtcgtcggaaccaacgccgcccagattggcctcgcgctcaacaagcgcgcgggcgttctggtggcgacgggcgccatcgacaatctgtgcaagggtgcagcaggccaggcggtccagtgcgccaacatcgtctttggttttgacgagcgacgaggcttgcccacagtggcgtgcccggtgtagcacattcgattgttaacgatttggtagtcgggcatcgagtggggcgccactcttaagctggtctcatgatcacgactggcatggcgcaccaaccgatgtccgttttttgtttgacataaggagtcataaagacgatgaataccgagctgtttgatatcaagattcgcgccgtcgagggtggcgttacggcagcggccggctttaaggccgcaggcatccatgcgggattccggaagaatcccgagcgcttggactatgcgctcgtcgtgcccgataaaccctgtcccggtgccggcgtgtttaccaccaatcgcttttgcgcggcgcccgtgcaggtgagccgtgccaacctgggtggtgccgacaagggctacggaatcatcgccggcgtttcggtcaactctggcaatgccaacgccgccacgggtgagaccggccttgcatgcgcgcgcgagacgtgcagcatcgcatcgcaggtcatcggctgcgagccccagcagattctggttgcctccacgggtgtgattggccagattctgccgatcgacacgtttgagactgccattcctgctgcctacgaggcgctctctgcccacggtggcgccgatgccgctcgcgccatcatgacaaccgacacgcactccaaggagtatgctgtgtgttaccgcagcgaggccgcggggcacgcaggtaatgcctatacggtgggcggtatgtgcaagggctcgggcatgatcatgcccaacatggccaccatgatcgcagtcatcactaccgatgcccccgtcgagccggcggcgcttcacgccctgttactctccaccgtcaagcagaccttcaacaaggtaacggtcgactccgacacctcgaccaacgacacctgcatcatgcttgcttccggcgctgccgcagatgccgagcctattgtcgagggctctgacgccttcgacgagctggcctttgccgtgcatgaagtgtgcgagagcctggcgcgcaacatcgccgcagatggcgagggcgcatccaagctcgtgacggttaacgtaaccggcgccgtaaacgacgaggaggccgatatcgccgcccgtgctgtcgccaactcgccgctcgtcaagacctgcatcgccggccacgactgcaactggggccgcgttgccatggcgctcggcaagtgcggcgtgcagtttaaccaagaagatgtgtccatcgacatgatgggtatgcccgtctgtcgcgatggcctgacggtccccttcgatgaggacgaagccctgcgacgttttgaggcgcccgagattgtgatctcggcagacctgggcgccggggacgcggcgaccaccgtgtggacttgcgacctcacgcacgagtacatctccattaacggcgactaccgttcctagactcccgatgtgccgcgcgccccgctgcaatagcgggcaacgaggtacggcgcgatagctacacgaaagacgaggcagactatgaagttcgcacgcgattgtcgctcgagcgaatccaacgaagttaccgcgcagttgctgttcgaggcgctgccgtggattaagaacctgaccggtaagacggtcgttatcaagtacggcggtgccgccatggtcgacgagcaactgcgtcgtgacgtgatgagcgacatcgtcctgctcaagattattggcatgcgccctgttatcgtgcacggtggcggcaaggccatcaacgaggctctcagccactacgacatccccgtcgagtttaagaacggccagcgcgtgactacgcctgccaccatggatatcgtgcgcgaggtgctgggcggcaaagtcaaccaggagctggtcgcggcgctcaaccaccacggcaacctggccgtgggcgtgtccggcagcgacgccggtacccttatcgccgagccactcgatccagagctcggacgcgtaggcaaggtcacgcacgtcaacaccgactatatcgagcgtttgctcgacagtgagtacattcccgttatcgccacggtcgcggcgggggaggacggtggcttcttcaacatcaacgccgataccgccgccggtgccgttgcggcggcgcttcatgcgcataaggcgatttttttgaccgatgtcgacggtctgtacaaggactttagcgacaaggattcgcttatctccaacctgacgctcgacgaggtcaatgagatgctctacggcggcgaggtcgacaagggcatgatccccaagctgcgcgccgccgtcgatgcgcttaccgccggtgtgttccgcgcacacatcatcaacggcaccacgccgcattcgctgctcttggagctgctgaccgatgccggcgtcggtactgtgatccactccaccgagacggcctacgagttcgatacgcatccgcacccgctttcgacgtttgcggcgcgcctgaccgagaacctcgacgaggtcgagaagctccagacggtctagctgacccgcggtcgtcgcgtccctgcacccatagccctgcgccgtacggcgcccaacgaaaggcatcccatgtcacttgcaactcaacaatcgctcgaatcccattacgttatgcatacttttggtcgttctccggtagagtttgtcgaaggccacggcatgaagctcatcggtgacgatggtcgtgagtatctcgactttctcgctggtattggcgtgtgtagcctaggccacggtaatcctgcagtgctttcggcgctcgaggctcagaccaaaaagcttctgcacgtgtctaactacttctacatcgagcagcgtggacaggtcgcggcgctgctgtccaagcttgccaacgacgacgtagatggtgcgtgcgttctggccgatgccattgccgccggcgatgagaccacggccgctgcgctcggtgccccggctgcggacgagcaggtgtgggagacgttctttgccaactccggcgccgaagccaacgagggctcgatgaagctcgcgcgcctgtacgccaagcgtgccggtaacggcggcaacaccatcgtatgcatgcgcggcggcttccacggtcgtacgctcgagaccattgccgccaccatgcaggattggctacaggacagcttccgtccgctgccgggtggctttgtggcctgcacgcccaacgatgtcgacgaactgcgctcgatctttaagcagctgggaagcgaggtctgcgccgtcatgctcgagccgattcagggcgagagcggtgtgcaccccatgactgaggagtttatggcggcggcgcgcgacttggcgcacgaggtgggcgccgttcttatcgccgacgaggtccagtgtggcatcttccgctccggcaagccgtttgcattccagacctatggcgtggagcccgacattatgagccttgccaaggggattgccgatggcgtgcccatgggtgccgtggtggcaaagaaggagatcgccgatgtgtttaagccgggcgaccacggctcgacctttggcggtagctgcttggccgtcgcggcgtgcgccgcgacgctctccgcgcttgtgcgcggcgattacgctgagcatgccgccaaggtgggtgcttatatggagcaggcgctggccaagcttccgcacgtggttgaggtacgcggtcgcggcttaatgctcggctgcgatttggatgacgctgcgggcgatgcacatgatattgttgcccgcgcgctggccgctggcgccgtgattaacgcgaccggagctcatacgctgcgtttcctgccgccgcttatctgcgaggaagccgacgtggacagcctgatcgagattttgtcggacgttttggcctaacacagcgcgcttcgctcctcgcgtgctgcgctggaaaacgcttacgcgtttcctcagctccgcacccttgcgggttcgaatcccatgaaatgggcccaaacaaaaacggtcctctttcgaggaccgtttccaattcagtggtgggcgatgagggattcgaacccccagccttgtgcgtgtaaagcacctgcgctaaccgttgcgccaatcgcccgcagggattgagtatagcggaaaccccgtgctgttcaccgctaattcataacgaaacttacgcggcgacttcggcgacttcggcgcccttgtcctcgtcgataaagaagcgcttgtaccagatgaggaacgtcagcgcggtatagatcttgcgctggttgagcgcgcggccctcaaagtgatcgtcaagcagtttcatgagcgcatcggtgtcaaagaaatcagcagcccacggtgcggtgaagtattcctttacgtagtcgtagtacttttgctcgcgcagccagaacttgaccggtacggggaagcccaccttcttgcgcgttgcccactcgtcgggcagcgtgcggttggcagcgtgacgcagaacgagcttgcagccttcttcgttaacacggtagttggcaggaatgtgctcggcaaactccatgaccttcttgtccaggaacgggacgcgaagctccagagaatgcgccatgcacatcttgtctgccttgagcaggatatcgcccggtagccacatgttcatatccagatactgtttcttggaaagctcgcagcagttgggaacctgcttgtagtactcggcgcacatctcggcggcgttcttgccggtgtcataagcgggcttgagcacctcgtcgacctcggagggatcgaacacctttgcctgacccacataccagcgctcgggaacctcggcgcatttcgtcaggaagttgtggcccttaaagtaggggagatgctgaacgagcgagcccagggcgcgacgtacgccgagcggcacgcgcttcttaaaggagcgcatctcgggggtgtcctcgtaccactcgtagccggcaaacagctcgtcggcgccctcgcccgaaaggacgacggtgacctcctcggaagccatctgcgccagatagtacagcggcacgctggacaggttcgattgcggctcgtccatgtgatactggatatcgggcagtgcatcgaagaactcgtcggcggtaatcatcttgcgcacgttcttgatgcccagcttgtcggaaagctcagcagcgtagttggtctcgttgaagttcttgtaatcaaagccgacagaatacgtggtgtcgggcataagacaggcggcaatgtagctggagtccacgccgccagaaagaaacgagcccaccttaacatcggcaattcggtgtgcagcgacgctttcgtgcacgaccttgtcgcactcgtccacgtactcctcgaaggtcttggagttgtcgtcggtgaagtcacagctccagtaacgcttgatgtccatggtgttggtcgtcaggtcatacgtaaagcaatgcgccggagcaagcttgaacacgcccttaaagaaggtctcctccgtggcggggaattgcagcgtcaggtaggggcgcagcgcgtcgtggttgacggccttctcaaacttgggatggtccaggaagctcttgatctcggagccaaacagcagcgagccatcggatgcctggtagtaatagaacggcttgataccaaagatgtcacgagcgccaaagagtttgttcttgttctggtcgtgaatcacgaacgcgtacatgccgcgcaggcggttgaccaggtcctcgccccactcctcgtaaccgtgtaccaggacctcggtatcagcgttgcagtggaaggcgtagccggctgcctccagctcggcgcgaagctcctggaaattgtagatctctccgttgaagacaatcgtgaccttgccgtcgtcgctcgacatgggctgagctccagcttcggaaagatcaagaatcgaaagacgacggaagccaagggcaacgttgttgacgatatgctggccgcccatatcgggaccacggtggatgatgcgattcatcatagccgtgagaaccagctcactctgttcatctgtaccggtaaaaccgacaaaaccgcacatgcaagatcctttctgctgacggctcaggtgtactgccgcaaggattgtggcagctgatgtcaaataatctttactatcatgccaatcttttgtttcgtgatagggcataagcgccgagcgaaccgaaaaaaccacgcccgatcttcagacgaagcgtcgggccgtggttgcgaatgctatgtatgagcggttaacgcttgctgcgctcggcgagacggtgctccaccttggtgacgatgtggatgagcggaatcgtcacgaccagatagtaaagtgcggcgcaaatgtagggcgtaatgttgcccgtggtggccgtgaggtttttggagaacagcatgagctccatgacgccaacgctcgaaagcagtgacgtgtccttgtacagcataacgaactcgctggtcatagtcggtataacgtaacgtacggcttgcgggatcacgatgcgcgacataacttgggaccaagtcatgccaagcgagtaggcagcttccgcttgaccatgcggtacgctctcgatgccggcgcggaaaatctcggcaagataggccgagcagttgatggctaggacgccaacgccgagcggcagattgggcacgttgagaccgatcatagggaacccaaagaacgcaatgcagatctgcaggaagagcggggttccgcgcaggacgttgatgtatgttacggcgatgccgcgcagcatacgactatgactgattttcataaaggcaaacagcaagccgatggggatggcgagcggaaaaccgatagcggtcacggcaagtgctatgccccagcccttaaagagcgagacgattgaggtgacgataatctgcggcttgcagaacatgcccaaaaacgggttggagttccacgcggcaacccaaggctgggcatcgagccaggcgacgatttcttgcaccatggtgctctccgagacgctgatggtggggctctcgggaagatctcgcttgtcgccgacggcgacatagctgccggtgacggcataggcacccgcgttgctcgggaatacgacgtcggggacgacaacgcgaatctgtgagccggcggcgacgggatcggcgaacttaatgacgagctttgagccgtccagcgagcacgatgccttgacacccgtctggttcagcccgtcgagcagcgtgaccttaacatcggtgctttcaaatgacccgccctcgggcaactcaagctcaatttgcgaaacgtcgccctcgtcgctacccgttgtcgcttcccaggtcaggcgggttgcgatgccgccgagcacgccgttgccgccgtcttcgtttgacttggcggtcgccgaggtgacggcgagtgaagtgcccgtcgcgtcgtctgagctcgaggcatcctcgttatcggacccgctcgtgggtgccatgccaaaccacttctcgtacagtttgtcataggcgccggagctcttgatcttggcgagggcatcgttgatggcctgtgtcagctcggggttgtctttagagacggcaatgccaaactgctcgcccgtcggaacctctttgatgatctccataccggtaaaggagttcgaaaccatccactgctcaacgggcagatcgcatacgaccgcctggcactgaccactcatgacggcggtgaaggctgccgtccagtcgtcaaagttgacggtggttgcctgcggcaggttttcgattgcccactcctcggacgtggtacccgactgcacggcaattttgacgcccggtgcgttgaggctatcgaccgtgtcgtatccagtgttctttgcaactgcgacgccctggttggagtcgatatagggatcggtgaagtcgacctcttccttgcgctcgtcggtaatcgtgatgttacatgcgccgacatcggtctttacaccctgcttgaccatggggataatgccgtcgaacttttgcgccggcaagtagttgagctccagaccgagttcgtctgcgatcatgcccatgagttcataggtaaagccctggtcttcgccggaatcgttgacgtattcaaacgggggcgtggccaagtcacttgcgacggtgagcttgccattctcgacgagtgtgtaggtgctcgaggcgttctgggaggacgaacagccgctcgcgccgatgatggtggcaagggccacaatgaccgtcgcgaaggcgcagacgatgtgccgggtcaactggacacgtgtcgagtggtggcgacgttcgaagtgtcgtttcatctggaatcctttgctttggcatgatgggtcggcattgcgggtcaatgaggcacatcaagacatttggataaagaatagcacccagatttccttgtttttacgcggggcgaacactgttgtcatttattaatccacggcacagtccatgcaattttttagaaggctgcagtgcgcgcaaggtcaggtggcatattaggatggttgataatacagaatgtttcatcgtttctgccgcgggacgtcttttgccctttaaggctgaatttagcgagagaggtctttgtatgtcgagtccgacacaagagaagctaactctgatgcgctatatagagttgctcgaggaagatgaccttgttgtttccagaccgagcgcttcgtgcgaccagcgcattgagtttgcgactgatgactcgcgccaggtgcgtccgggcacgttgttcgtctgcaagggccgtgcgtttaagcgcgagtacctgctttcggcaatcgccgatggcgccgtggcctacgtttccgaggtcgattacgatgttgatcttcccgcggtgattgtgagtgatattcgtcgcacgctcgccgtggtggcagatgccttttatgggcacccgtcgggtaaggtgaaggtctgcgcctttacaggcaccaagggcaagtcgacctgcagcttttatctgcgcggcattctcgccaacgaggccaagcttacgggctgtcatcggcccgctcttaatacgggcattgagttcgacgacggcatcgaggcaggcccttccaaactgacaacccccgaatccttcctgctgcagtctcgcattgcgcatgctgcggaggcgggtgccccgtggctggttatggaggcatcgagccagggcctcaaatacgagcgcacgggcaagatcgcctttgaagtcggcgcctttaccaatatcggcgaggatcacatctcgccgattgagcatccgacgctcgaggattactttgccagcaagctcaaaatcttctcgcagagccgttttgccgtggtcaatctcgatatggataaggtcgatcgtgtgctcgaggcggcatctcgttgcgaacgtgcggtgacgttctccctgaccgacgagcgtgccgacgtgcttgcgctggcgattcgtaatgacgactgcggcgtggtggcaacggtgcgcacgccccgctttacgcgcgacattgtgattcccacgccggttaagttcaatgtctccaatgcgcttgccgctattgcctgcgccgaggccctgggcatttccgaagagggtatcgtctacggctttgagggcgtcttcgttcccggccgcatggagctctatccgtccgtatcgggcaaaatcctgggaatcgtcgattttgcacataacggcatgagcctcgagacgctcctgcgtgacttgcgcgagaactatcccgagcgtgagctggcggttgtatttggcgctacgggcggtaagggtgtcgatcggcgcaccacaatgggtatcgccgctggcaagtatgccgaccgaatcgtgattaccgaggatgaccccggccccgaggatgtcgaggatatttgcgctgagatcgcgcgcaacgttcaagcgcagggaaatgataactggcaaatcgtgactgatcgcgttgccgctatcgagactgccgtgcgcgaaaccgtccgtcctgccgtggtcatcgtgaccggtaagggcgaggaagagcgtatgctgtgcaagaacggacccgagccttgtgagcgcgacggttcgattctcaagcgcacccttgcggcgtacgacgcctaagaccagaagccccttctacgtaatggagtgaccatgtcccacaataccctgccgaccgtcgctgagctttcgggcgagatgcgcgagcgtcttgccaaggttaagtacgtctttaccgacctggacgccacgatgctcgcacccggctcgtgcgtgctgcgcgacaacgacggcaacccctcgaccaagctcgtcgaggctgtcgtggcacttgcccgcgccggcatccaggtggttcccacctcgggccgcaaccgtaccatgatccacgaggatgcgcgcgtgctcggcctcaactcctacatcggcgagatgggtggtctggtcatgtacgacctcaaggccaacgattgggagtacctgaccggcgatatgccctacgaccccgcctgcggcctcacgccgcatcaggtgatcgagcaaaccggcgtgtgcgagaagattctcgcccgctggccgcataagatcgagtaccacaacgacatgtcgactggctacaagtaccgcgaggtcaccgtcggcatgcgcggtgatgtgcccgacgacgaggtccaggccattcttgacgaggccggctgcggcctggtctgggcctgcaacggtcacctgacccatctgtccaaaccgacgacgctcgagctcgaacgcgtcgaggatggccgcgcgtttaacatcaatcccgccggtctcaacaagggcgtcgctatcgcacgtttctgcgagcaccttggtatcgagcgcgaggagacgctggcgctcggcgattccgagtccgacttctacatggctgaccacgtgggcacgttctgtctggtcgagaacggtttgaccagcgccggcgcgcccgagttcctggatgcttgcgataacgcctacgtcacgcgcggcaagattgtcgacggctgggcggcaacggcagagctgctcgtcgcggctcgttcgtagtgcggtcctatcgcgctgagccatatcttttcgagagagaatctggtgaggtcatgtccgatattgagaatctggctggcgacacacgccccattggcgtattcgactcgggtctaggcggtctgacggttgcgcgcgcgattgcgacggcgttgccgcacgagtccgtctactacttcggcgacaccaagcgctgcccctacggcacccgcaccgaggacgaggtgcgctcgtttgcgctgcaggcgggccgttggctgtcgaagcacgacgtcaagatcatggtcatcgcctgcaatacggcgaccgctgcggccttgcgtttggcccagcaggtgctcgacgtccccgtcatcggtgtgattgcaccgggcgcacgcgcggcaatcaacagcacccgcacgcgccgggtgggcgtgctcgccaccaacctcaccattcgctcaggcgcttacacgcgtgccattcaggacctggatgccggcgtcgacgtatacggctgccctgcctcgagctttgtcgaggtcgttgagcacgagctcgcctcgggcgcacatctgcaagagcagtggctcgagaacgaggacatctttgatacgcctgccgtacgcgcgctggtcggtgccacggttgaaccgctgcgcgaccacggcatcgataccgtggtgctcggctgcacgcattttccgctgctcgtggggcctattcgccatgcgctgggtcccggagtgcgcgtggtgagctccgccgaggagaccacgcgtgagttgaccgatattctcacgcgccgcgagcagctggcgggcgacgcagccgagccgcagcatcgttttgcaacgacggccgataacattgccgagtttgcggtggcgggcagttttatctttggccagccgctcaagagcattgagcatatcgatatcgacgaactgaaatagataaaaggtcaccgaccaaaggctcactttcaccttttgccgaaaggatttttctatggagtatatgcaggtcaatcgcgccaacggccgcgccgccgatgagctgcgccccatcaagcttactcgcggtgtcatgaagcacgcccacggttcgtgcctggccgagtttggcgatacgcgcgtgctgtgcgctgccaccatcgaggagggcgtgccgggctggcgcaagggcgccaaggccggttgggtaacggcggagtacgccatgctgccggcatcgaccggcaagcgctgcaagcgcgagcacgccaaccgcaagggtcgctccatggagattgagcgcctcatcggccgtagcctgcgcaccgtcgtcaacatgaaggcgcttggagagtacaccgtcaccgtcgactgtgacgtgattcaggcagacggcggcacgcgtacggcgagcattaccggcgcctgggtggcgctgcacgatgcccttgccatgtgggtcgaggcgggtaagctcgagcgcattccgctcacgggccaggtcgccgcgatttccatgggcgttgtcgacggcaacaccctgctcgacctggattattccgaggacagtcacgccgaggtcgacatgaaccttgtcgccaccgataccggtgagatgatcgagcttcagggcactggcgagcaggcgcccttcgaccgcaagcgcctcaattccctgctcgatttgggcgacaagggcattgccgagctcatcgagctccagcgccaagctctcgcctagcctgccaaaaagggacaggtttattttggcaggttttatctgcggaaacgccgaagtataagactgccgctgattaagaggaggagaggccgagacctcgtcgtcctcaacacggcattgctatacggacaaggagaccactcatggcacttgagaagatcgacatcgacaccctcgacccggcggcgaccatcgtcgtggcaacgggcaacgcccataagctcaccgagatcgaggccattttgggcaaggttatgcccgaggttcgctttgtggcgctcggccagctgggcgattttgaggaccccgaggaaaacggcacgacgtttttggagaacgccatcatcaaggcccaggctgcggtggaggagacgggccttatggccattgccgacgattcgggcctggtcgtcgacgcgctggacggtgagcccggtgtgtatagcgcgcgctacgcgggcgttcacggcgacgatgccgccaacaatgccaaactgctcgtgaatctggagggcgtggccgacgaggaccgcaccgcgcgctttatgagcgtcgtcgcgttcatcgacacggacggtttggtcacctatggtgagggcacctgcgagggcgttatcgcacacgagggccgcggcgatcacggctttggctacgacccgctgttcctgccggtcgacacgccgggcaagaccatggccgagctgacggcggacgagaagaacgccatcagccatcgattccatgcgctcgagcacctatccgccaaactgacgggcgaggagtaggccgtgcgtgcggtggtgcagcgcgtgctcaacgccggcgtgacggtagacggcgagtgcgtgggcaaaattgggcgcggctatctggtgctactgggcgtgggccacggcgacacgcgcgccgaggccgataagctgtggggcaagctccggggcttgcgcattaacgaggacgagaacggcaagaccaacctggcacttgccgatgtcgacggcgaggttctcgtggtgtcgcagttcacgctgtttgccgattgccgtcacggccgccgcccatcgtttacggatgccggcgcccccgatgtcgccaacgagctctacgagtacttcctgacgcttgtgcgcgaggacgtcgagcacgtagcgcatggcatcttcggtgccgacatgaaggtcgacctcgtcaacgacggcccattcaccatcgtcttggacaccgatagtctgtaagtagtcaatttgggaccgggcttttttagctacttgcgtatggccacaacagagtgctatagtattagagttttgtctatcttaggggtattatcccctttttgaattgcaccttctggaggccctgttcatggaagagatggaagtcaatcacgtcgacgacatccacgagaagctgaccgatatggtgggcgatcgcgttaaggtgaaggccaacatgggccgcacccgcgtcgtcgagcgcatgggcaccatcaagagcgtccatccggcagtctttatcgtcgaggtcgacgagcgccgtggccgcaagtcgcgtcagtcctaccagtatatcgatgtcctcaccggtcaggtcgagctgttcgaccccgagagcggcgagcacatctttaccccgctcggcaatcagctcgaggagcattaacggtgaccgatcggtccctgactctttccgcgccggcaaagattaacctctacctgggggttcataccgagcgcgatgaccgcggctaccacagggtcgattccctgatggcagccgtcggtctttccgataccgtgacggtcacgccggcgcaggcgctgaccgtccagacggttccagcatcagattttcccatgcaaaagaatacggcgtatcgggctgcggttgctatggccgagcattatggtcgcgaggcaaacatctgcgtgacgattgagaagcgcattccattgtgcgccggcttgggcggcccctcgacggatgcggccgcggtcattgtcgccttggcggagctctggggcattgatcgcaccgacccagcgctcgacgatattgcgcgaggcattggtgccgacgtcccgttctttttgcacgtgagccctgcgttctacgtaggtgggggagacgtgctggcaactgagtaccccgcgctgcccgcgacgcccgtcgtgctggtcaagccgcgcgaggcaagtgtttcgacaattgaagcctatcgacgttttgacgaggccccggtgcctgcggacaagctcggcgcgatagcttctgccttgcgtgctggtgatgccgagacggcatatgcgctcatccataacaacctgggtatcatttccgcacagatggagccgcagattcaaacggttctcgattggctgcgtaaacaggacggcaccgttgctgtagatgtgtgcggatcgggtgcctgctcgtttgccatttgcgacaccgccgccacggccgaaaggcttgccgacgctgtccagcaaaatggctggtgggcctgcgcgactgagctcattcccaacacggttcaaatcgacgcgccaaagaaataaaaatttctctagcacgcggcgaaaatctttgttactatagtcgagctaacgggttgtggctcagtttggtagagcactgcgttcgggacgcaggggtcgctggttcaaatccagtcaacccgaccagagcatgaggagggaccgcttcttgcggtccctttttttagctagtgttgtgataccgcgatacccgcggtatactcattcgagcttgtctcgctgtattgtggaggtctacatgtttggactgagggctcctgagctcatcattattctcgtcgttgtcctgattatcttcgggcccaagaacctgccgaagctcggcaagtccctcggctctaccgtcaagaatatccgcgagggtatggagggcgacgataaggccgagaccaagcaggccgaggaggtcgtggtcgagcagtccgaggaggacaaggagatcgctgagctcgaggccaagctcgctgctgccaagaagaagcaggcagaggacagcgacgcggacgcagagtagtcccatccctttggggtgagcacctgaccggcttgcccgcaggctagccggtctttttcgttttgttgacagttgattgtttgatcagagttggggagatatccgtatggacgcaagccagatcgtactgaccgctgagggccgccagaagctcgtcgaggagctcgcttggcgtgagggcgattacgccaaggagatcgtcgaggacatcaaggaagcccgcgcgttcggcgacctttcggagaactccgagtacgacgccgctaaggacaagcaggcccagaacgccgctcgtattgccgagatccaggccatcctcgccaacgctcaggttgctgccaccacgggcgacctgaccgtctccatcggttccaccgtttcgctgattgatcccaacggcgaggtcatggaagtcacgctcgtcggtaccaccgagaccaactcgctcgagcacaagatttccaacgagtctccggtcggtcacgccatcattggtcacggcgagggcgactccgtcgaggtcgttacgccttccggcaagactcgcgtctacaccatcgccaagatcgcacgctagaccacggtcccgcgtaaaggtatgttttcgctccctgggaccgaatcctagggagcgatttagtttgaggagctaacttatggcagagaaccagaacgccgccgatcaggcatcgacgctcaacgacgagcgcgccacccgtctggccaagcgcgccgccctgttcgaggcgggccagaacccctatcctgagcactctgagcttgaggactacgtcgccgatatcgaggctaagtacgccgagcttgccgatggcgaggacaccgaggacgtcgtgaagatcgctggccgtgtggtcgccaagcgcggtcagggcaagatcatgttcatcgtcgtgcgcgatgcgactgccgagattcagctgttctgccgcatcaacgacatggacgaggctgcctggagtacgctcaaggccctcgacctgggcgacatcctgggcgtgaccggcgtggtcgtgcgcacccagcgtggccagctttccgttgcccctaagagcgcgaccctgcttgccaaggccgttcgtccgctgcccgagaagttccacggtctttccgataaggagacccgctatcgccagcgctatgtcgacctgatcgccaacgacgacgttcgcgagaccttccgtaagcgttcgcagattctctccaccttccgtcgctttatggagtccgacggctacatggaggtcgagacccccatcctgcagaccatccagggcggcgctactgccaagccgttcatcactcacttcaacgcgctcgatcaggagtgctacctgcgtattgccaccgagctgcacctcaagcgctgcatcgtcggtggttttgagcgcgtgttcgagatcggccgcatcttccgtaacgagggcatggaccttacccacaaccccgagttcaccacgatggaggcctaccgtgccttctccgacctcgagggcatgaaggcgctcgcccagggtgtcattaaggcagctaacaaggccatcggcaaccccgaggtcatcgagtatcagggccagaccatcgacctttctggtgagtgggccagccgtcccatgaccgacatcgtctccgacgtgctcggcaagcaggtcaccatcgacacgccggttgaggagcttgctgccgccgcacgcgagaagggcctggagatcaagcccgagtggaccgccggcaagatcatcgccgagatctatgacgagctgggcgaggacaccatcgtcaaccccaccttcgtgtgcgattaccccatcgaggttagcccgcttgccaagcgctttgaggatgacccgcgcctgacccaccgttttgagctggttattgccggccacgagtacgccaacgcattttccgagctcaacgacccggtcgaccaggccgagcgctttgccgcccagatggccgagaaggccggcggtgacgacgaggccatggagtacgacgaggactacgtgcgcgccctcgagtacggtatgcctcccgcgggcggcatcggcatcggtatcgaccgcgtggtcatgctgctcaccaaccaggcttctatccgcgacgtgctgctgttcccgcacatgaagcccgagaagggtttccagtccggtgccgctgccgccaaggctgccgaggccggcaacgccgcgagcccgttcgttaagtcgcttaagcccacgctcgattactccaagatcgccgttgagccgctgtttgaggagttcgtcgactttgataccttctccaagagcgacttccgcgctgtgaaggtcaaggcatgcgaggccgtcaagaagtccaagaagctgctgaactttacgctcgacgacggcaccgacaccgaccgcaccatcctctccggtattcacgcttattacgagcccgaggacctggttggcaagaccttgctcgccatcaccaacctgcctccgcgcaagatgatgggtattcccagctgcggcatgctgatcagcgctgtccacgaggaggagggcgaggagcgcctcaacctgatccagctcgacgcctccattcccgccggcgcaaagatgtactaattggttccgccgttctaccgaacggcggaccagccgacgctgcgcgacgcccagggcgacaatttgtcattcaaaaggcaaggcatgaccagaaggtctatgccttgcctttttcatgccaacttgttcgccctggacgtcgctcgctgtccgtcctctatctgcggcgttgacttggttgacacttagaacatcgatgtagtcattgggggcgttctcaaacgactacccaacggctattgcgcacatggctcgcatgacagccgtccttttatgtttcctttagccgttgctgcctaggatgggggttagtcggtaggaagggagcgtctatatggacgacgcgagcgagcgttcaatcgaagaggacatgctcgatcagttcaattactttgatgatgaggacgaggagctgatcgaccgtcgcgagccagcgccgcttgattcctttgatctggtcgatgaagagcccgacgaggacgagggcgaattaacggagcccccacagccttcgcgccttgactcgctgctttcgagagcccccatgcatcacggcgttcgtgccggcgcgctccatatgaaaactgactggcaccagatcgtgacggcaggcgatgaacttgccgtcgatgcgccgctcaccgataaatcatccatcatctgccgcaccggcatgcttatgctggcaagcggaacgggtgcctggcgcgtgcgcgataccatgaatcgtgttgctgccgtactgggcgtcacgattcacgtcgacctgagtcttctgtcgtttgagtgcacctgcatcgaagatggccactgctttaacgaggttgtcagcctgcccacaacgggagtcaatacccatcgcatttggatgatggagagtttcctcaaggaaatcgagacctatggtcgtcgcttcacggtacacgagtatcacgagatgctcaggaccgttgagagctcaaagcccgattactctccctggcaacagggccttgcggcagcctgtgcttgcggcgccttcgtctttttgctcggcggcggccctatcgagatggcctgtgcattcgtaggcgctggtgtcggtaactttgctcgctcccatattctcaagcaaggccttggtcagttcagcgcgctgacgaccggtgttgcgctcgcttgcgtttcgtatctgctggcattgctcggccttggccaggtcataccgggggcaatgtcgcaccaagaaggctatatcggcgccatgctctttgtgattcccggctttccgctcattacggcaggcctcgacatcgctaagctcgacatgcgaagcggtatcgagcgcctttcatatgccgtatcgattattgtgatggcgaccctcgtaggttggatggttgccgagtgtgttggcctggcgccggacgactttgccccactgggcctttcgccgcttgcccttacgctcctgcgcgtggtgatgagcttcgttggcgtattcggcttctcggtgatgttcaacagcccggtaaagatggccgcggcagctgggttgatcggcgccgtttccaataccctgcgccttacgctcgtcgatgcgccgacgatgattcccttcctgggcctcagcacgggaatgcctcccgaggcagcagcgtttatcggcgcgctggtatcgggtctgctggcaagcttggccgaagtcaagctcacctacccgcgtatcgctctcacggtgccttcgattgtcattatggtgccgggtttgtatctgtatcgctcgatgtattacatgtgcaccttcgacacagtcaatatgctcggttggtttgtgcgtgcagtgctcatcgtggcgtttttgcccgttggtctgggtgtggcacgtacactcaccgaccctcgctggcgccacaccagctaattggtgcaaaggggacaggttactttgcacccccaatgagttgcggtgaaatagggactgaattgctgcttaaagggtcaaaacagtccgtattccaccgcaacttatggggtcggggggggggattattggtgtcctgcatctccataaactcaacgcttacgaagcgcgcgccgttcgtgttagggtagttccaccacataagtagtcgcagacgcacgtaccacgggcgggcgagatgaagtcccaacagctccatcttgcccgcccgtttttgttgcgtggtgccgcggcgtaacacagaaaggacaatgccctttatgcctatcaacaaacgagagagcctgctgttcacctttatcatgtgcttttgcatggtgctctggatgagcatctacaacgttgccctgcagcatggggccatcaacggcgaggttgttgccgccgcgtggctcggcttccccgttgcctacatttttgccatgtgctgcgactggtttgttgccagcccccttgccaagggtttcgcctttaaattcctggtcacgccgggcaagagttcgccgcttgccatgacgcttgccgtcagctcctgcatggtcgttcccatggtcatcatcatgtcgctgtacggtgcctgtgagggtctgacgcacatgcccggcggcatccttgcgaacctgtattccgtgcccgcgatctggatgatcaacatcccgcataattttgtgatggcgctgccgtggaaccttttggtagccggtccgatttcccgcttcgtcttccgtcgcgccttccctgtggggacggttttcgaggaggagcatgccgagctcttggagcaggctatggctcctgagtgcgagtagctcgcttagggatctgctgagcgcgggcgacttgcttggttggagcccaaagcgtggatagctctctcggcgacatcgcgggcgtgagcggtgcgcatgaccggagggcccgtgctgctccgttgcccgacgtgctagcgcgcagaacaatctgttggtgcattcggcggctgctgaagcgtttcggcagccgctttttatacggagtttaaatacaacagtctgttgtattacgtagagtggtatatctctagcgggaaaaatgcgagagacggagcattatggcgttgctagtaggactggacgtagggtcgacgacgaccaaagtttacgcgatgcacgaggatatgaccgaggcgtggtggggatatcgccgccacggggcgtgtcagacagcgagcgtgcgcgccatgctcggcgagctcgccgagcgctttccccatgagtcactgcgcgttgcggtgaccggctcgggtgcgcgcgatatcgcgaccgcgctgggcgcctcgtacgttcaggaggtggtcgccaacgcgctcgcgatcagcaggttctatccgcagacgcgctgcgccatcgagctgggcggccaagacgccaagatgatcttcttccgcaccaacgataagggagacatcgaggttgccgacatgcgcatgaacggctcgtgcgcaggcggtaccggtgcatttatcgacgagatggcaaagctcatgggggtcggcaccgaatcgggcgagttcgagcagctcgcaagccgggggacgaccgtccacgaggtctcgggccgctgcggcgtgtacgcaaagaccgatatccagccgctgctcaacgagggcattcctaccaccgacctggcgctttcggcgcttcacgcggtcgcccgccaaacgatcggcggtctggcccagggtatcgacatcgagccgccggtaatcttcgagggcggtacgctcgcctacaaccccacactggtccgcgtgttccgggagcaactgaatctatcggacgatcaggttatcgtcccgcgcgatccgcagatcatggtcgcgcgcggtgccgccctgtcgctgaccgacatgttcgcatcgtcccaaccgatcgaccttcccgacgcttttgtccggctggataagctcgagacggtcgcgcccgcaagcggggagggacgtcttgcccagcccttttttgccacacctgccgagcaggcggattttacggcacgccatggcaaagagacgccggcaaagggtccggatgcgtatgcgcccggagagacggtgcgtgtggcgctcggtatcgattcggggagcacgacgaccaagttcgccctggtcgatgaggcgggtgagcttgtcgattcgttctacgcgtctaataacggcagaccgctcgacgtcgcccaacagggtcttgtcagcttgaagaaccgctgggagacagcgggagtcacgcttgcgatcgatgccgtgggcaccacgggatacggcgaggagcttttcgcgcgcgcgttccacgccgactaccatacggtcgagacggtcgcgcacgcccgcgccgcgtgcgcatgcgttcccgatgcgaccttcgtgctcgacatcggcggacaggatatgaaggccatctggctcaaccacggcgtgctgaccgatatcgtcgtcaacgaggcgtgctctgcgggctgcggctcgttcctcgagggttttgccaaaaacctcggaatagccgttgaggatatcgcgaccgaggcattttcgtccaaagcccccgccgttctcggcagccgctgcacggtgttcatgaacagcagcgtcgtttccgagcagcggcgcggtaagggtccgggcgacatcatggccggtctctgccgttcgattatcgagaacgtgttcaccaaggtcattcgcgtttcaaatctcaaccgtctgggcgacaaagtcgtcgtccagggcggcacgttccgaaacgacgcggtgctgcgcgcattcgagcagtatctgggcaaacccgtcacgcgtgcgccccacccggggctgatgggcgctatcggtatcgccctgctcgcgcgcgaggaatgccgcaagggcgacgccggcacgtcgtttatcgggctcgatgccgtggagcgcttcgagcatcgcgagttcggcggcgttacctgccgtcggtgcaacaaccgctgccagcgcgcggtcgtggcatttggcgacggctcgctttacgtcacgggcaatcgctgcccgcgcggcggcgccatctcatgggatgagctcgtgcgcgaggttcccgcggcggaggagctgcgtccgcagggtgcttgcgaggcacaggcacccggcacggggcgcgaccggaccgcggctgcccccaatctctttgtcgaccgcgagaagctgctgttcgagtcgtaccccacggtttccgtcagcggggggcgcgatgtcacgatcggcattccccgtgtgctcgagttctgggacaccatgccgttctggtcgacgttcttcagcacgctcggctttaaggtgcgcgtctcgggacgcagcaccaaggcgatgtacgagcgcggtctggcgcacgtcacatccgacaccgtgtgcttcccggccaagctcgtccacgggcacatccgcaatctcgtcgacgccggcgtcgaccgcatcttcatgcccgtcatcacgacggtgcccaccgaaaacaccgcctctaccagcgagtggatgtgcgccgtcgtaaagggatacccctacgtgatgcgcaattccgataacccggaggagcgtttcggcgttccgttcgatacgccgctgttccactggtacgacgagggcgaccgaaaccgccagctcaaggcgtggtgcaaggagaccttcgatatcgatgccgacctggttgccaaggcgaccgagcaggcggaccgcgcgcaggagacgtttgagaaccagctgcagctgcgcggcaggcaggtgctcgagaacgtgcacgaggacggcggctacgcggtggtgatcgcttcgcgcccgtaccacaacgacccgctggtcaaccacgggctgcccaagctcttctctgagcgcggcatccccgtgctgacgcccgatgcggtgccgggggtctgcaacgtcgatctttccaacagccgcatcgacatcgtgaacaactaccatgcgcgcatgctgtcgtgcgcggtcatcgtcgcatcgacgcccgagctcgagctcgtgcagatgggcagcttcggctgcggccacgatgcgtatctcaccgacgagatcgcgcgcatgatgggcgagatgggctccaaggttccgatgatgatcaagctcgatgagagcgacgtcgccggtcccatgggcattcgcgtgcgttcgtttatcgagtcggtcaaccgtcgtcgcgcggaggagcgtgccgagggcgcccgggtgcacgcggtccatccgctcgacgacccgtataaggtcaagtacaccaagcgcgaccggcacgacaagatcgcgctggtccccaacacctcccatgcgttctgcaggctcatgaccgcggcgatgcgcaatcagggcgtgcgcgccgaggcccttgatatcgggcgcgaggatgccatccgcctgggcaaacgctatgtgcacaacgacatctgcttccccgcgcaaatcgtgatcggcgaggcgctcgcggcactcgagagcggtaagtacgacccgcacgacgtcgccgtggtgactggcaagtatatcggcgactgccgcctgacgcactacatgcccctgctgcgccgcgcgctcgacgacgcgggatacgactatgtcccggtgctcaccaacgacgacgtcgatgcccacaatgcgcatccgggcttcaagctcggccttggcccgagcatccagatcgcctacggtcttcccatgatcgatgccctcgaggccatgcttaggcgcatccgtccctacgagctcgagaagggcgcggcggacgctgcgttcgaccgcgcgctcgatgaggttatcgagggcatggagcgctccgggctgagaggccaggcgacgggcttcaaacgcgcgcttgcgatcatggacgccgttccgtacgaccgctcgaacccgcatccgaccgttctcatcgtgggcgagtacctgctcaatttccatctcggcgccaaccacgagatcgagcgctacctcgaggacaacgggctcgaggtcatcgaggcgcgcatgaccgacgtgatccgcaagacctatttctacaagcatgcgcagtcgcgcgagttccacgtcgacctgtcgctgcccgaaaaggcctggtacgccacggcggacaacctgttcgagctcgcgcacgaccgttgcgaccgcctgggcgcggcgagcccgctctacgagccgccgacgcgcatgcccgagctcgtgcgcgcgagcgataagatcctgcaccatacgttcgatgcgggcgagggcgtgctgattccggcggagattctcgagcacgccaagcgcggctgccgcaacttcgtgatcctgcagccgttcgggtgtctgcccaaccatgtcgtggggcgcgggctcatccatgcgctcaaggagcagtatcccacggcgcagttcctgccgctcgactacgatcccgacgtgagcttcgccaacgtggagaaccgtcttcagatgctcatcatgaacgccaaggcgcaggggtgcggtgaggcgcatggcgagaccgcgtaaggacgccgatgcgcccgatgcacgcacccgtatcatcgaggcgttttgggagctcatcgagaacaacagcatcttcgagctgtcggttggcgaggtgacccgcgccgcccagtgcaatcgcggaacgttttactactattttcacgatttcgatgaactcgtcgccatcgccatagcccagctgctgcaggataacgagctcatcaccgatgccctctggcatttttcgagcgagggcgacctttcggcgttcgaccggcgcgacgtccgctgcctgctgcggcgcatcgtcatcaccatgagggcgggtgccgccgagcaggtcgtgcagggcatccatacgatcatcatcgaccgcgtgagagagatcgtccaccccgacggagaagagctcaaggcagattcgagctttgcggtgggctttctggtctcgggcatcatgggctttgtgatggcggtcggctttgcccgggagggcggcgaggagatagacctcgagcagccgggggacagcgcgtgcgcgtacctgagggcggtcgccatgcagacggtggaaacggtcgcgcaagtcgagggcgtcgatacatccgagctgctcgaacgcgtctccaaggaggtcgatgcctatcgcgcatcgcgtgcgacgagtcccgacgtggtgaaagacgcctagggtttctcttgcggggcgcctgtcgcgcatcgcgcggtgagtcccgcgatgcggtcataacctgcattcatgtgagccgggtttatagatattcctccagctgttaacatagacaacctgtgggtaaagagacaaaagcgccgccgacgggcgggcgttttgatttcgatgaactcatgtaaggaaacgagcatgttagatagatttaccgatcgagcgcgcaaggtcatgtcgatggccaaacaggaggcgctcgatctgcactcaaataaggtgggcaccgagcacctgctgctcgcactcgccaaggaggacgagggcatcgctgccgaggcgctgcgctcgcttgatatctcctacgacgacatcatggacaccctcaaggaggtccagaccacggttcccgagcccagcgaggagaccgaggctgccaagcttgcctttacgccgctcgtcattagcgtgatggagcgctccttccgcgtggcacgtgagaacaaccagacctacgtgtcgaccgagcacttgctgattggcatcgtcgaagagggtaacggcatggccatggacatcctcatgcgcctgggtgtgtcgtccgcctccatcaaaaaggctatcgagaaacttaccgccaaggaccaggacaagaagcgtccgctcgccggtgccggtgccgggcgtcccggtgcgggcctgccgttctttagcggctcggacgcgtcgcagcaaaaggggagcggcaccgatacgcttaagcagttcgccaccaaccttacgcagaaggcgcgcgacggcgagctcgaccctgtaattggtcgcgaaaaggaagtccagcgtatgatggagatcctttcgcgtcgcaccaagaacaatccgcttatcttgggcgaccccggcgtgggcaagacggccatcgtcgagggtctggctcagcagattgcagctggcaacgtgcccgagaaccttatgaaccagaacatctggacgctcgacctgccgggcctcgttgcgggcgccaagtatcgcggtgagtttgaggagcgcctcaagaacgtgatccaggaggccaccgaagctgacgacgtcatcctgtttattgacgagatgcacaccatcatcggtgccggctctgccgagggctccatcgacgcgagctccatgctcaagcccgtgctcgcgcgcggtgccttccagattatcggcgccaccacggccgaggaattccgcaagtacctcaccaaggacccggccttcgagcgtcgcttccagaccatcgatgtcgaggagccgagcgtcgaggacacggtcaagatcctgaccgcgctcaagccgcgctacgaggagcaccaccatgtgcgctatacgcagggtgctatcgaggccgccgcgaacctttccaaccgctacatccaggatcgcttcctgcccgataaggccatcgacctcatcgacgaggctggcgcccgcgctcgcatcgccgcgaatcgcgcgcccgagccggtgcgtgaggccgagcatcgcgtggaggagcttaaggccgccgcgcaggaggccaccgagagcgacgacatgaacaaggccgccgagatcaccgagcagcagaaggccgccgagattgagctcgccgaggccaaggccgcctggaccgccgagctcgacgccagcccgctcaccatcgatgtctcccagatcgccgacatcgtgtccgtgacttcgggcgtgccggtgtcttcgcttaccgagagcgagagccgtcgcctgctgcaggccgaaagcgtgctcaagacgcgcatcatcggtcaggatgaggccgtcgaggccgttgccaaggccgtgcgccgcagccgctcgccgctcaaggacccgcgtcgccccggcggcagctttatcttcctgggccccaccggcacgggcaaaaccgagctcgccaagacgctcgccgagtatctctttggcagcaaggacgcgctcatcagcttcgatatgtcggagtttggcagtgagttcgaggtctccaagctcatcggtagccccccgggctatgtgggccacgacgagggcggccagctcaccaaggctgttcgccgtcacccgtactcggtcgtgctgttcgacgagatcgaaaaggcgcaccccgacatcttcaatatcctgctgcaggtgttggaggagggccgtctgaccgatagccagggcaagacggtcgacttccgcaatacggtgatcatcatgacgtcaaacgtgggcgcccgcgagatcgcgcaggatgcgagcgttggctttggcaccaccggcgagcagggcctcacgtcgagtgagatccgcggccgcgcgatgggcgagctcaagcgcctgttccgccccgagttgctcaaccgtatcgacgacattgtggtgttccagaagctctcgggcgagaatcttaccaagatcgcgcacctgctggtggacgacctgcgtcagcgtttgattgccaacggcatgaacatcaagctcaccgatgcggcctatgacaagatcgtggccgagggcaccgacctcaccaacggtgcgcgtccgctgcgccgtgccatccaaaagctcatcgaggacccgctgtccgaggagctgctggccggcgagtggggcgagggcgataccgtcctgtgcgacgtggccgacggcaagttcgtctttagccatggcacaggcgagattccagcgccgcgtccggcaggtgcgctcgggggcgataccgctccggcagcgccgcacaccggaaacgccgcgcctgtgagcagtggcgtgagctcgggccccggcggcatgatgcaagccggttccggcgcgctgtagggcgtggcgacaatttgatctgtgcaatcgaggcgttccggcaagggcgcctcgatttgtagagctgcggtaactgtgaccgttacgctatgcggtccaccgttagccgatgatgcgagagcgctcggcgttttcgactggtttatgcaaacgaagtctgggaatatacaaggcgcatgtcttactgtctaaccagttgcgccaaggaggcaccatggactacaagattaccggctacgagcccgcccagctgttccatttctttgaggaggtcagcgcgatcccccgtgggtctggcaacgagaagggcatcagcgatttcctggttgcgtttgccaaggagcgcggtctcgatgtgtatcaggacgaggtctacaacgtcatcattcgcaagcccgcatctgccggcgccgagaatgccccgaccgtgatgctgcagggccacatcgacatggtgtgcgacaagctgggctccgttgagcacgactttacgactgatggtatcgacctggtcgtcaaggacggcgtcctcaccgctaacggcaccactctgggcgccgacaacggtattgccgtcgctctgatgctcactgtgctcaacgacgattcgattgctcatccggccctcgagtgcgtgttcaccaccgacgaggagactggcctggttggcgccgagacgctcgacaagtcccagattagcgcccgcaccatgattaaccttgactccgaggaagagggcgttgccaccgtcagctgcgccggcggcgtcgtcgttacctacacctgcccgatcgcgcgcgagcacaagaccggtagcaccctcacgctcgacatctccggcctgctgggcggccactccggcagcgatatccacctggagcgcggcaacggcaacctcatcatggcccgcatcatcgaccgcctgatggtcgccggcgagcccgccatcgttagctttaacggcggcaccaaggacaacgccatcaaccgtgagtgcaaagctgttctggtctacgccgaccacgccgccgccgaggccgcggcccagatcgcaaagggcatcatcgccgacgttactgccgagctcgaggtctttgaccccggctttacctgcaccgtcgagattgccgacgacgccgaggtcgaggccatggacgagaagtccgcgcttgccctcatccgtgccctgcgtcttgcccctaacggcgtgattcgccgcaacgtcgccaccgacggctccgtcgaggtttcctccaacatcggtgtggttgccacctctgacgaccaggtcaagatcatgctgtccccgcgctcctcgatcacctcgctgcagaacgagttcaaggaccgcctgcagacgcttgccgatgtcctgggcttcgacgccaagtttgagttcgagtatcccggctggagctatgccgagcattcgccggtccgcgacatctttgtcgagagctatcgcgagctctttggctccgagctgcgcatcgagtccattcacgccggccttgagtgcggcttgtttgccgaggccctgcacggcctggacgccatcgccgtgggtccgacgctctccgatgtccacaccccggacgagagcatggagctcgcttctgccgagcgcttctacgagctgctcatcgacgtgctcaagcgcctcgctgcgtaaaggttgcgctagcagcagtccgagccacgtgctagcggattgcaaatgacattacgagagggggcattcgagcgtttgcgacgggtgcccccctcttttgtttgataattgcgaaattacggtcacctagtccatttctgccctgatgaggtcgagggtgcgctggcagttttcgcggacggggccgagcatatgctcgcgcaggtccgccatgccgggcaggtcggcgtattcgtccatgacctcttccatgcaaatgggtacctcgtaggcgaggtccatcatggtcgcaaagcaaaacttctcggatagcccggcatcggtaagcgccgcctccagcgcgggatcgcccataccgtggtatcggcggatagcgcctggaccgattcgccccacacgattttcgccgccaacgctcatggcgaggcgcgcttttcgccgcatacgttcgtatgctaagcccgatgcgacatcgtacatgggtgcgagcgccgcgtttgtgcctttgcctaggatgagcgagtagtttttagcgtgtgcgtcaggcgctccgataatggcgttatagaacaacatataggtaaaaagcacaagattcatgtggtgggggactgtgttaatcagtcgttcttggatgtctcgtgtagttggtcctccgtcggcggtgtatttctgggttggcaatacaccgagtgcctggcaaaagtcctcctgatgcagcctttcgatatttccgctgctattgaccattctgtcgtaccgttcaacgacgagcgcagcttcgtcttcaaatgtgcaataggagacgttggcagttggaatgccaacacgccgagctgttttcatgcagacgaattcgtttaaggcctgatgtttgaacccaacgacaccatttttgaagatatgggtagtgggggatgaccctagacattcgcaccattgtccatcatgccaagctagtgcaaatttgccttggttgccgcccagggaccagctttcgttggagcccatccatgtctctctttcgtcatcgcgaattgctttgagcttgtgagcgatttgagaattggtaagcgggcggtatgctgagaccctgccgtgggcggcatctaattgatcggctcgacaaaactgaacggcccccgcgcagtctagaccgatatggcacaagagggcgacggggttgttggatgcaacgtcatgctcggcggcaatagcgcgacgctgctcttggctgtcgggcaaaaggccaaataggaacggacggacgatgttatggccatatgtgcgattggaaagcggcattgttaacgatagcggtgctccgcgataggttggggcgtatacaaagctgcagagtccatgctcgtcttgccggagagtgccggcgatttcgccacaaatgaaggtcgcaagctccatttctgccatttatttcacaaccttacagccaaaggagaggtctgaagtgccggaaaggccttgctcggctgcgatttgggccagcaaggcaccatagaaagctggcgttccttgtcgagcgggtcgtctgcctacgcttggctttggcagggcattcgagttcgcgatagggaggtccgctatcgtcatcggatgttcggagggtgatgcgatggagtcgttatcgctttgcgcaaagagacctatgccgagtgcgttaaagacggtcaacagcttgtcgagccgaatgcccgtggcatctcccagctcgagcgatgcgagcaggcgctccgaaacaccggccttattagcgagggcggcacgggtgagaccctgagcctcgcgtgcctggcgcacgtagatgccagcttggcgcggtgtggtgatgggaagggtatccacggcgatctcctaacgtgcagacttttgcatcatagcatgacatgcaaaagtctgcatgaaaaggcctcatgcaaaactctgcatgaggcctcatccggacgtttagttttgaagggtgttttacagcgccaaaatccccagatgctccagcaaaatcttgaggccgatgaggacgagcacgacgccacccacgatggtggcgggcttttcgtagcgcgcgccaaaggtgtggccgatcgctacgccggcaacggagaagacaaaggtcgtgatgccaatgagcgacacggcgggaacgatatcgaccgagagcgcggcaaacgagatgcccacggcaagcgcgtcaatcgaggtggcgatggcaaggattagatattcgcccaggtcgatcttttcggcatccttgccgtcgccttcgttctcgtcctcagtaaaggcttcccacagcatcttgccgccgataaaggcgagcaggataaaggcgatccagtggtcgatggggctgatgatgcccatgaactggctaccaagggcccacccaattacgggcatgccggcctggaaaccgccaaagaacaggccgagtatcacggcgaccttaaggttgatccttttcatgccaaggcccttgcagatggatacggcaaaagcgtccatagaaaggccgatagcgagcaacacaagctctgcgagtcccatagtctggctccctctctgcgggcgggcccgcgtgtacctcttgggggagtaacaaaaaagacccgtggcgtacgcgttgcgcgcacagccacgagtctcgttcattaaggcaagccaggccgcatcggccagtgtgttgacttgccgcgccaccggaggcgaacccgatcacgcgactactccctcatttatgcgaatcccgatgctaccacatgaacagctgatttgggttgggctctcagctgtgttcgctcattctgtaagcatcggatttcgcaagcgccgcagggacaaaccgtgagaaactatttagcgtttatggagcgtatacgatgggagcgatgccttggataagaacgagctgcaaaagcgtatggaacaggccatccgcctgacggcacctggtcagccgatccgcaccgccctcgacatgatcatcgccggtcacctgggcgcccttatctgcgtcggcgacaccgaaaacgtgctcgctgccggtaacgacggcttcccgctcaacatttcgtttacctcgaaccgcctgttcgagctttccaagatggacggcgccatcgttatcgatggcgacctcacccagatcctgcgcgccaacttccacctcaatcccgatccctcgctcgccacgagtgagacgggcatgcgtcaccgtactgccgctcgcatgtcggtgctcaccgatgccatcgtgatctcggtttcggctcgtcgcgccgtcgtcaacgtgtacgtccacggcaagagctacgagatccagcccgtcaccaccatcatgagctcggtcaaccagctcgtcgccacgctccagactacccgtcagtcgctcgatcgctccctgctgcgcctgacggccctcgagctcgacgactacgtcacgctcgccgacatcaccggcattttctcgagtttcgagatcatgcaacaggcaaagaccgagcttaaggattgcatcgtcaagctgggtaaccagggcaagctcgtgcagatgcagcttgagcagctcgcgggctccagcatggataccgaatacgacttgatgatccgcgactacgcaagcgattcctctgaggccaacgccgagaagattcgcgccgagctgagtcgcatgacgcctaaggacctgtctgacccgcagcacgtggcggcagttctgggctatgacgacctggacgaggactccgtcatgacgccgctgggcctgcgcacgctttcgcgcgtgtccgtcgtgcgcgacggcgtggccgagaagatcgtcgacgagtatggctcgctgcaggagctcatggacgacatcagcgaggatccggagcgcttgggcgactttggcgtcaacaaccctgccattcttgcggactcgctgtaccgcatgaagggcaccaaacaggggaacgcataatggcgcccgtatgcgctgtggtcgttgccggcggcagcggccagcgctttggaaatcccggcggcaagcagctcgttaacgtggcgggccgtccgctcatgagctggtccatccgcgcgttcgatcgtagcgacaaggtcggccacatcgtggtggtgtgtcctgccgagcgccgtgccgagatgcgccgcctggccatcgacccgtttgactatgacacgcccatcagctttgccgatgccggcgatacccgtcaggattccactcgtgccggcgtgcatgcggttccggcgggtttcgaatatgtcgccatccacgatggcgctcgtccgctcattacgaccgaggccatcgaccacgctatcgacgtgctcatgggtgaccgctcgctcgacggtgtcgtgtgcggtcagcccgcgatcgacacgctcaagatcgtcgacggcgataatatcgtcgagacgccgccgcgtgagctctattgggccgcgcagacgccgcagatctttagcgtcgatgctatgaagcgcgcccacgctgcagccattgccgagggctttatcggcaccgatgattcgtcgctggtcgagcgcatgggtgggcgcgtccgctgcgtccagagcccgcgcgataaccttaaggtgacggtgcccgaggacttgcgtcccgtaaccgcgattctgcttggccgcatggccgagggagaggaccttccccatgttcagtaacctgcgcattggccatggctacgacgtccaccgtctggtggaggggcgtcgatgtatcatcggcggtgtcgacattccctacgagcgcggcctgctgggccactcggatgccgatgtgctcgcgcacgccttggccgacgccattctgggcgcctgccgcgggggagacatcggcaagctattccccgacaccgatcccgcctacgagggtgccgattcgatggtgctgcttgcccgcgtgatggactatgcgcgcgagctgggctttgagtttgtcgatgccgattgcaccattgcctgtcagcaacccaagatcaccccgcaccgcgatgccatgcgcgccaacctcgcccatgccctgggcgtcgatgtcgaaaacgtgggcgtcgccgccactacgaccgaaaggctcggttgggaaggccagggcgagggaatcggcgcctgggccgtctgcctgctacagaaaaccgttaaggagtaacgaatgcgtatctacaacagcgctacccataaaaaggaagagctccagcccatcgagtccggcaaggtccgcatgtacgtgtgcggccccacggtctatgacaacattcacatcggcaatgcccgcacgttcatcagctttgacgtgattcgtcgctggctcatcgcgagcggctacgaggtcacgtttgcccagaacctcaccgatgtcgatgacaagatcatcaagcgcgccaacgagcagggccgcactgccgccgaggtcgcgacagagttctccgacaagttcatcggcgtcatgcgcgccgccaacgtgctcgatccggatgtgcgtcctcgtgccaccaaagagatcggccccatgatcgccatgatcaagacgcttatcgagcagggccacgcttacgccgccgataacggcgatgtgtactttgccgtgcgcagcgatcccaactatggtcaggtctcgggccgcaacatcgacgaccttatggttggcgcgcgcatcgaggagaacgaggacaagaacgatccgctcgactttgccctgtggaaggccgccaagcccggcgagcccagctggccgagtccctggggcgagggccgtcccggttggcacaccgagtgcgccgccatggtgcaccgctacctgggtaccccgatcgacatccacggcggtggctccgaccttgccttcccgcatcacgagaacgagtgcgcccaggccacctgcgcctggcaccagggtttctccaacacctggatgcacacgggcatgctgctggtcgacggcgagaagatgtccaagtcgctcggtaacttctttacgctggccgaggtgctcgagcagcactccgctgctgccctgcgcctgctgatgctgcagacgagctatcgctcgccgctcgacttttcttgggagcgcctggagggtgccgagaactcgctcacgcgtatcgccggtacggtcgagaacctgcgctgggccgcgaaccatgcgacggccgatgccgatgcggctgccgccgaggcgtttgccgccaaggccgctgagactcgtgccgcctttaaggagtgcatggacgacgactttaacaccgctggtgccatgggtgtcgtctttggctttgtgaccgagtgcaaccagtacctggagcaggcgggcgacgctgccgacaaggccgccgcgcttgccgccgccgacacgctggccgagctgctcgatacgcttggcgttgagctccccgagcccaaggtcgagctgccgctgggtctgctaggcgttgccgccggcctggtcgcctacacgggcgacgacgtggacgaggccgctgccaagattctcgaggcccgcgccgaggcccgcgccgccaagaactgggatctggccgacgccatccgtgatcagctcaaggacctgggcctgacgattgaagataccgccgccggcactcgtatcaaatctctctaatccccgcgggtttcccaagcacccgaccttgccgttcaaaccgtcgctcgcgtactcaagtacgcgtcgctcctctttcacggcaatctcgggcacttggaaaacccgtaccgaccgcccgaattaatattcatgggcggtcgtttattttgtttcgtttgatagttgtatttaggaggtcactttatggccgacaatcgcaagcgtgcgccgcgtggaggcaagcaggctgcttctggctcgcgtccgattcgccgcaacgaccgcgctgccgctcccaagggccagcgcgagcgctcccaagcccaggctgcacgtccgcagcgagatcgcaaccgcgacaacgttcaggctcccaagggcgagtttatcgaaggtcgccgtgctgccgccgaggcgctacgcactggttttcccatcaagtgtgcgctcattgccgagggcggggagcgcgatgccgccttgtcgcgcctgatcgatgacctcaatgccgcgggcgtccgcattaagtatgtgccgcgcgcgcagctcgatgcgctgtcgagccatggcgctcaccagggtattgcgctcgaggttggcaacttcccctatgccgacgtcgccgacatcctcggccgcgcgggtgacggaccggcgctcgtcgtcgtgctcgatcatgtgaccgacgacggtaactttggtgccattgtgcgctctgccgaggtcgtgggcgcggcgggcgtcatcattgccaacaagcgcgccgccggcgtgaccgttggcagctacaagacttctgccggtgctgtcatgcacctgcctatcgcacaggttcccaatatcgcccgtgcgctcgatgacctcaaggccgctggcttttgggtgggcggtgcctccgagcacgccgagggcagctgctgggatgctcccttcgagggccgcgtggcgctcgtcatgggctccgagggcgacggcatctcgcgcctggtgcttgagaaatgcgactttttgaccaagcttccccagcgcggcatgaccgagagcctcaatgttgcccaggcgacaacggcgctgtgctttgagtggctgcgccgcaatgccggcgagctcatgggggaggagtagcgcatgtccaagaagaaccgcgccaagtccaaggccaagcgctttggcgagggctcggccaagccgattgtttcggctgcgacctatggcgtgggcggcaatgcgtttgcgcaggctatcgccgacccagtctcgacggtgcactccaacaagcccgagctgctggtggtcgacggttacaacgtgatccactgcacgccgcgctacgaaaagctcgtgtacgaccattccgacgatccgtattccagcgacgttcacgatatggcgcgcactgccctcatcaacgacgttgccgcgtttgcccaaggccgctacgaggccgtaatcgtgtttgacggcgcgggcaatatctccagcgagcgccccaatctgccggcccgtggcgtgcgcatcgagttttcgccgacgggcgtctctgccgataccgtggtgcagaagctctgtatcgaggcacgcgaggaaggccgcgcgtgctccgtggtatcgagtgacggcacgatccaggccgtcgtcatgggcaagggcgttacgcgcatctcgagccgtatgctggtggacgagatcaaacagatcgataacgacgttcacgaggcagaggaagctccgcagatcaagatgaccctgggcagccgcctgagccccgatgccctggccaagctcaaggccctgcgcggacggtaggggagctgacggcgcgacgctgtctcgctaactccattcagcgatgtcgatcattctacggaggcgccatgtaagcgcctcttttagatatggcagccttgccgtgagcgcgtcgtttctggacagaatctcgattgcctcgtcaacgaagccttcgagtttgtcgccgtcaaaccagcccatgtcctcgacgagcaacatttgtttggcggggcttgaatgaaattgtgcgctggtaaaactgtgctctcccgccctaagctcttctagtgatatgttgcaccagagtgatgagcccgaatcgaagatgggggctggtctgcaggctagcgtgtttacgtttcgcacaaggccaaagttacgccaatggcggtcatagttggcgatgatgtcgtcgcacacgatcatgcggtcaagggcgtcttttatatctgtcgctccaagctcttcgcagtttgctacataccgttcgtaatcggttagtcgctcgtctgcatttgcatgctggtttacatagaacgcagggacatactcttcttcatcagttaagaagacatcgcatgtgctcagggcggaagtgcccgtgccctcgagcgagtaaggcacataatcgcaggcgtttaggatgcgacggtggagcgcggtcgccaccagctcgttataaggttcctggtccaggtgcgctcctgccttatgcagaattcgacgttcgccctcgcacgtccagtacttttgaagattgccgtccgaggtgttatcgggctttgcggcagccgcttttccctctggggcaaagggtgcaatggacagcgagacgtcatcaaaggcgttattgaagaagttgatatcctcccaggtgagaccggaaccttggggcctaatccaatactggtcggataaggagaggccgagatttcgctggacgagttcatcgggaacatcgactgcggcttctgcaagcagggaggctagcccaatgcgtgcgagcgggataccgcggccgcgccaccagatgcggaaggagtctagcgatatggggctattagggccaaatactccaataggggcgtgggcgtaatcgatgtcggcaccgatgtgggtaaagtcttttcgcgatgtactgtagaccagctgagcgacttcgtgcgtgcgattcatgagggtgaacgcgatctcgctcttaccgtggccgcggcggggacgtccccccgttttggtcacggagcggagtcgcgtgtcgacgctgtctttgtcgatgagccatacaccagaagccttgcgggcctcaagtgctccgttttttatgagctcctgcaccctgcgcggagtgatgccgagcagctcggcggcttctttggtagtaagcatcgcgaaacccttcgccagaacgaatagttttatatatagcaattgtaattaaaactattcgttctggcgaatggttttaagattgagggcgcactgacagaaatgaacgggcctggtacgcgttgttgctggattttgcatatttgtataacgccgtgcggcctgttgcgccccgtccgcaattcctttattcttaactcgcttcgcgtgaaagcgccaagtgtgccagtgtggcgcaacggtagcgcaactgatttgtaatcagtgggttgcaggttcgattcctgtcactggctccatgagagtttcgggctctgtttccttgtgggacagggcccgtttctatttatgtcgataagtcagcgtgtttggcgccaaccaagcttcaggtttgtctcgatccgtaacacgagtgggctgaagaccctccttatagttacagatcgaaacattgccaagggaaggccgataacatctcgatccgtaacacgaagaggctgaaaaccgttcttactgttacagaatgagacgtaagcgggggtttctgcgaaacatctcgatctgtaacagataggggaggaataaccctcttactgttacaggtcgagacataggccggggcgaggttggtcatcgtcatcgagcgtggattatcggacacacgagcgtggaaaatcttccgcctagtgaatgagcgtggataatctgccactttggattcgatggcacggcaaagtgggagattatccacgctcgatttcaaacggaagaaaatccacgctcgattttgcctgggaagagcaatcttctgtctgggcagccccgatctcgacctatatataggtgcaaataagctggtatcgaaggtcgatgctgcagatgtactccaccgtgacaaagtgttccctcgtgaaatgtcacaagcgtagccaaatccaccgtccttcatatccaaactcaacaaaaccgcaggtcacagctatatagatacgcccggcaccgtgtatctagaggttttcgttgacagcccccaaggttgcatcgtattatctttttcgttcgcgggggcggcggtccaaaagaccaaaggacctgcggatacttgaacgattgggagtttgcccgagtggttaatggggacgggctgtaaacccgttggctctgcctacataggttcgaatcctatagctcccacccgtcaagtgcctgtatagctcagtcggtagagcacttcgttggtaacgaagaggtcaccagttcaagtctggttgcaggctccatccggcggtgtagctcagttggttagagcacacggttcatacccgtggcgtcactggttcgaatccagtcaccgctaccataggtaacacggtggcttctcaatagtatgttgagaggccactatggtataaaggcaaagtcccgtccggggacgacctgtttagaggagggctttatggccaaagagaagtttgagcgcactaagccgcatgttaacatcggcaccattggtcacgtcgaccacggcaagaccacgctgaccgctgccatcaccaaggttctctccgagaccgagggctgcaaggctgacttcactgcgttcgagaacatcgacaaggctcccgaggagcgcgagcgcggcattacgatctccgtctcccacgtcgagtacgagactgctgcccgtcactacgctcacgttgactgcccgggccacgctgactacgtcaagaacatgatctccggtgctgctcagatggacggcgctatcctggtcatcgccgctaccgacggccccatggctcagacccgcgagcacatcctgctcgcccgtcaggtcggcgttccctacatcgtcgtcttcctgaacaagtgcgacatggtcgacgatgacgagctcatcgacctcgtcgagatggagacccgtgagctcctctccgagtacgatttccccggcgacgacattcccgtcatccgtggttccgctctgggcgctctcgagggcgacgccaagtggatggacgctatccgcgagctcatgaaggccgtcgacgagtacatcccgacgcctgctcgtaacaacgacctccccttcctgatggccgttgaggacgttatgaccatctccggccgtggtaccgttgctaccggccgtgtcgagcgcggtgagctcaagctcaacgagcccgtcgagatcgtcggcatcaaggatacccagaacaccgtcgttaccggtatcgagatgttccgtaagtccatggacttctgcgaggctggcgacaacgtcggtctgctgctccgcggcatcaagcgcgaggacatcgagcgcggccaggttctctgcaagcccggttcggttaccccgcacaccaagttcaccggtgagatctacgttctgaccaaggaggagggcggccgtcacaccccgttcttcgatggttatcgtcctcagttctacttccgtaccaccgacgttaccggtacggtcaagctccccgagggcaccgagatggctatgcctggtgaccacatcaccatcgagggcgacctcatccacccgatcgccatggaggagggcctgcgcttcgctatccgcgagggtggccacaccgtcggttcgggcatcgtctccacgatcattgagtaaattagctctttgatatagctgacttagagaacccggcacttatatgggtgccgggttcttttctgcaatggatattgagccgttgctggtgtcgagaggatcgacaatggtcctggatgcaccgtcgattagatctcgatggcttcattgatgtgttccaaatatgaatggatccaccgagaaccaattgactcgaggttttcattgacagcacttacgtggagctgataaagtaacaactcgtgcccgtacggggcggaaatgaaaggttcaggatacatgcgtactctagttactcttgcgtgcactgagtgcaagcgccgcaactatacgaccaccaagaacaagtcgaccatgcctgatcgtatggagatcaagaagtattgcccctggtgccgtcaccacacgctgcacaaagagactcgctagtctctagtcacatacgccagtagttcaattggtagagcatcggtctccaaaaccgagtgttgagggttcgagtccttcctggcgtgccagtcattattccgtaagctcccaattgggggcttacggtttactcatgtataagcgcattgcgcggaggtaacccaaatggccaacaagaagaacaagaagaaggctcagcagcaggcgcctgccaacaacgctgccgccaactccaaggttgaggccaagaaggccgttgccaagaagaacgagaaggctgcgaagtccaagaagaacgagaagcctggtttcttcgcccgcaccaagaagtatttcgcttcggtcaagtccgagatgaagcgtgtcacgtggcccgataagaaggagctcgtgaactactcggtcgtcgtttgcgcttctctgatcgtcgtcggcgtcgtcatcgctctgctcgatgctggctttggcgaggctcttgctctgttctctggattgaggggctaaaccatgtctaagcgttggtacgtcgttcacacttactctggatacgagaaccgtgttaagtccgatctcgagcatcgaatcgagactatgggcatgcaggaccgtatctttgatatcgagattcctatggagcgtgtcaccgagattaaagagggtggcaagcgtgagaccaaggattccaagattttcccgggttatgtccttgtccgcatggagatggatgatgatgcttggacgtgtgttcgtaacacgcctggcgtcaccggtttcctaggcggcaacggcaagcccgctccgctttcccgcgacgagtacaacaagatgactcgtcgtcccggtaagggcgattcgcccaagcgcacctcggttgatattgaggtcggtacgtccgtccgcgtcaccgatggcccgcttaccgactttgatggcaaggtctccgaggttaacaccgaggctggcaagctcaaggtcacgctgatgatctttggccgcgagacgccggtcgagctcgactttaaccaggtcgctgtcatcgcttaagttttcgtccgttcgcgcgagcgtgcttcttctgtgactgctcatctcaggagtgcttctaacacgtgcgtgcttacgatatagcaagtacttcacactcgtgattcgaaaggaatgaccatggctgagaagaaggttgccaacgtcattaagctccagattcctgctggtgcagcaaaccctgctcctcccgtcggccccgccctgggcgctgctggcgtgaacatcatgcagttctgccaggcctttaacgccgagacgcaggacaagaagggtgacatcatccccgttgagatctctgtctacgaggacaagtccttctccttcatcaccaagaccccgccggcggctcaccttatcaagaaggagctgaacctcaagtctggttccgctaagccccaggctgacaaggttggtcagctctcccaggagcagctcaccaagatcgccgagatcaagatgccggacctcaatgccaacgacattgacgccgccaagaagatcatcgccggtaccgcccgttccatgggcgtcaccatcgctgagtagcgatttcttatggtaacggcgggtgctccgaccggggcgcccgttaaatgtgtgcaatagggcacacgatacgatgtgggagggctcacgcccgtttaaccacaggaggtaatgcacatggctaagcatggtaagagctataacgccgctgccgagaagatcgaccgcgccacgctctacaccccccttcaggctgccaagctcatcaaggagctcgacaccgccaagttcgacgagaccgtcgaggctcacttccgtctgggcatcgatactcgtaaggctgaccagaacatccgtggttccatctccctgccccacggcaccggcaagaccgttcgtgttgccgtcttcgccgagggcgagaaggcccgtgaggctgaggctgccggcgccgacatcatcggttccgacgagctcgtcgcccagattcagaagggcgagatcaacttcgacgccgctatcgctacgccgaacatgatggccaaggttggccgcatcggtaagatccttggtccccgtggcctcatgccgaaccccaagctcggcaccgtgaccatggacgtcgccaagatggtctccgagctcaaggctggccgcgttgagtaccgcgccgaccgctacggcatctgccacgtgcccctgggcaagaagtccttctctgagcagcagctcgtcgagaactacgctgccctgtacaccgagattctgcgcgtcaagccctcttctgctaagggcaagtacgtcaagtccatctccgtgtcttccaccatgggccctggcgtcaaggtcgatcccgctgtccagcgtgacttcctggctgagtaactgctagttactgcctgagtacagcaagcattgctaaagaaacccggttctgccttgtgcaggaccgggtttcttgttatcgcgtcaaaagcaccataaaggggacagtgtcccctttatggtggttaccagggtgttctggctgttgaagactcgatggcttcgtggcgtttgagctcgcggcgcatggtttgtgagttgagccaagctgcttgccagccgcggatggggtagtgcgtctggtcgagctcaaactgcgtatagccgcaagcgttgatgatcgtcgttccacacacatgctgacgctcgcgctgaaaatcgcaaccgtagctttggtgcacatgcccgtgcaccatgtagtcgggattccaggattcgagtgctgtgttaaaacactcgaatcctcgatgcggcagatcgtccagatcacccataccggcggcgggtgcatgggtaagcagaatgtcgcacccgccgaccatcctaaccttacgcgacagcttacgcatgcgcttggacatctcgcgttcggtgtacatgttggcgccgtcgcgataacgcatggacccgccaaggcccgcaatgcgaatccctcggtacgtgtacacgctgtcctctacgcagatacatccacccggtgcatgacgtgcgtagcggtcatcgtgattgccgcgcacgtagatgagcggtttgttgatgaccgtaaccaaaaactcaagatagtccgggtccagatcgccggcggacaaaatcaggtcgactccctcaaagcgttccttgcgaaagcactcccaaaggcatcgttcttcggtatcggctatggcaaggattttcatagggcagggactttcggctcatcgtcgagctgcggaatggtgcctaccacgttgtccgccagccaattcatctcgacaatctgcgtgctcggcagcggagggaagccttcgatctgtaccacgccgttctggctgtggagctcgccgccaaaggggttgatggatcccacaacaatgccgttgcggagcaactgcacgagtttgcgcgtttggtagggtaggcccggagcgtaacgaatgtcgataacgccggagctcatgccataccagtagttgacagcgcgcacttggttgtcgtcgctggtctcgtcccacgtgccgtgaagaaggctgcgaacgatgagctcgtagtaacggccccagttccatacgggcatggcgatgccggtgactttgccgtcgaccaagcggtgaagcccgtaggccgttgggtcttcgagcgactttgacatgtcagcgccggtcatgacgcttaagccttcgcggcacatggcttcggcaagaccgccggcgggaacatcgccccaggtgaggatgacctgcgcgcgcgggtcgagcagcgaggcgccaatcgcaaaggcgttgatctcgctgagtgcgcccgaggcgaagaccgacgcgtggtaaccgatgcggtggttgtccgccatgctggccgcaagggcgcccagcagaaacttggcctcgtacatcttgccaaagtacgaacggacgctttgatggggaaggccgatagagcagttgaggaaccgaacccggggatactcaacggcagccctgagcgtgtattccatcaggcggtgcgaggtcgagaagatgacgtttgctccatgtttgacagccgtttccacggcggcgtagaacacatccggatcgtgacagtcctcgaacgcctcggtgcgcacgataccgccaaagtgctcatcgagatactgacgcccttggtcgtgcaggctgtcccagctcgacgtcgcacaggggaactcatggataaaggcgatgcgcagggggttggccgtcgagtagacggtcttgcccataaagaagttgagcacgccagaggtggacttggcgggcgtctcctcctcgtcgacgctcggtgcttcgacaagatcgaccttgtcctcgtcatttttgccggcaataaccagctcgcgccagatcttgcacaggcggtttacgacgatatccgtcggcgtatccagcaggcggtcctggttgtacacattgaggtagacgagcatggcgtcggcgggcgtaatgtccaggtggtcgccgcctgcgcgaaggtaggcgcgcttaaagagcaggaaggtgtggcgcaggtagtcgacctttttctgcggccatttttcgataaggttctgaccgagcatcttggcgagcgtctcgtagcttccctcacgcgagaactcgatctcgtatagggggcagacgcgccaaaacgcgcagaactcgccgtacaggcggctttcgacggaatcccatgtgccggggtagagacgggtgaccttggccgaaaccgtcggagcgtccaggaatttgaggacactgacgcgtttgttgccttcctggacatagaaccgatgcatgaactcggtgacgatgatggggtcgcgataaccctcggttacctggatgtcgtagaggttggaccacttgcgggcgaactcggtgccaaacggcagcaggggcataaagttgcatgaaaaggcggactgacggcccttggtaaccgtaccgacgaccatttcgagcggaatgtctctcaggccgacattctctcgctggcctaaggggagctgggcaaccaagctatcgaggtccgtgaggtacggatactcgctttgactaatggcgcgtcgacgtccttgctcgccgcgcttgcgtgcttgacggtaggcctcttccatgatgttgctcccttagtcgtttaaacaactatataaaccatggtaccacgaatgaaaaccacaacaaaggtgcctgtcccctttgtggtggtttaggcaatgatgggggcgatggcgcggatgcaggcgtcggcagcggtgaaagtggtgctgtcgtcgctgacgataaagatgatcttgcccttgatgccaaagtcgccgatctcgctaaagagcacatacggctccttgtcaaagcccgagatgggaagcacggcggccttggtggcgctggtcagctcgtctgccagcgcgtcgagcgaggcccacttggacgtgtcctttacggcaacgggcacagccacgcgcccaaagggcatcaaatgcacgagcgtgttcttggagatgttggagttggggacgatgatggtctgtccacaggcatcctcaatcgttgtatgacgccaagtgatgtcttggaccacgccggatacgccgccgacctcgatattgtcgccgggtttgatgatgcccataaaggtcacttgcatgccgccgataaggtttgacagcgtgtcctgaaagccgagcgagatggcgatgccgccgacgccaagagcggcgacgagcgcgtttgcgttaatgccaaagcagttgtcgaggataaagctgccgccaatcatccagatgacagcgcgcgcgatgttgatgaagatacttgatgccggaagcgggttatcgtcacggttaagcagatggttcagggtcttggatacgacctcggcggcgacggcggtgcctatcgccaagatgacggcccagatgatgttgtggacccaccgttgctcaaagaaatgaagaatcggctcaaacaattccatgtagggaaaacctcctaatgatcgtccaaccatgatacccaccaggaagcccgtccgatcaaattcagacgggcttctgtgctcgatataaggtttacgcggcggggctgcaaggcccggcggtgtagcttagcgtcgacgcttccagataatgccgaggatgatgacgatgatgccgccgataaggcacgcgccaactactgccagcgtgcggtctcccgttgcggcgagcttaccgctcgtcttcttggtgctgaccttcgtggtcgtcgtgtccgtcttaggcgagggcttaggcgtcagggccggtgtgggcgtggggtccacggctacggagccgaagctgatggtgccggcgagcccggccatcttgctctcccagccgttctgcccaatcagcgccctcagcgccgcctcgcacgtgccccactcggtgtacttggtggcgtgtgcaaaggtgggaaagtcggtcgtgttggtaatgatgtagttgttggtggcgacggtataggtcttggcggggtcgagcgtgctgccgtctttggtgagtgtggcactcacaatgcgcttgccttcgggctgcgtccaatcaatcgtcacgttgatgccgccaaaggggagaacgctgccagagtcatcgcgccacttgtacttgtcttgcgcctcctgctcggtgtgaccggccgccacataagcctgctgaagctcgtagctgtcgttgcaatcgtcgctgatttgtagcgagtgctcgagcgctgcgaggaagtccgcgccggtcatggtccaggtctccacggtgttgccgtagggcgagatggcgatgacgttgccggcggtcacgttgcccgccgcgatgccgccgcggatgccgccagcgttttcgatagcgaggtccgcgcccgtcaggtcaagataggagctgcaaatcacgcggccgatggtctgggccttggtggtgtcgccctccttgctgggacggaaatcggtggtgcgcaccatttcccaaccatgcgtgcctgcggcgtcctcgccgtagaaatagttggtggtggatgtgccgagcaccttgttcgattcgttttcaaaggcctcgtcgagcggcttgatcttgttgcggacggcttcaaggcagctttggtagtcggagcccttgtcggggtctgccaaaaggtcgttgacgttcttggcggtgtagagcttctcgtcgctgccgtctgcagggaccgtgaccgtgtcatcgtcggtcgtctcggtgccattggtgtcgtacttgtacggaatggaaagcagccccacctcggcaaaggcgctgcctgcctcgacaacgtggattgtcttgccgtcggctcccgtcaccttctcgttaaggttgatgtgctcgtggcctgcgataagggcatcgatgccacggagccgtgtggcaaaggtcttggcgttgagcgtatgcgcgatacagacgacaacgttgcagcccgccttgcgcagctgctttgcctcggtattgatggcgttcgtggcactcgagaacgacgtgcccgcgaccaggtccgcgcgcagcgaggatcccagcgactcatccatggcacccacgacgccgaccttgattttgtagtcgaatgtggagtgatcctcgctatcctcccaggtgcgatcgagcgtcttcgtgatgctcgagctccatacgccgctcgtagacttcgcgttcgcgcagagcatggcgaagggcgtgccggtggtgctgtagccggtcatggtgcggagcttgtccgcgccgtagctccagtcgtggttgcccggcgtggtcgcgtcgtagccgtctacatagaaggtgtccatgagctcggcgatgctcttgccctcgctcatggtggcgaaggactgcccgtggaaggtgtcgcccgcatcgagcaaaagatcgggggcgttgccctgggcgctataaaggaccgccagtccgtcgaagccgacggtgccggtgcccttgcttgcgttgtagctgtacttgtagctgccgtggatatcgttggtgtgcatgacggtcacagagccgtcaatagcggcgggcaggttcccggcgaaagcgaggcttggggtgcctgcgagcgcgccggcaaacaacgcggcggctaacgcaaggcgggggagtcttttcatggcagtttccttagtccttagccagaatgtctggttgaatatcggattatcgacataatatgcgaaaaccgccgcaaggacgtttgcccctttgcggcggttttgacgtttgtgcagataaaacctaccaaaataaacttgtccctttttggcaggttttagctcagcagcatgcggtcgttggcgagctcgccgcccgagacctcctcgaacttctgcagcaggtcggctacggtgagcgacttcttctcatcgcccgccacgtcgtagatcacgtggccttcgtgcatcatgatcagacggttgcccagacggatggcgtcattcatgttatgcgtgaccatgagcgtggtcaggtggttctcgtcgacgatctcctcggtcaggttaagcaccttagaggccgtcttggggtcgagggccgcggtgtgctcgtcgagcagcagcaggcgcggcctggtgagcgtggccatcagcagggtgagtgcctggcgctggccacccgagagcaggccgaccttggcgttgagacgcgtgtccagaccaaggtccaggcgcttgagcaactcaacgtactcatctttctcggccttggtgacgccccacgaaaggccgcgacgctggccgcgacgcctggcgagggccaagttctcggcaatctgcatgtcggcagcggtaccgcgcatggggtcctgaaacacgcggcccaggtacttggcgcgctgcgactcgctcaggcgcgagatgtcggtgccgtcgagctcaataacgcccgaatcgagcgggtacacgccggcgatcatgttgagcagcgtggacttgccggcgccgttgccgccgatcacggttacaaagtcgccgtcattcaaggtgaggtcgacgccggtgagcgcgcgcttctcggtgacggtgcccttgttaaaggtcttcttgacatgcgagagcttaagcatctgcctcatctcccttcgtgtaggagctgcggagcttatagcgctcccaaaccacgggcacgcacagggccacagcgacaatcacggcggagagcagcttcatgtcgttggcgtccatgcccaactgcagcacgatggcgcggataaggaagtacaccacggagccaaagacggcggaggcaagacggacgctaaactgcgtgaggccgccgggcagcagacggccgagcacctcgccgataacaatggcggcaagaccgataacgatggcaccggtgcccataccaatgtcggcatacttttggctctggcagatgagagcgcccgaaaggccgatgagggcgttggagagcacgagggcgatcatcttggtggagttggtgttgacgcccagagcgcggatcatgtactcgttgttgccggtggctcgcagcgccgagccgatctcggtgccaaagaaccaatacaggatggcaacgatagccacggcgagcaggatgcccaagatgatggtaacggtggactgcggcagaccggtcatattgctgacggcggagaacacggtgcccttggcaagaatgggcgtattggacttgcccatgatgcgcaggttgatggaccacaggctgatctgggtgaggattccggcgaggatcgcgggaatctcaaagacggtggtcagaatgcccgtgacggcgcccgcgatggcgccggcgcacataccggccagcacggcgaacagcgggtcgacgttgttattgacgatgagcacagcgcagacgcagccgccgagggcaaagctgccgtcgcaggtcatatcgggaatgtcgagcaggcggaacgtgataaacacgccaagcaccataatgccccagaggacgccctgcgaaacggcgccctgcaatgcaatgagcatgcttcatacctcctaggatagggtggacacgtgattcaccataatagcggtaacaatgcatagacgagttacggacagacgttttgttttacctgaaacaagcagggcggacgccggtctacagcgcccgcccctgtggctcagatattgaataacgcggctaaagcgcgagcacgggctctagacgcatgccgcgtatagcattacgcgtccagagcggaaaggtcgatgcccagggcctcggccatctcgtcattcttgacgacgaccaggtccttgctcgagaggtgtttgatcggcatgtcttcgggcttggcctcgcctttcaggatcttaacggccatctcgcccgcggcgtagcccaggtcctcatagttgatggagagggtgaacaggccgccggccatgcacatgccctcctcgccagtcacgaaggggagcttgttctccttgcagatctggcccacctgcgaggcgcccgcggcgatggtgttgtcggtgggggagtacagcgcgtcgaccttgcccacggcagactcgacgacggactgaatctcgttggagctcgagacggtgaagtcagtgtactcgaggcccagcttgtcgagctccttcttggcggccttgatctggacgtcggagttggactcggcggtgcagtagagcaggccgacctttttaacgtcgggcaggaccttctgcatcatctcgagctgctcggcgaccggggtgaggtcggaagcgcccgtgacgttggtgccgggcttgtcgttgtcctggaccaggccggaggcggcgtagtcggtgatggcgcagcccacgatggggatatcggccgtggcgccggcggcagcctgcgcggcgggcgtggcgatggcataaatcaggttgacgttgtcgcccacaaacttgtcggcaatggacttacacgtggactggtcgttctgggcgttcttctggtcgatcttgaccttaaggccgctctccttgatggccttgacaaagccgtcgttggcggcatcgagtgcggagtgctcggtgagctgcagaacgccgatggtgtagtcggaaccggcggcagcagagccggagccagagttgccgccgcatccggcgagcggggcgagcgcgagcaggccggcggagaccagaaggctcctgcggctgatggtgatgtccttcatatcattacccccagtataaaaatggctggaaacactgcactgggacaaagtgcaagtggaactatagtagcgctgatgtccatttttacaacagcctggcgggttttttaatacagaatcggatgggcggtacgggtagtcgaatgggcggcggagggtcttatgcggcggaggaggcgtcgtcctcgtctagggcggcgaagagcttcttgccgtcgaggagacgtgtggtgacgtttctcattcggccaatctctacggtacgcaacgtgtcatcggcgcctcgggcgtcgtagaccgttcccagcagatacgagatgccatcgcgctgcctgatggcaaagggacggagtgtcatccgtgctgcttcggtttcgccacgcgtcgtgacgctcgaaatatcaaaactcaccgtggttccgtggtcgatggcctgctcgacgagctcgcacgtgtcgatgcgcttgatgggcgtgcgtgttgccttggtagccttgctgcctgcgcttggagcaggttcgggtgtatcgagatagccgcgaacgtcggcactcgccatggcaactaagtgctgcgccatgctcttgcggatggcgataggcgtggagcggttgcgcatgaccataccgtggagccggatgatctcctcgtcggtgagtggacgggtcaagagccgataccccacgccgcgcttgtattcaatctcatatccggcatggcgaagcgcggagatggcggtgtagatgctgcgccgcgccgccgagatgggcatgcgggcggggtcgtcgggatgggcgaggcgccggatcagctcatcggaaagcatggccttgtcttcgccggtgttttcgctcaagagctgcaggatacgaacggcgcgataggctgccatcgaggcggcgcccctcgtcgtggtgtcgtaggtttcaacagcggcttcggtcatcgtgcccacgtcctttccgttttgggtggcgacggtatggagcctaggacgtggggctttcccaggggcgcagggcgctctgggcggtcggtagtcgtcggcaaacggtgggtcgagttttcaacagccctgctcaactgaccaaaaacttgccaaaagcttgacggatgctgttgaaaaaaagcgtctctcgaccgatgtcgagagacgcttatgcgatgagcgttggcgtgtggcgacgcgagctagcgtccgacgattagaagtcggcgttgcccacggtgcgcgggtgcggcaggacgtcgcggatgttgcccacgccggtcagatacatgaccaagcgctcgaagcccagaccgtagccggcgtgcttgcaggaaccgtagcggcgcaggtcaaggtagtacttgtactgctcgggattcatgcccaggtccttgatgcgggcctcgagcagatccaggcgctcctcgcgctgggagccgccgataatctcgccgataccgggaaccaggcagtcggcggcggcgacggtcttgccgtcctcgttcatgcgcatgtagaacgccttgatctcggccgggtagtcggtcacgaaggtcgggcgcttaaagtgctcctcggtcaggaagcgctcgtgctcggtctgcaagtcgatgccccagctgacggggtaatcaaactggtggccagcagcgactgcctgctccaggatctcgacggcctcggtgtaggtaacgcgggcaaagtcggagttggcgacatggtccaggcgctcgagcagacccttgtccacaaacttgttgagcatattgagctcgtcggggcaggttgccatgacgtccttgaggacatacttgagcatggcctcggcgttatccatgtagtcgttaaggtcggcaaaggccatctcaggttcgatcatccaaaactcggcggcgtggcgcgtggtgttggagttctcggcacggaaagtggggccaaaggtgtacacgtcgccaaaggccatggcaaagttctcggcattgagctggccggacacggtgaggctcgcatgcttgccaaagaagtcctggctccagtcgacctcgccggactcggtgaggggcggatttttggggtcgagtgtggtcacgcggaacatctcgccggcgccctcgcagtcactcgtggtgatgatgggggtgttgacgtagacaaaaccctgctcctggaagaagcggtggatggcggcagccgcgacagagcggatgcggaacacggcgcggaacaggttggtgcgcgggcgcaggtgctgctgggtgcgcaggaactcgacggttgcgcgcttcttctgcagcgggtaatccggggcgctcgtgccctcgacctcgatggaagtggcagaaagctcgaaaggctggggtgcatcgggggtcagtttggcggtgccggtgcaaatgagtgcggccgagacgttttgatgggcgatctcgtcgtagttgtcgagtgcctcgcggttcatgacgacctgcaggtcgcggaagcagctgccgtcgttgagcgtaacaaagccaaagttcttcatgtcgcggacggacttgacccagccggcgacggtgacggtctggccgccgagcgactcggcatcggcatagagctgcgcgattttggtgcggttcacgtatcctcccataacggttgaatgatagttatccatacagttcgatattctagcagctcggctcatttgggctatacagataaagcattggcgggatggtttttcaaacgaaaagcgcccgcggccaaatggtcgcgggcgcttgacgaggtgccttttggctgtgtggcgcggggcctggctacttggtcttggcaaccagcagcgggtcgccaagcttgacgagcgggttgccgccgataagcgttccagactcgccgacatggtcgatgctcttaagacgatcgagctcggagacgatgacggtcacgatgtcctcgtgaccagcggccttaatggcctcgcggtcgaagctgatgagcggctggcctgccttgaccacatcgcccatctcgacaaagcgggcaaaacccttgccgttcatttccacggtgcccaggccaacatggatgaacacgcgcaggccgtcctcggtaatcatgccgatggagtggttggtgacggtggtggcgccgatgcggccgttggcgggcgcatagatggtgccggtaatgggctcgatgccatagccctggccaagcatgcccgaggcgatcgtctcgtcgggaacctcgttcaggttgacgagcacgccgttgacgggggcatagatgacgccttcgcgggtggcgaagcttgctgcgggcggaacggacgcctcgccggtcgaggtgaaggtggacttaagcgaatcgagcagacccatagttgcctccaacttaaataggcgcatatcgcgcgtttggtttgccggaaacgtttcatatgtgtttcgcggcttggtcaacgccccctattctacgctgctcaacgatacctctgaactgggattatgtgatatatcagttgaagggaaacttattgccggagtgtttctgcgccacgggttcaagtggggtacgcttgaaggcgaaaaacaagggcgcataatttgcgcgaagggagcacatatgattgtcgagaaccatgcgctgtggggcgaggagccgaccgaggattatccggcgacgtttacgtatttgggtgccgagccgctgcccgataaaccgaatggccgccgccccgcggtgatcatctgcggcggaggcgggtttacacatatcgctccgcacgagcaggacccggtggcgtttgcatttttggatcacggttaccaggcctttgtgctcaactatgtcacgagctctacgggtgacgtgagctttccgcacccccaggcagatcttgccaagatggtcgccacggtgcgcgccaacgccgacgagtggcatgtcgatcctaagcgcgtgtgcgtcgtgggattctcggcgggcggcatgatctgtgcctcgctggcaacgcagtggaagaccggccccttcgcggcacttgccggggcacgtccggacgacattcgtcccgatgccgtggtgctgggctatccgctgctcgactttgcctatgtgcgcgacatgcagacgcgcgatccgcgcattgacttgcgcgtgcccaagacgggcggcaagacggggcgcgatttgctcaacgactacctgtcgatggtgacgggtggcgaggcaactgacgagcatttggccgatatctgccccaccacgcatgtttcgcgtcagatgccgccgacctttgtgtggggcgtgtccgacgacaagacggcgccgatcgcgcaggtctacccgtttgcgcagcgcatggccgaggagggcgttgcatgcgagatgcacgtcttcgaccagggtggtcacggcctttcgctcggcaacgccaacaccgcggtcgacaacgaggacaagcaggtggcggtccgtccctggatccgcctagccttccgcttcctggagcgccacgggttttagttacggcgttttaccaaacgccgtaaccacttgacgctgcaagcccgccagggcggcaatctgcctttcaacttcggcggcatgaccaaaaggtcaatgccgcctcgtttcagggcaccttgctcgccctggcgggctttcgctcatatgacccaatccgctgtcaagagccacaatggccccgccgaccgcttgcaatcggtcggcggggcctgccgttgaacccgtcccggtccgcccccggcatgtcgtcgacgccttcggctcagtctcatatccgcggataccgttctgtcggcccgcactccattccttcggcggggttccccaagtctgtcgaggcgcatgcggagggctccgcgcgcacagcgaaatagggggtatccccgaaggccgcccggctcgccgggacgggggctatgtctattccgcgccctcccggcacatcatgccgagggcccagagccacctcacgagctcggccgcggtggccgcgttggccttcacgagcgggggctcctatctttttagtgccctcggattgggtcatagtgtctgttcgcgccaaaacatcggcgttgccatggcccagatgcggcacttggggacgttccttttgtgccggcacttggggacggtccttgcagcaatctgtcgattgaacgtcgttgtgcgttcgcgctatcatgcatggttacaattggttagccgtggcaaacggttagccaaggtaaactaaatgcaacgccctgtgggcgtcgggggaggagcacggacgtgaagctcgatacactcgagattggaaaggacgccgttgtcgcatcggtggcatcggacgatcaggcactccgacagcatattttggacatgggtctaacgccgggcaccgaagtcaccatgatgaagtacgcccccatgggtgacccgctcgagatccgcctacgtggctacgagttgacgctgcgcaaggacgatgccgcacgcattgagctcgtggatgtgcacgacaccgataccggcccgcgcgttaacgccgcaatcggcacgacggaccacccggccctgggcgaggggacgtattcaccccgtgcggcaaaaacggccgtgcccgagggcgcgccgctgcattttgcccttgccggtaaccaaaactgcggcaagaccacgctgttcaaccagcttacgggctccaaccagcacgtcggtaactttcccggcgtgacggtcgaccgcaaggacggcaccattcgcaaccaccccgaggcgagcgttaccgacctgcccggcatttactccctgtcgccgtacacaggcgaagaagtcgtgagccgtcagttcatcctcgacgagcgcccggacgccatcatcgacatcattgacgccaccaacatcgagcgcaacctgtacctgacgctgcagcttatggagctcgaccgccccatggtcatcgcgctcaacatgatggacgaggtgacggccaacggcggcgccgtggacgtcaacctgctcgagagcctgctgggcgtgcccgttgtccccattagcgctgcccgcaacgagggtatcggcgagctggtggatcatgccttgcacgtggcgcggttccgcgagcgtcccggtcgcctggacttttgcgcacccgatggtccagacggcggtgcgctgcatcgctgcatccacggcatcgccaaccttatcgaggaccatgccgcgacggcgcacattcccgtgcgttttgcggcgaccaagctggttgagggcgacgagctggtgaccgaggcgcttcacctggatcgcaacgagctcgacgctatcgagcacatcattactcagatggagggcgaggccggcaccgaccgcctgtccgcgctggccgatatgcgctttagctttatcggcgacgtgtgtgggcgctgcgtcgtcaaaccgcacgagagccgcgagcacgtgcgctccgtcaagatcgaccgcatcctgacgggccgctacacggccattccggcgttcctggtgatcatgggcctcgtcttttggctgacgtttggcgtgatcggcgcggcgttgcaggggctcatggaggacggcatcgctgtcatcatcgcctcggccgatgcgggcctcaaggcgttcggaaccaacgacgtggtgcgctcgctggctgtcgacggcgtgcttacgggcgtgggcagcgtgctgaccttccttccgattatcgtcgtgctcttcttgttcctctccattctggaagactccggatacatggcacgcgtggcctttgtcatggataaggtgctgcgtcgctttggcctgtcgggccgcagcttcgtgcctatgctcgtcggttttggctgtaccgtgccggctatcatgtcgacccgtacgctcccatccgagcatgaccgcaagatgacggtcatgctcacgccgttcatgagctgctcggccaagttgccggtctatggtctgctgtgcggggcgtttttcccacaggcgacggttcccgccatggtctcgctctatctgattggtattgcggttggttgcattgcggctttggtgctcaaccgtacggcatttaagggcgacccggtgccgtttatcatggagcttcccaactaccgcctgccgagcgtcaagacgacggtgatgctggcatgggataaggccaaggactttattaccaaggcctttaccattatctttgccgctaccgtggtcatctggttccttcagacgttcgatatccgctttaatgtggtcgccgatcagtcgcagagtctgcttgccggtctgggtagcatcatcgcgccggtgttgaccccgctcggttttggcgactggcgcgcctcgacggcgctcgtcacgggactcatcgccaaggagagcgtcatctcgacgctcacggtgcttttgggcgcaacgtcgcccgcggtgctgtcaaccatgttttcgccgtttaccgcttacgtgttcctggtctttacgctgctgtacccgccctgcgtggcgtccatcggcgccgtcaagagcgagctgggcacgcgctatgccgttgctgtgttcgcgtttcaggtgacggtcgcctggatcgtggcgtttgtcgtgcattcggcgggcatattgctgggtttggcttagttatttattgacggcgcaacctctgtgtattgagttgattgcggccccgcatctgtactgacggatgcggggccgttgctatataatcgcccaccgcccaagacaatcggagaggtttcctacatgactcaggcaagacaagatggcatctcactcaagcagtggctcccgcttattgggctcgcctgttgcgcgttcgtattcaacacgtcggagttcatgcccatcggtcttctgactgatattgccgcatcgttctcgctcacggaggcccaagcaggcatcatgatctcggtctacgcctggggcgtcatgctgctgtcgctgccgcttatggtgtttgcctcgcgctttgagttcaagcggatgctgctcggcgtgctcgccgtgttctcgctgggccagttcctgtccgccgtggctcccacctatcctattttggtttgcgcacgtctggtggtcgcctgcgcgcatgccgtgttctggtcggtcgcctcgattatggcctcgcgcctggtcgacagtcgccacggagcgctcgccatcagcatgatcgccacgggctcgtccatcgcgcagatctttggcctgccgatcggccgcgccatcgggctggccgtgggctggcgcatgacgtttgccgtggtcggggccctctcagccatcgcggtcgtctaccaggccgcggtgttcccggccatgccggcgggcgagcgctttaccgtcaaacagctgcccgagctgctcaagaatccgttcctggtcgcgctctacgcggtcacggtttttatggcgaccggctattacgcaagctacagctacattgagcctttcctggcgcaggtcgcacacgtcgacgcgggcgccatcaccatgacgctgacggcgtttggcttctccggtctggtgggcagctggctgtttggccgcctgttcgacgggcatcgcttcccgttcttggctatcacgctctccggcgtgccggtggctctgctgcttatgggtccggtcgcatcgtcgctcgtggcagtgcttgccgtctgcgcgctgtggggctgctgcgccacggcctttaacgtggcgttccaggccgagctcatcaagtacacgccggcggattcgtcggccgtcgccatgtcgatcttctcgggcctgttcaatctgggcatcggcacgggcgccgcaatcggcggtgccgtggtttcgggtcccggtatcgcttggattggcttcgtgggcggggcgattaccgtcgtgggcgtcatcctcgccatcaccgtgctgttcccagccatccgtcgcgccaagcccgtcgcctaatcacaacccaggagggtcggggtggctaaaagagccccgtcccaaattaactactctgctgggcatacaatggatgtcgttgtgttgagcttaccgggaggttgctatgtgggcatacgagacgacgttctaccaggtctatccgctgggcttttgcggagctccgcgcgaaaacgccgcgcccgttgctgaggatgagctcgcccaggctgccaacgacgcgcccaactccgatgcccccatcatgaagatcgcccagtgggccgactacctgcaaaaactcggtattggcgccgtgctcatcaacccgccgctcgagtctgatagtcacggctacgatacgcgcagtctgcgccatatcgaccgccgcctgggtggggatgccgactttgccgccgtatgcgacacgctgcatacccatggcatccgcgtggtgctcgatgctgtcttcaaccacgtcggccgcggtttttgggccttccgcgacgtgcaggagcgcaagtgggactcgccctacaaggactggttccacattagctttgacggtgactcgtgctacggcgacggcttttggtacgagggctgggagggccattttgagcttgtgaagctcaacctgcaaaaccctgccgtggtcgattacctgcttgagtccgtgcgtcgctggtccgaagtctttggcgtcgacggtctgcgcctggacgtcgcctatatgctcgatcgcgattttatgcgccgcctacacgcctttacccgcgagctcaagcccgacttcgtgctgatcggcgagacactccacggcgactacaaccagatcgtcaacgacgagatgctcgactcctgcaccaactacgagtgctacaagggcctgtactccagctttaactcggtcaacatgttcgagattgcccactcgcttcatcgccagtttggcggcgacccctggtgcatttatcgcggcaagcatctgctgtcgtttgtcgacaaccacgacgtgccgcgcctggcgagcatcctgacggacaagtcctgcctgcgccccgcctacggcatgctctttggtatgccgggcattccgtgcgtctactacggcagcgagtgggggattgccggcgaaaagggcggccccgatggcgattgggcgctacgtcctgcgctcgatgagcccgcgcccaacgagctgacggcatttgtcacgcagctggcgcacctgcgctcggcaaacgacgcggcagcccgtgccctcaactacggtgcctatcgcaacgtggtgatccagaacaagcagctgctgttcgagcgcgcctgcgacgatgcgacggtgctcgtggcggtcaatgccgtgaacgagccctacacctttggagctggcgaactcagcggctccttcgtcgacctgcttgccgacgatgcgcccacggtcgagctgtcgggtgcccttgagcttgcaccctacgaggtgcgttatctgctgagggcctaggccatggcagcgtctgacgagggctatcaacatattgagcatgggtttgagcccgtgttcgaccagcactcgcgcgttttggtgctcgggtcgtttccctcggtgctttcgcgcgccaatgccttttattacggcaaccctcagaatcgcttttggcgcgtgatggccgcgtgcctcggtgtgcccgtgccgcccaacgagggcgatcctttggcaagcggtgagcccgcgacgctcgatgcctcgattgccgccaagcgggccatgctgctcaacggcggtgtggccctgtgggacgtgatcgagagctgcgatattaagggttcgagtgacgccagcatcaaaaacgttgtgccggcacatatcgagcgcattaccgacgcggctcccattaagcaggtgatatgcaacggtggtacagctggccggctctacaagcgctatctacaagaacgcaccgggctgccggccatcgttctgccgtcgacaagtcccgccaatgcggcatggcgcctagagcgccttgttgggcgctggcgcgaggccgttgactggggcgctctgtaatttagatatctgattgggcgcgggtgccgaggcgtttcatgatggcatgccagatcggtgcgggcagcgcgggcttgacgcgcaccatgccgtcggcatcgacgcctccggcattgccaccgccaagcagctgcgcatgctcaatggagcagcccatgcgtacggcgcccacaagcttatccatcgcttccgaaaatggccgacgcaagagacccatgcgcggggagtggcgaagcgctgcgatgccggtgccggtgcagacgacaacgccgtcgcaccatggcaggtcacgtagaagacatgcccgatacaggcggtcgaggacttcgtccgtctgcttggcgttgttggacagggcctggacgacgacatagacgcgtgtttctgtattcccaaggcgatcgagtatctgctcgacagcgatcatagcctcatcgtcaaatgcatcatcaacagcgagcactatgccatcgactgcaccggcatcatccgccttcaagtcaaccgggtgggggagtacggtgtcggaaagccgggcataggcggcgatggcatcctgcaggtcccaaagcaaaaactcaagatcggtgctttcgggaatactgacaaacgcgatgttatgcagtgtttttggtacatcgccgcgcgcggtcgtctccatgccgcctcctttccggttggtttccgtttaggttacaccgtctggtggcgctccgccgcgctatcctagtgcaacccttacgaaaggaacgccatgcgtctgcccatgaatacctcgcttgccacgcttaagccctccggtatccgccggatcaacgcactcgccgcccagcatccggggtgcatcgcgcttgcgcttggcgagcccgattttcccacgcccgatgtgattagcgccgaggtgaccgccgcgctggaccgcggtgacacgcactatccgcccaacaacggtcgccccgccctgcgtgagacgttgtctgcctacatgggggatgcgggccttacgttttcggccgacgaggtcatcctgaccgacggcgcgaccgaggcactgtcggcaacattcattgctatgctcaaccccggcgatgaggtcattatccccacgccggcctttggcctgtacgagagcatcgtcgtggccaaccacgccaaagcggtctttttggatacggagcctgcgcaattccagattgacgaaaacgcacttcgcgcctgtgtgaccccggcgaccaaggccatcgttatctgctcgcccaacaatcccacgggctgcattcttaacgcggcatcgctcgacgccgtggcgcgcgtagcagaacagtcgggcatctacgtggtctgcgacgacgtatacagccgcctagtctatgtggatggctatgagcgttttgcccagcgccacccggagctacgcgagcagacggtggtcatcgagagcttttccaagccctgggctatgaccggttggcgcctgggctggctcgcagcggcaacccccgtcatcgccgagatcgcaaaggcccaccaatacttagtatcgagcgccgtctccttcgaaatggacgctgcagcccgagccctcaccgtcgacccaacccccatgctcaaagtctaccgagcccgccgcgagcgcgtactcgaagccttaaacgccatgggcctcgacgtagtagagcccgcaggagccttctatactttcccgagcatcaaaaagttcggcctaaccagcgaagacttctgcatcaaagccatcaaagaagcaaacgtagccctagtcccgggagactgcttcggaaccgaaggccacatccgcctcagctactgcgtttccgacaaagacctggacgaaggtctccgccgcctgtccaccttcatttcaaccttgtagccatcagggacgcaacatatcagcccaccgacttaaggcttatgagtgggggcgtcggccaacgggaaaccgggctgccccaaagtcaccgcaggccgcgccgccgaaggccaggcgcaaggttttcgtagattccgcacgagccgaagagcacttaatgtgctcttcgtgcgagcccaggacctgaccgagcgaaaaccttgcgcctggccttcggcggcgcggccggatggtggaattgtgtgcagcccggtttcccgttgaccgacgccggggtccccgccataatactttcggttcacgcacgaatccgctgccagagacagccggcgcaaacgggtcttacccgcgagcttaatgggatatcccgccagccgaggtggtcgagtagatatgtcttctcgcccccgtcgctcatgcagcgcgggggctttctttttggacatgcccccgtcacgtccttgtggcggaccgtgcccggaaagaattcgaggaggtgtaattcatgccccagcagtacaaaatcgacaaggttgcagagatcgagtcccgtatcgccgagaacgccggtctgttcgtcgtcaactacaacggtctgacggttaagcaggctcaggagctgcgtcatcagcttcgcgagtgcggcgccgagatgaaggtctacaagaacaacctggtcaagatcgctctcaagaaccaggagcagcccgagctcgacgagattctcgccggccccgtcgcttatgtgttctacgagtccgagccggtcgaggccgctaaggcccttaaggacttctccgctaagtccaagggcgtccttgagatcaagggcggtatctccgacggcaaggccgtttccgctgatgatgttaaggctatcgccgagctgcccaccaaggatcagcttctcggccagatcgccggtctcatctccggtttcgctcgcgacatcgctgtctgcgtcaacggcgtttcctctggtctcgctcgttcgatccagcaggtctccgagcagaaggcagcctagtcgctgttttcacccgcggcggcaacgccgcacccctggcgcattcgcgccgtgttttaactgatctccgtgcattcgcacggaaaccgaaaggacttagaaatggctaagcttaccaccgatgagatcatcgatgctcttaaggaaatgacccttctcgaggcttccgagctcgttaaggctatcgaggacaccttcggcgtttccgccgctgctcctgccgctgttgtcgccgctcccgctgctggcgctgctgaggccgaggagaagaccgagtttgacgtcgtgctcgagggcttcggcgacaacaagatccaggtcatcaaggccgtccgtgagctcaccaaccttggcctgaaggaggccaaggaggtcgtcgagggcgctcccaaggctgttctcgagggtgccaagaaggaggacgccgaggctgccaaggagaagctcgaggctgctggcgctgctgtcaccctcaagtaatcaggctttctcgccagatttctttgcagacggggttcgcattgcgagccccgtcttttttgtttttcggtccctcgacatcggttgctcaaactgccatgttctgtaatttgcgtcgtatcgggcaccctgccgttgggcaataaaattgcaccattcgagcaataatttgcgttgacctgctgaagaattgtctctgccttgtagcgacatatagttccagcggtaagatgcttgggtatcgcaatttggtctgcggccgccgtgccgcgcgcacagggcgcatcttgcgcctgcgaaaggatctttgaataacatgaaagcaatcatccccgccgccggtcttggcacgcgttttctgcctggcaccaagtgcacgcccaaagagatgctgccggtgctcgacaagcccgtcatccagtacgtcgtcgaggaggcgctcgatcccgaggaggtcgacgatgccatcatcgttacttctcccggtaagcccgagctactgaactacttccagcccgatcgctcgctcgagaacctgctgcgcgagcgcggcaagaacgcctatgccgacgccgtcgcccacgctggcggtatgccggtcgacttccgttatcagtacgagcccaagggcctcggccatgctattcgctctgccgccgacgccgtggcaggggagaacttcctggttcttctgggcgactacgttgtgcctaaccgcgacatctgcgacaagatgctcgccgtttccaaggagcacggtggcgcttcggttatcgccgtcgctgcttgctcgcccgaggaagtcagccgctacggcgttatcgccggtgagcgcgtcggttcgctcgagggtgccgaggacgttgccgatgcagagccgggcgctgtctggcgcatcggcggtctggtcgagaagcccgctcccgaggcggctccgtccaatctgtacatcgtcggtcgctacctgctgagcccgctggtcatggacctgctggcagatcagcaggccggcaagggcggcgagatccagctcaccgacgccatggcccgttcgctcgaccgcgaggccatgtatgccgtcgtcattgacccgctgtcgggctacgacaccggcactccctctggctggatggccaccaacgccctcatggccgcaagcgacccccgctttgccgatgccttctgggatgccatcgacgagcgcggcggattgatgcgcaagtaagccttcgggcatcgacatttacgggcgcggacctcggttcgcgcccgttttttataagagctgcgattgccggctctctgttcacagaaaatatatgaacagatgttcgatacacatacatctacctgcgtgttttctgtcgaaaaactttgctactccaaaaactcaatcgcgtcaaggcttttcttgcccaacggtcggtacctgataaactattaggttgcgataactggcgaagctatgcctcgccaacccaccgagcatttccgtgaaggaggaaaaacctggtgacctacgcatacactgccactgagcgcaagcgcgtcagcttcgggaaaatcccggaggccatggagctccccaaccttatctctgttcaaagggaatcctttgagcgttttaaggacgagggccttcgtgaggcgttcaaggaatccagccccatccagagccagaaccatgttctcgaggttaccttcggcgagcatcagttcggcgaccccgcgcacaccgtcgaggagtgccgcgagaaggacatgacctatcaggccccgcttctgaccgacgtccgtctcaccaacaaggagaccggcgagatcaaggagcagctcgtctttatgggcgacttccccatgatgaccgatcagggcaccttcatcatcaacggtaccgagcgtatcgtcgtctcgcagctcgtccgttccccgggtgtgtactacagctccgagatggattcgggcaagcagatctacaaggcccagatcatcccgtcccgcggtgcctggctcgagtttgaggtcgacaagcgcgaccagctcatggtctccatcgaccgtaagcgcaagcagagcgccacgatgttcctgcgcgcccttggcatcgccgtcaccaacgatgacatcatcgagctgctcggcaactccgatgtgatcaagcgcaccctggagcgcgacaccgccctcactcgcgaggacgccctcatcgagatctaccgtcgtctgcgcccgggcgagcctcccaccgtggacgcttcccgcagcctgctcgagggcctgctcttcaacccgcagcgctacgatctggcccgcgtcggtcgttacaaggtcaacaagaagctcaacctcaccaccgaggaagaggtcacggtgctcaccgacgaggatatcgtcgcgacgctgcgctacctgctgtccctcgctgtcggcgagcagggcttcaaggtcgatgacatcgaccactttggcaaccgccgcatccgcaccgtcggcgagctcgtcgccaaccagttccgtatcggcatgagccgtatggagcgcgtcgtccgtgagcgcatgagctcccaggacatcgacgagatcaccccgcagtcgctcatcaacatccgcccgatcgtggcctccatcaaggagttcttcggttcctcgcagctctcgcagttcatggaccaggcgaaccccctgaccggtctgacccacaagcgccgcctgtccgcactcggccctggcggtcttgccggccacaagtccggctccagccgccgcaccaacgtgccgacggccgtccgcgacgttcacaactcgcactacagccgcatgtgcccgatcgagacccccgaaggccccaacatcggcctgatcggctcgctcgccctctacgcccgcgtcaacgagtacggcttcatcgaggctccgttccgtcgcgtcgagaacggcgttgccaccgaccagatcgactggatgaccgctgacgaggaagagaagcacgtcatcgcgccggctaacacgccgctcgatcccaagaccaacgagttcatcacgaccgatgccgagggcaagcttgtccgcccgcacaccgtgatcgcccgtacccgcgacttcgacggctccttcggcgctcccgccgacgtgcccgtcgaggacgtcgactacatggacgtctcgccgcgtcagatgctctccgtcgcagccacgctgatcccgttcctcgagcacgacgacgccaagcgtacgctgatgggtgccaacatgcagcgtcaggccgtgccgctggttcaccctgccgctccctatgtcggtaccggcatggagcgtcgcgccgccctggactccggcgaggtcaccctggccaagaacgccggcgaggtcatctatgccgacgcctccaagattatcgtcaagcatgccggcggcatggacgagtatcacctggccaagtaccagcgctccaaccagtccacctgcatcaaccaccgtccgctcgtgcgcgtcggtgacaccgttgagcagggcgagcctctggccgacggtccttcgaccgatcatggcgagctcgcactgggccagaacctcaccgtggcatacatgccgtgggaaggcttcaactacgaggacggtatcgtcgtgtctgagcgcctggtggccgaggacctgctgacgaccatcaatatcacccgtcacgagatcgacgcccgcgacaccaagctcggtcccgaggagatcactcgcgagatcccgaacctctccgaggacatgcttgccaacctcgacgaggacggcatcatccgcatcggcgccgaggtcggccctggcgacatcctggtcggcaaggtcacgcctaagggcgagagcgctctgaccgccgaggagcgcctgctgcgcgccatcttcggtgccaaggctcacgatgttcgcgacacctcccttaagatgcctcacggcgcttatggccgcgtcatcgacgtcgtccgctttagccgcgagaacggcgacgacctggcccccggcgttaacgagcaggtgcgcgtctacgtcgcccagcgtcgtaagatccagcagggcgataagatcgccggccgccacggcaacaagggtgttatctgtaacgttctgccggtcgaggacatgccctacatggctgacggtaccccgatcgacgttatcctcaacccgctgggcgttccttcgcgtatgaacgtcggccagctgctcgagtgccaccttggctgggctgctgcctgcggttgggataccgaggatgccgactccgacaagtatgtccccggtccgttcttcgtctcgacgcccgtcttcgacggcgccaaggaggacgagatcgccgaggtcatccgtcgcgccaacaagaacatgctcaacaaggccaccgctgcctttggcgatcacatgcgccccgagtttgtcacccagcttgacgagcgcggcaagacccgcctgttcgacggccgcaccggcgaggagttccgcgagcccattaccgtgggtacgtcctacatcctcaagctcggccacatggttgacgacaagatccacgcccgttcgaccggcccttacagcctggttacccagcaaccgctgggcggcaaggctcagttcggcggccagcgcttcggcgagatggaagtttgggcactgtacgcatacggtgcttccaacgtcctgcaggagatcctgaccgtcaagtccgacgataccgtgggccgcgtcaagacttacgagtccatcgtcaagggcgagaacgtcccggttccgggtatccccgagtccttcaaggttctcgtcaaggagatccgttccctcgcactggacatcgagcccatgcacgatgccgacgaggacgcctccgcccctgtgaccgccgaggagacctctgctctcgacgacctggctgcgctcgccggcgttgacgccgacgtcgaggcccaggatgccgagaccgccgaggcacccgaggctgtcgccgccacgaccactgataaggagtagttgactgtggcagatttcgaagctactgattttgactcggtaaagatctcccttgcctccgccgaccagatccgttcctggtcgcacggtgaggtcaagaagccggagaccattaattaccgtaccctcaagcccgagaaggacggcctgttctgcgagaagatcttcggtcccgccaaggactgggagtgctcctgcggcaagtacaagggcatccgctttaagggcatcgtctgcgagcgctgcggcgtcgaggtcacctcggccaaggtgcgtcgcgaccgcatgggccacatcgagctcgccgctcccgtgtcccacatctggtacttcaagagccccacgagcttcccgatgagccgtatgctcgacatcaagtccaaggacctcgagaaggttctgtactttgccagctacatcatcaccgaggttgactacgaggctcgcgaggccgatgccgatgacctgcgcgaggagctcgccgccgatctggaagagatcgatgctgagtgcgcccgccagatcgagtccctcaaggagcagggcgaccccgagaacttcgacgagttctccgacgaggagccgctgacccccgaggagatcgcctctggcatcgtcgacatcgaggaagagtgcaaggacgagaagcagctccgcacggacgccttcaacgccttcatgaagctcagcgagcgcgacctcatttccgatgagccgctgttccgcgagatgacccgctactactccatgtacttcaagggtggcatgggtgccgaggccgtccgcgacctgctcgctgccatcgacctcccctccgaggccgagaagctcaaggccatcatcgccgacgaggactcccagaagcagaagcgcgagaaggccgttaagcgcctcgaggtcgttgacgccttcctgaagggcggtaacagccccgcgaatatgattctggacgtcattccggtcattccgcccgatctgcgcccgatggtccagctcgacggtggccgcttcgccgcgtccgacctcaacgacctgtaccgtcgcgtgatcaaccgtaacaaccgactcaagcgcctgctcgacctggacgcccccgcgatcatcgtgaacaacgagaagcgcatgctccaggagtccgtggacgccctgttcgacaacggccgtcgtggtcgcccggtctctggccgtggcggtcgcccgctcaagtcgctcgccgaggcgctcaagggcaagcagggtcgtttccgtcagaacctgctgggtaagcgtgtcgactactccggccgttcggtcatcgttaccgaccctaagctgctgctgcaccagtgcggtctgcccaagaccatggcgctggagctcttcaagcccttcgtcatgaagcgcctggtcgagcttggcaaggtcgagaacatcaagggcgccaagcgcgctatcgaccgtggtgccacctttgtgtgggacatcctcgaagaggtcatcgacggccgcgtcgtgctgctcaaccgtgcaccgaccctgcaccgtctgtctatccaggcctttgagccggtgctggtcgagggcaaggctatccacctgcacccgctggtctgctcgcccttcaacgccgacttcgacggcgaccagatgtctgtccacgtgccgctgtccagccaggctcaggccgaggcccgcgtgctcatgctctctgcgaacaacctgcgctcgccggcatccggcaagccggtcaacatcccctcgcaggacatgatcatcggtgtgtactacctcacccaggttcgcgagggtctgccgggcgagaaccacgtgttctcgagcttcgacgacgcgctgcacgcctatgactgccgctccgaggtcgacatgcaggccaagatccaggtccgcgtgtccgctgccgatgccaacgtcatcaacgaggacggcacccgtatcttccgcgtcaagaacggcaagaacgagtttgtcgactacgacgttaccggcaacaagaccgcgcgcttcgagacctctatcggccgcatcatcttcaaccgccagtgcctgcccgaagactatgagttcatgaactacaagatggtcaagggcgacgtggccaaactggttgcggactgctgcgatcgttaccccgaggccaaggtcggcccgatcctcgacgccatcaagtactccggcttccactacgctacccgcgccggcctcaccatctcggtgtgggacgctctcatccctgccgagaagcaggagctgctcgatcgcgcccaggccaacgtcgaccagatcaacgagtacttcgaggagggcttcatcaacgagacggagcgccacatcgaagtcgttaacgagtggaccgcttgtaccgataaggtcgcagcgctcatgctcgacatgttcgacgaggagaacccgctgtacatgatggccgactccggcgcccgtggttctaagacccagctgcgtcagctcggcggcatgcgtggcctgatggcagacatgtccggcgagacgatcgaccttcccattaaggcgaacttccgcgagggtctgctgccgctcgagtacttcatttcgacctacggcgcccgtaagggcctggtcgataccgcatcccacacctcggactctggttatctgacccgtcgtctggtcgatgtggcccaggacgtcattgtccgcgaggaggactgcggtacgcacgagggcgtcacctacaacctcatcatccccggcaccaccgacctcaacaccgacctcaacaccgacctcgtcggccgttgcttcattgaggacgtcgtggcccccgatggcaccgtgctctttgagcaggacggctacatcgagaaggtcgccgacatccagaagatggtcgatgcgggccttaagaaggtcaagcttcgcgcgctgctcacctgccgctccaagtacggcgtgtgccagaagtgctacggctgggatctttccacccgtcgtccggtcgctatcggtactgccgtcggcattattgccgcccagtccatcggcgagcccggtacgcagcttacgatgcgtaccattcactccggcggcgtcgctggcgtcgacgatattacgcagggtctgcctacggtcagccgtatgttcgatatcgtcggcaacgtcaacgagaagatcctgggccgcgaggccgagctggctccgtactccggtcacctctcgattaagcccgagaagtccgagtacgtgctgacgctcaccgactccgaggatcacacccgtgtcctcgacgagcgtcgcgtccccgcttcggtgcgcttcatgcctgagatcgaggacggctgcgaggttcgcgccggcgaccagatcaccaagggcttcgtcaacttccgcaacctgcgcaagctgaccgacatcgagtcgacgatgcacaccttcgtcgagagcgtaaaggacgtctacaccagccagggcgtcgacctgaacgacaagcacatcgaggtgctcgcacgtcagatgctgcgtcgcgttcagatcactaaccccggcgactccaagtacctgcttggtcagtacgtcgaccgctacgagttcgccgacgaggtcgagcgcgttgcccgtctgggtggtcaggctcctgtggccgagcccgtcatcctgggtacgctcaaggtcgcgtccaacatcgactcctggctgtcgagcgcttcgttcatccgtaccgccggcgtccttaccgaggctgctattgagggcaaggtcgaccacctgctcgaccttaagtccaacgtcatcgtcggtaagaagatcccggctggtaccggcctcaagccgtacgccaacgccaagctgacgtatcgcacggccgacggctacgtggacatcgacggcccggcttcgcccaacgccaagtcgctgcccgagtgggctcctgtggagctcaaggacctggacgagcagctcccgcagcagctcgactgggccggctacgacgagttcggtggtgctgacggttcgttcacccgcaacggccacaccatctccgccgagaaggctcgcctgtacctgttcgacgacctgggcgtgtcgcagcgctggaccaacaagttcagcgaggtcggcatcgagacggtcggcgacctggtcggcaagtccgaggaggatctgctgcgcatcgatggcatcggtgccaaggcgatcgaggagctccgtgacggcctcgaggcccacgacctgctctacatcctcgagaacaacgacgacgttgccgacgaggaagacctctcgcagctgctgcagatggtctttagccccgacggtccggacgacatcctgctgggcacctccgccacgccgacgcatcacgccgacgccgacgaggagctcctgggcgccccgatcgacgacaagaaggctcccgccaacggcgcgatcaacgaggacatggcgtccctcgacgagctgctcaaccagctcgtggacaccgacgacgccgaagaggcaaaggacaacgacgaggagtaatttcctagtacgttaaccgtccttccaaagacccgtttcccaacagggaagcgggtctttttgttaaagaaaacctgccaaaaagggacaggtatattttggtaggtttttcctgcttgaatttgaaacatttcgcccgacaagagcgtatctaaggtgagggcctcaccaagaattattaacgtcaccgggaggtgattatggaagaacaagcatttagacaggcggtcgaggatcaccgtgatgtcgtgtttcgaatcgcattgacgtacctgcgcgatcgtgccgatgccgacgatattgcccaggatgtctttcttaagttgcttaaaagcgatggacactttgaaagttgggaacatcttcgccgctggcttatccgggtcacgatcaatgaatgtaaatcgctctttcgaaagccatggaggcgtgtggaggatattgagaacctggccgattcgctttcggcggcgcaggatgagaccaaggcggtcctgtcagacgttatgcgacttccggagcgattccgcgttcccatcgtgctctattactatctgggcttttcgacctcagagattgccgagttgttgcatgtaccagccgcgaccgttcgaacgcgtttggctcgcggcaggtcgaagctcaagttcatcctagaggagggcgaccgtgaaatccaatcaaatcaagcaggccttcgagtccatccaagccgatagcaatcttgcagatcgcgttcttaatactgctgcgggtgagccgcttcatcgaaagggccatgcgaagcctctctatgttgccgtaatcgggtgtcttgtcggagtgttggcgaccggaggggtcgcctacgcagttatcaattccagctattttgcctcagcctggggaaaccacggcaacggggattccattacctggaccaacggcggctcatcggggactcaatatacctacaccagagagttcggtgacggcatcgcgccccaaagcctggagggcacagtccagaaggttgatctgtccgtcgagggtaatggctatacgctcgatatccatgagatggctattgaccaaaacggctgcggagccgtgacgtttacgttgtccaatccaaatggcgttaactactacaagccggcagcagagacaggcgaacttgttctctatggtgaagaagaacaaggcatcggcacgcccagcatgaacttcggcgaggaatgggctgacacacgctgcaccattgataaggacacatcaagcgccacggtcattaatggcacgatgtactttgcctctatggatcgcgagcgaggttttcaacatgcggtcacctggaatatctcgtggaccgagggcgaaggcgaggatgcgaagccgttcgaggcatcgacgcccgagtttagcgttggagcttacgtcgatacaaaggaactccgctccgatgactcgcctctcgagatcagcccgttttctatccagacacacatcgatgatctgggcattgatgcagttgataataagctgaccgtcagctacaaggatggatcggagcagattatcgaagatgacgacgcaggggtgttcaacttatatttttcttatgcgcgcaatagcggagagaacatctggctgccaacgaagttgatcgatgtcgaccaagtggtctcagtaacgcttgagggcacgaggtacacgtcaacaggagagaccgaaacggaagagtcctttactatcgtctattcgtaaggtctgaggccgcttcctactaggggaagcggcctcttttgcgttaaatggaaacgccgccgatttccatgcgacagatgagagcagattaccgctggagcgcgacgtttccccagataaaaccgatcaaaataaacctgtccctttttggcaggtaacgttgccccgacgagcacatcggattcccggtccgggcggcccgctgtttaagtttgtcgcgagttccgcacgcaaaggaaagcacttaatgtgctttccgtcttgcgcaggactgtagagcagcaaacttaaacagcgggccgcccggaccgggaatccgcccccgcgcacagaaggggattccttttgtgtaggctttgcggaaatatgctcattttgggatacgcccggcggcgtggtctgttgacggcacagctaacgccacgtatcctatcgaactgcgtgtttcgtagggggatgctgacccctcgattcaagccgttgcactttacagaaagctggaatcattcgagaaggagtacgctttgcctactattaaccagctggttcgccagggccgtcgttccgtgcccaagaagtccaagaacgctgctctgcagcacaactcccagaagcgcggcgtgtgcacccgcgtcttcaccacgagccctaagaagccgaactcggctcttcgtaaggttgcccgtgttcgccttgtcaacggcatcgaagttactgcttacatcccgggtgagggccacaacctgcaggagcactccatcgtgctcgtccgcggcggtcgtgtccgtgacctccctggtgtccgttatcacgtcatccgtggcgcctacgacgctgctccggtccagaaccgtatgcaggcccgttccaagtacggtgctaagcgccccaaggctaaataagccagataacgttttgatactttcgccgtgtgccgcctaagggccgcacggtagacacttaaggagatttcacatgccgcgtcgtgcagcagctaatcgtcgtgaggttcagcctgacgccgtttacaacaaccgcctggtgactcagctcatcaacaaggtccttcttgacggcaagaaggccaccgctgagcgcatcgtttacaccgctttcgagatcgttgccgagaagtccgagggtggcgacgctctcgctaccttcaagaaggctatggacaacgtcaagcccacgctcgaggttaagcccaagcgtgtcggtggcgctacctatcaggtcccgatggaggtcaactcccgtcgttccaccgctctgggcatccgctggatcgtcaacttctcccgcgctcgcaaggagaagaccatggccgagcgtctcgccaacgagatcctcgacgcctccaacggcctgggcgcttccgtcaagaagcgtgaggacgtcttcaagatggccgaggccaaccgcgcgttctctcactatcgttggtaagttaaggtaaggaactaacatggctaagcctaagtacaagctttccgatacccgtaacatcggcatcatggctcacatcgatgccggtaagaccaccacgaccgagcgtattctttactacaccggtaagacccacaagatcggtgaggtccatgagggcgctgccaccatggactggatggttcaggagcaggagcgcggcgtaaccattacctccgctgctaccacctgcttctggaacaaggacggtaaggactaccgcatccagatcatcgacaccccgggccacgttgacttcaccgccgaggtcgagcgctgcctgcgcgtcctcgatggcgctgtcgccgtcttcgacgctgttgccggcgttcagccccagtctgagaccgtttggcgtcaggcttctaccttcaacgtcccccgcatcgccttcatcaacaagtatgaccgcgtgggcgctgacttcttcaacgctatcgagaccatgaaggatcgtctcgacgccaacgccgtggccgctcaggtcccgatgggcgccgaggacaacttctggggcgtcatcgacctggtcaccatgactgcatgggacttcaaggccgacgagaagggtatgacctaccccgagccgatggacgagatcccggctgagtttgccgacatcgctgccaccaagcgcgaggagctcctcgacgctgctgccagctttgacgacgagctcatggagaagatcctcatggaggaggacttcaccgtcgaggagctcaaggctgctctgcgcaagggtgttctggccaacgagctcaacctcgtcttcgtgggctccgcctacaagaacaagggcgttcaggagctgctcgacgctgtcgtcgactacctgcccagcccgctcgacgtcgaggccgtcaccggtaccgatccggacaccggcgaggagatccagcgtcatccttccttcgacgagcccttctccggcctggtctttaagatcatgaccgacccgttcgtcggtaagctcacctatgtccgcgtttactccggccgcgctgagtccggctcctacgtggtcaacgcttccaacggtcagcgcgagcgtctcggccgcatcctcgagatgaacgccgccgagcgtatcgaccgtgacgacgctgccgccggcgacatcgtcgcttgcgtcggcttcaagaactccaccaccggtgacaccctgtgcgccgagggcaaggagatcgtcctcgagaagatcgagttcgctaagcccgttatcgacgttgccatcgagcccaagaccaaggccgagcaggacaagatgtccctggctctgaccaagctcgccgaggaggacccgaccttccaggtgtccaccaaccacgagaccggccagaccatcatcgccggcatgggcgagctgcacctcgagatcatcgtcgaccgtctgctccgcgagttcaaggttgacgctaacgttggtaagccccaggttgcctaccgcgagaccgctggtcacgacgtcgagaaggctgagggcaagttcgtccgccagtccggcggtcgcggtcagtacggccacgccgtcatcaagctcgagaagatggaggagggcttcggctacgagttcgtcaacgctatcgtcggcggcgtcgtgcccaaggagtacatcccgtccatcgacaagggcatccaggaggccctgaacaccggtgttatcgccggcttcccggtcctcgacgtcaaggtcaccctgttcgacggttcttaccacgaggtcgactcctccgaggccgccttcaagatcgccggttccatggctatcaaggacgccctcaagaagtccgatccgcagctgctcgagccgatcatggctgtcgaggtcgagacccccgagcagtacatgggcgacgttatgggcaacctctccggtcgccgcggcaagatcgagggtatggaggatcgcaagaacagcaagctcatccgtgccaaggtgccgctgggcgagatgttcggttacgctaccgaccttcgctcccagacccagggccgtgcatcctacacgatgcagttcgactcttatgagcctgcgcccaagtccatcgtggacgaggtcatgagcaagaacgcctaagttcgagctccctgttacgtaatcctgcgagaacatctctcgcactctttggaggtttaagttggctacccagaagatccgcattcgcctcaagggctatgatcacgaggtcgtcgatcagtccgcgaagctcatcgtcgagaccgctcagaagaccggcgctcgcgtttccggtcctgtccccctgcccaccgagcgcaacctgtacacggttatccgctcgccgcacgtgaacaaggactcccgtgagcagttcgagatgcgcacccacaagcgcctcatcgacatcctcgaccccacctcgggcaccgttgattcgctcatgcgtctcgacctccccgctggcgtcgacatcgacatcaagctctaagcgatatcgctcatagcttaaagggccccgctgccgttacggtagcggggcccttttgttttgagtttagattttgggatagcgaattcgtctgccgagccggcggctgcggcgccctattcgctcagggggcgcaaggatgcttcttcgaagtggaagacgcacaagccgctctcggtctcaatgcatgcgcggccgcaatcgtcgaccgttctaaatatgcctcgtgccagctcgtctccagcgggggagcgggcgataacgtgcttcccgatccaattgaggtgagcgatatattcgtcgtggacgggcgcgagcggaccggcgttttcttccatggcgttgaggcgctctgcccaggtatctacagcgtctataactgcgtgatagacctcatcgaggagcatgtcgacggcgggaacgctctcgttgaggtccgagaggccaattgccgccaggccgccatcgggcacctcttggggcgtgtagtttacgttgacaccaatgccgcagacggcgaaaggtttgccttcgttatcgcgtgcggcctcgaccagaatgccgccgagcttgcgtcctcgcgcgaccaggtcgttgggccatttgagggctatttcgcttgcaaggccttgcttttcgagtgcttcgagcaccgctaggccgctgacggcggcaagaccagagtactttgcgggattaacgcatggacgcaggacaatcgaaagcaataggttgccggcggttgaatcccacttgtggccgcgccggccgcgtcctgccgtttgcgcgcgggcggcaagtcctgtgccgtgcggcgcaccctgttttcctgcctcgagcaggtcatcgttggtcgatccggttacgtcgacaatcgttaattgggcatccatagcggctgctacctccttattgaataagtgaatgacgcaatggtgtcgagagatagacacaatgtgaagcctttgtcgcatttggacaatttaatgttaacacgtcaacaaagactgaaatgcgttatcctctcttggtcgatgtaaacacgtcaacaactcaaaggaggttagtgatgggtttcacgattcttggaacaggctcggcgcttcctgaacgcagtgtttccaatgacgagctgtctgagttcctcgatacctcggatgagtggatttttacccgcacgggtatcaagagccgccacgtctgcaccaccgagtcacttgacgaccttgccgtagcggcgagtgagcgggcactccaggtgtccggaatcgacgcgagccagctggatctgatcgtctgctcgacgacgacgggtgaccaccttgttcccgctgaggcgtgtgccgttgctgagcgactaggcgcgacgtgccctgccttcgatgtctcggcggcttgtgccggcttcgtatttgcgctcgatgtcgccgagggctatatcgcccgcggtcgcgccgagcgcgtgcttgtcgttgctgccgagcagatgacgcgcgcgctcgactggaccgaccgtgccacctgcgtgctctttggcgatggggcaggcgccgcagtgattgaggctgggggagacagtccccttgccgttgagctttcgacggcgcccgacgtcgagacgttgcgcgttcccggtctggtcggtacctcgccgtttaaggcttccgcagatagcgcgagcgtgctgtccatgaatggccgccgcgtgttcaagttcggcgtcaacgccatctgcgacacggtccataagcttgcgatcgatgcgggcattttggtcgaagacatcgatcattttgtattccatcaggctaacgaacgaatcctgagccaggcggtcaagcgcctgggcgtgccggacgagcgcgtggttcgcacgttgcgcgagaccggcaacatttcgagcgcatgcattccgcttgccctcgaccggctggcaaacgccggtgcacttcacacaggcgacaccatcgccttggttggatttggcgccggtctggatataggtggctatctgcttcgttggaagtagtcgcacataggaaataaaaacgccctagggcacaaccaaaggagaactaccatggcagatcagaagaccttcgagcgcgtttgcgacgttatccgcgagaccgccggtcttgacgatgtcgagatgaagcccgagtccacgctcgaggagattggtctcgacagcctgggcaccgtcgagatcctcgttgccgtcgaggacgagtttggcatccagctcgataccgaggagaaccccaagacggtcggcgagttcgccgatacggtcgaggcggcattggagaagtagagatgctcaagactcctctctgcgatctgctcggcatcgaaaagcccgtgttccagggcggtatggcctggattgccgatgcctcgctggcgtccgcagtgtccgaggcgggtggcttaggcatcatcgcggccatgaacgccgacgccaactggcttcgcgaccagattcatgagctgcgcgccaagacggataagccctttggcgtcaacgtcatgctcatgagcccgtttgccgacgaggtcgcgcaggtcgtgattgacgagcgagtgccggtcgtcgtgacgggcgccggcaatcccgccaagtacatgaaggcgtggaacgaggcgggcatcaaggtcatcccggtcgttgcctcggtggcgctggcgcgcctcgtggcacgtcgtggagccacggcggttgttgccgagggtaccgaatcgggcggccatattggcgagacctcgacgatggcactggtgccgcaggtcgtcgatgcggttgacattcccgtcgtggccgccggcggtattgccgacggccgcggcgtggcggccgcctttatgctgggcgccgaaggcgtgcaagtgggtacgcgctttctggtcgcagacgagtgcaccgtctcggagcagtacaaagagatggtcctgaaggccaacgacacttcaacgcgtgcgaccggtcgctcgacgggacatccagtgcgcgccctcaagagccccttcaccaacgcctatgccaagagcgagggtttcggcgcgagtgccgaggagctcggtgctatgggaaccggtgcgctgcgtaaggccgccaaggacggcaactacgaagagggttcgtttttgtgtggacagattgccggcatggtcaacgagcgccagagcgcacgcgaaatcgttgacgacctggtcgccggcgccgagcacgtcctgaagggtgcgtgcgcatgggtggcgtagcgtttttgtttgccggccagggtgcccagcaccccgcgatgggcgtcgacttgatcgagacatcgccggcggccgccgaggtgttcgccattgccgatgaggtgcgcccggggacgagcgagcagtgccggagcgcctccaaggaggagctctcgcagaccgagaacacgcagccttgcgtgttcgtgcacgacttggctgtcgccgtcgccctgcgcgagcgcggcgtggtgcctgccgcctgtgcgggattctcgctgggcgaggtcgctgcactcacctttgcgggggcattcgatacgcgagcgggttttgagctcgtgtgtgagcgcgcggcattgatggccacggcggccgagcgtcaccccggcggcatgcgcgccgtcatcaaacttgatgctgcgcaagtcgagaacctagctgcgcaggccggcgaggactgctggccggtcaactacaacagtccccagcagacggttgtggccggagcgcccgatgcgctgcagaccctcgacgtcctagtaaaagaggctggcggccgcgccatgaaggtcgcggtgtcgggtgcatttcatagcccctatatggccgaggcgacctgtggccttgcagcatatattgaggccggtcacgcgccgtccccgttgctcattcctgttttggcaaatatgacagcggcgccctatccggcggacccccagacggcatcggatgtcttggccaatcaggtgagccatgccgtgcgctgggtcgatacgctgcatgctctgcaggatcaaggcatcgacacatttattgaggtcggccccggcaaaacgctgtccggcctgatcaagcgtacgttgagcgacgttcgtgtgtattcgtgcgagacggccgagcaggtcgcagctattgccgacgagctcgcatggtccacagggctgtaacccgaaaggaatgacatgggcaacttgaacaacggcgcgctcgagcgcaacgactcacgtcgcgtggcactggtcacgggcggctcgcggggtatcggccgcgcctgcgctatcggtctggcggaggatggctacgatatcgccgtcgtctatgccggcagcgtcgatgcggcgcgcgagacgtgcgacgcctgcgaggcggctggcgccacggcgcgctcatatcaatgcgacgtggccgaccccgctgccgtcaacgcgtgcgtggaagcggtcctcaacgactttggctccatttgggcgctcgtcaacaacgctggcatcacccgcgatggcctgctcatgcgcatgggcgatgacgccttcgatcgcgtgctcgatgtcaatcttaaaggaacgtttaacacgacgcgcgcgctcaccaagacctttatgcgccagcgcggcggctgcgtcgtcaacatgagctcggtcgtgggcctgatgggcaatgctgggcaagccaactacgctgcctccaaggcgggcgtgatcggcctgaccaaggcggtggcgcgcgagcttgcgccccgcggcgtacgagtgaacgcggttgcccccgggtttgtcgagacggatatgacggcaaagctctcggagaaggtgcgtacggtaaccgaggagcagattccccttaagcgtatggcgcgtcccgaggaggtggccggcgtggtgcgctttttggcgagcgatgcggctgcctacattacgggtgaggtcgtgcgcgtcgacggcggaatggcgatgtagaaaccagggccgaagaacggcttggatgaggagaccatgatggaacagagagttgcaatcaccggtatcggtgccgtgtcgccgctcggcaacaccgcgcttgccacctgggcggcaatgtgtgctggcacgtgcggcatcggcccgatcacgcacttcgataccgatgcgtttgccgtcaaggtggcagccgaggtcaagggctttgacagcaacgagtactttggcaagcgtgacgccaagcatctcgacccctgcgttcagtttgcgatggcggcttcggacgaagccatgcacgatgcgggctttgatgtcgaaggcgccatcgatcgcgagcgcctgggcgtctacgtgggctcgggcgtgggcggcatgacgacgctcgtcgacaacgtccatacgattgccgaacgtgggccccgccgcgcatcgccctatatgatcgcgatgatgatccccaacatggcatcgggcaatatcgcaatccgccacaaggcaaagggcccgaccctgcccgtggtgaccgcgtgcgcaacctcggcccatgcggtgggcgaggcgttccgcgccatcaagcacggctatgccgacgcgatcctcgcgggcggcgccgaggctgcaattatccccgatgccgttgcgggctttacgtcctgccgcgcattgaccaccaaccccgatcccgcgacggcctgccgtccgttcgatgcagaccgcgacggctttgtgatgggcgagggcgcctgcgtgctggtactcgagagcatggaacatgcgcaggcgcgcggtgcgcacatttatgccgaggtcgtgggctacggcaacaccgatgatgcctatcacatcacgagtcctgatcccgaggctgccggcattgcccgcgcgatatcgctggcggtgaccgagggcgacgtcaagccttccgagggtctctacatcaatgcccacggcacatcgaccaagctcaacgattcgtccgagacgacgggcattaagcgtgcgctcggcgaggacgcggcgcgcgccgcgcacgtctcgtcgactaagtcgatgaccggccacatgatcggtgccacgggcgccatcgaggtcatggcctgcgccatggcgctcgagcagggcgtggtgccgccgaccattaactaccacacgcccgatcccgcctgcgatcttgactacacgcccaatcgcgcggttcgcgctgaccttacctgggcgctttcgaccaacctgggctttggcggacacaacgccgccatcgcgctgcgtagatatacgaggagctagagcatggattccaaaagacttgccgagatagccgatgttatggaggaccgcggcctcacgcgcgtacgcgttgaggagcccgatggcaccgcggtcgaactcgagcgcgcgagcgccgcacagccggttgccgtgcccatgcccatgccgagcgctatggccgctccagttgcagctcccacagtcgcgcctgccgcaccggagcccgccgcgcagacacctgccgccgcaccggagcccaagggcaccgaggtgaccgctcccatggtcggcgttttctatgctgccccggcgccgggcgacgagccgtttgtgcacgtgggctctaaggtcaaggccggcgagacgctctgcatcatcgaggccatgaaggttctcaacgaggtaacggcagaggcagacggcgaggtgctcgagatctgcgtggccgacggcgacctcgtggagtttggcagttgccttatgaggatcggataggtgatatccatgaacaaagaagagcttaaggaactgttgccgcatcgcgaaccgatgcttttgctcgacgaggccgagctggtgggcgacgaggcccacggcaagatcacgattacgggcgacgagtactttttgcaggggcattttccgggaaacccggtggtccccggcgtgattcagtgcgagatgctcgcccaaaactgttgcgtgctgctgatgggcgatgaggaagcgcgcggcgcgacgccgttctacacgagtctggacaaggtgcgctttaagcgtccggtgcgcccgggcgacacggttgatctggtgtgcaccatcacgcgtgcgcgcgggccgttccgctttgcgacgggtactgcgagcgtcaacggtgaggtttgctgccgcgccgatatgtcttttgcactcatgcacgaaagttaaggaaggcttcatgttcgacaaagtgctcatcgccaaccgcggcgaagtcgcggtccgtgttatccgcgcgtgccgcgatatgggcatcaagaccgtcgccgtttattccacggccgatgcggacgcgctgcacgtgcagcttgccgacgaggcgtattgcatcggcggtccgcgtcttgccgagagctacctcaacgacgatgctgtgctcacctgtgccgtaaagtcgggagctaaggcaattcatcctggctatggctttttctccgagaaggcgagcttcgtgcgcgactgcgacaagtatggcctggcgtttgttggtccttcggccaaggtgatcgacagcatgggcgacaaggacgccgcacgtcgaacggctgccgcggcgggcgtgcccatcgtgccgggctgcgatttgctcaaaagtcccgaggaggcaacggccgaggctgagcgcattggctgccccgtgcttattaaggcgcgtgcgggcggcggcggtcgcggtattcgtaaggtcgagcgcgtggaagatgcggcaaaggcctttattgaagcacgcgccgagggcgaggccgtttttggcgacggcgagtgctacatggagaagttcgtcgcgccggcgcatcacgttgaggtacagattatggccgataagcagggccatgtgttttcgctcggcgagcgcgagtgctcggtgcagcggcgcaaccaaaagctaatcgaggagagccccgcgccgtgcctcgacggacacgacgacattcgtgctcgcatgcacaaggcagcgcgtgacctggctcgtgccgtcggctacgaaggagccggtaccatcgagttcctgtattcggacgacggcaatttctactttatggaaatgaacacgcgcttgcaggtggagcatccggttacggagtttgtgaccgataccgacttggtcaagtggcagctgcgcgtggcagccggccagcctctgccctttgagcaggaggacatgccggtccgcaaccacgccatggagtgccgcatcaatgccgaaacgccggattttctgccgtcatgcggaacggtcaccgcgttgcgtgtgccgggtggtccgcgcgtgcgctgggattccgccatgtttaccggtgctaaagttccgccgtactacgactccatgcttggcaagctcatcgtgtgtgcgcccacgcgtgacggcgccattcgcaagatgcgctcggccctgggcgagctcgtgattgagggcgtgagcgaaaacagcgagcttcagctcgacgtgctggcaaacgacgagttcttgtcgggcatgtatcacaccgatctgatggggcatctctatgctgatgaatagaaaagcgaagacggtcaacgtcctcgagggaccgatgaccgagtcgtgcgccgagtttcccgcgcgccacgtgtttatcaagtgcccggagtgccgccgcgtgatcgatgaggcgcgcctgcacgacaacctcgaggtctgccctcgttgcggcaaacactttcgcgtgagcgggcgcgaccgcatgcgcatgacgattgacgagggcacgtttgaggaatgggatgccagtctggcgccggaggacttcctctcgtttcccggctatgccgacaagctcaagagcgtgagcgagcgttcgggcgagcacgatgccgttgtgtgcggcaggggcaaaatctgcggttgcgataccgcgctcttctttatggacgccaactttatgatgggctcgatgggttccgtggtgggcgagaagatctgtcgcacatttgagcgagcgaccgagcttggattgccagttgtcggctttaccgtttcgggcggtgcgcgcatgcaagagggcgtgacatcgcttatgcagatggccaagatttctgcggcggttaggcgccacagcgaggcgggcggcctgtatatcacggtgctcaccgaccccacgaccggaggcgtaaccgcgagctttgccatggagggcgatattatcctggccgagcccgatgccctgacggcatttgccggcccgcgcgtgatcgagcagaacatgcacaagcgcctgcccaagggattccagcgctccgagtttttgctggagcacggcttttgcgatgccgttgttccgcgtggcgagattgcgctcacggtaggcgagctgctggcgctgcacgaagggcacgcgcccggcctgggggcaccgcatgagatcgtgcatacgggtcgccgcggcaaaaagctgggacacttgttcaagcgctcggccgcaccaaaaaccgcgctcgagattgtcaagcagacccgctcggcagatcgcgccacggcaggcgagatgatctcgctgggcctggatggatttgtggagctgcacggcgaccgctactttggcgacgacgctgctgtggtggctggcattggctggaaagacggacgccccgtaacggtcatcgccatcgagcgcggcaccacgaccaaagagcgcatgcgtcgcaactttggtatggcacatcccgagggctaccgcaaagcgcgtcgcctgatgcgccaggccgaaaagtttggtcgaccggttctgtgcctggtcgatacttcgggcgcgttttgcggcatcggtgccgaggaacgcggtcagggcgaggccatcgcccagaatctcatggagatgagcggccttaagacgccgattgtctcggtggtgacaggcgagggcggctctggtggcgcgctggcgctgtccgtggccgaccgcatcctgatgctctcgagctcggcctattcggtcgtgagccccgaggcctgtgcgtcgatcctgtggaaggataccgagcgtgcggatgaggccgccgaggcgcttaagctcacggcccccgatctgctggcgctcggcatcatcgacggcattgttgacgataagggcctgtcgcatgaggagatcgccggtgccgtcatgtcctcggcatttgatgccttcgatacgcttgggcagctcgacgacgcgaccctcacaaacctccgctacgaaaagtaccgcgcaatcggtcgataccgcacgatgtgacaaagggacagcccgcatgtcatattgggaaaggcgttccatgctacaagtttctaacacctcgtttacaacgtcggtttcatcaaacgccatggccgtggtggactatctgtccaaaagcatgatgtcggcgctgccgtttattgtctgcgcggcgttgttccgcaccgtcgctgtcattatgggcgaaggcatgctgggcctgtggtctgccgattccgatatctatcgcctgttctacagttggctctataacgccggctactactttttgcccatttatcttggttgggcggccgcccgccagctcggttgctcggagcagctgggcatgatgctgggcggcgtattgattgcacccgatttactcaagcttgtcgatgccgcatcgacgacggggggcatcgatgacttccgtgtatggtctgcttcctgcgccggtcaacgattacacgacgactgttattccggttctcatctcggtgcccgtgctatggcgagtggagtgtttctttaagcgcgttatccctaaggccgtggcgttttcgtttgttccgtttgcgaccttgcttgtcatggttccggtttcgctgtgcattacggcgccggcgggcagctatctgggcatgctgttgggccagcttatgtttatgcttggcaattccggtggcattgtgtcgctgctcacgctcatggggcttgccgcaggctgggagttcctaaagatcgcgggcgtcagcaacgtcgtcctatcgctcgcctatgcgcagtttatgagtgtgggaacggattcgtgcatcctgatcgccgcgacgatggcaacgttcgccgtttggggcatgccctttggcgcgtcgcttcgcgttgcggataaggacgagaaggcgctcatgctgggctattcgatctcgggtgtgcttggtggcgtaagcgagccggcgctgtacggttgcggctttaaatatggcaggtgcctgacgtgcatggccattggcggcgccgtcggaggccttgttgcggccgtgggccacgttacggcctataccatcggcatgacgaatgtcctcatggtcattggctttgccacgggcggcatctcgaacctgctgtggtgctgcgctgccggtggtgtagcattcgcgatgtctgcggcgctgagctactgctttggtgtggtgccgacgaaggggcagacgacgggggacggagccgattcgtccgaaacagtggcgagcgctgctgaggtaagcgcataaacctgtgcgacaaaaggacgattcctttgtcacattccaaggccgtggcccgtgtgggctgcggcctttttgtatcttgaggacaaagtggctacactacaatccgtttgagcaatagatatataggtagtaccgtgggggcggatgcagatggtcgagtggatagttaagcgcgcgcagggcgatcgtgcgcgtgtgggcacgttagcgggcatggtgtgtattgtcgccaatgtggcgctttgtgctgcgaagggcgcaattggtgtgctgtcgggatcggtttcgatcgtggcggatgccatgaacaacctgtccgatgctagttcgaatatcgtgagcgtgctgggctttaagctggcgagcaagccggccgaccccgagcatccttacggccacggtcgctatgagtatctctcgggattggtcgtggcggcgctcgtgctgctgattggcgttgagctggtgaagtcctcggttgagcgcgtcatccaccccgaacctgtcgagttctcgcttgccctggtggcagttctagcgctttcgatggtcgtaaagctctggatggcggccctcaaccaaaagctcggcgatcgcattgagtccgagacgctgcatgcgaccgcgcaagattccaagaacgatgttcttgccacgggcgccgtgctagcgtgcgcaattgtttcgcagatgacgcacatcaatcttgacgcatgggtcggccttgccgttggcgcctatattggctggagcggttttgaactcatccaggatacggtgagcccgcttttgggccagacgcccgatcctaagttggtcaagcacattcgagacaagatcatgagctaccccggcgttttgggcgttcacgatttgatggttcacgattacggtccgggcaggaagtttgcaagcgcacatgccgagatggcggccgaggccagcccgctggaaagtcacgacacgctcgataacatcgagcaggcgtttagggacgaggacggcatgatcgtcacgctccattacgatcccatcgtgaccgacgatccaaaggtggcgagcatgcgtttacgcattaacgccatggcccaacagatcgatagccgcctttcgattcacgatctgcgctgtgtgccgggtcctacgcacaccaacgtgatctttgactgcgtgcgtccctcggatatgggcatggacgccgaggacctgaagcacgcgttggcccagagggtcgaatcggaataccccaagtcgattgccaagattacgatcgacgaagactacgtaggacatacccacgagtagggctgtgccggcaaagcaagttatacagaaggggagagcatgaagcgtctatatctactccgccacggccagacggaattcaacgtcaaaaagctggtccagggccgctgcgactcaccgctcaccgacttaggccgtcagcaagccgggatggcagctacatggatcaaatctcacaacgtcgttcccgacaaagtggtctcttcacccttaggccgagccatggacacagctcggctcgtcgcaaccgaactccttggcccggacgcagcagtcgagccctgcgaaggcatcattgagcgctgctacggcaccttcgaagaaggcccccacgacgcattgcctaccgacgtctgggatccgggtgaggatttggtcccctttggaggagaagggaaccgcgcgctgcaagaacgcatggtaggcaccctcaccaatctcatgggagccgagggcatcgaaaccctcctagcagtaagccacggcagcgccagccgccaattcatcaaggctgcagccccagagggcttcgagctcccaacaaaactccccaactgcgccatcatgatcttcgattttgacgaggaaaaactacaagcagagggcgagccaatgcaatgcaagttcactctccagcaaatagtggacccccaacaaagaaattagctgagcgagcagagttaagcagacatcaacgtgtcgtctcccgagcttggcagaggggcggcgaaatatattaagtttgtcgcgagttccgcacgcaaaggaaagcacttaatgtgctttccgtcttgcgcaggactgtagagcagcaaacttaatatatttcgccgcccctctgccaagcccaggcgactccacgcactttacctgcgtaaacaatgtgagtgaaatatgaatctcgatggatacgcccgcagccgtgtatactaaacaactgtgtgtaaccaggggagtattctggctggacaaaatgcctgcttaatagggttgtcaggtagtccggacgcaatacaaggctggggagcacgtcgtgtaagtagtggtcctctaggggcgtacgctcggtggtgtacgcattgtcccaagaccacgcgagagttgggatcatatcttgatcagcatgattctcggccgcaagattggcatgacccaggtttgggacgaggacgacaacgtcgttcccgtcacggtcatccaggctggcccctgcgctgtctcgcaggttaaaactcaggcaaccgacggctatgacgccgtccagatcggtttcggcgacatcaaggccaagaacgtgaacaagcccatggctggtcacttcgccaaggctggcgtcgagcctgtccgtttccttcgtgaggtccgcgtcgagaacggcgaggagcacaaggtcggcgaggtcgtcaccgtcgctgatttcgctgatgtcgagaaggtcgacgtcatcggtacctccaagggtaagggcttccagggtcgcatcaagcgctggggtcagcgccgcggtcctatgacgcatggttctcacttccagcgtcaccccggttctatcggtcagtgcgcctatcctgcgcgcgtcctcaagggcgtcaagatggccggtcacatgggtaacgagcgcgttaccgtcaagaacctttccgttgtccgcatcgatgccgagcagaacctcatcttggtcaagggcgctgtcccgggtgccaagaatggtctcgtcgccatccgtatggcctaagggcccagcccatttagcccagcgtcataccaaggagaacacttaaatggcaaagtttgaagtaaagaacagcgagggcaagaaggtcgccgaggccgagctcgccgctgaggtgtacggcatcgagccgaacatccacgttatgcaccacatcgtcaagtgccagatggcctcttggcgtcagggcacccagtccgctaagggccgctctgaggtttccggtggcggcaagaagccttggcgtcagaagggcaccggccgtgcccgccagggttccatccgtgctgcccagtggcgtcacggtggcgttgtcttcgcccccaagccccgttcttacgctaagcgtatgaacaacaaggaggtcaagctggctatgcgctccgcgctgtccgccaagctggccgatggcgagctcgtgctcgtcgacgactacggcttcgagaagccttccaccaaggctgccgtcgccatgctcaaggctctcggccttgagggcaagcgtctgaccatcatcgttcgcgatgaggacgtcaacgcctacctgtcgttccgcaacattcccaagacgttcatcatcactgccgacgaggccaacacctacgatctcgtcaataacaacgctgtgctgatgcccgccgacatcgccgctcacttcggggaggtgcttgcataaatgaccgcccacgagatcatcatccgtccgatcgtgtccgagcgttccttctccggcatggagctgaacaagtacacgttcgaggtcgccaaggatgctaacaagtatcagatcaaggacgctgtcgaggagatcttcggcgtcaaggtcgttcgcgtgaacaccctgacggtcaagcccaagaccaagcgcgtgcgctatgtcgccggcaagacccgttcttggaagaaggccatcgtcacgctggccgagggcgacaccatcgaggtctttggcaaccaggcctaagactcgctgctgttgagtgagctcatgcctcccaaataggggaggcgagagctcaaggttttgggcgtataaaatggacacgcccggaaccgtgtatacgtccggtgtcatcgcacccgaggcagaacctcgaatccctgtctgcgatggctaacggattcctattgaaagggattgtaatggctgtaaagcaccttaagccgacctccgctggtaggcgttggcagacgatctccgatttctccgagatcacctgcaccaagcccgagaagtctcttctcgagcccctgcccaagaaggccggtcgtaacaacaacggccgcatcaccacccgccaccagggcggcggcgtgaagcgtcgttaccgcgtgatcgacttcaagcgcaacaaggacggcgtgcccgccaaggttgccacgatcgagtacgatccgaaccgttccgctcgcatcgctctgctgcactacgctgacggtgagaagcgctacatcctggcccccaagggcctcgaggtcggtcagaccatcatgtccggttctgacgccgacatcaagccgggcaacgctctgcccctcgccgacatccccgtcggtacgctcatccacgccgtcgagttccagccgggcaagggcgctgctatcgcccgttccgccggtaactcctgccagctgatgggtaaggagggcaagtacgctatcgtccgtatgccttcctccgagatgcgccgcatcctcgttacctgccgcgccaccgtcggtgaggtcggcaacgccgatcactccaacatcgtcatcggcaaggccggccgtaagcgtcacatgaacgtgcgcccgaccgtccgcggtaccgtcatgaaccctgtcgaccacccgcacggcggtggcgagggcaagaaccacacctctggtcgtccctccgttaccccctggggtaagccgacgaagggccttcgtacgcgcaagaagaagaaggtctcgaaccagcacatcattcgtcgccgtaagaagtaatttcggataccgagttttaggagaaagcacttatgagcagaagtctcaaaaagggcccgttcgtggagactcgccttctctcgcgtatcaccgcgatgaacgaggctggcaagaaggacgtcgtgaagacctggtcccgcgcgtccaccatcttccccgagatggttggtcacaccatcgccgtccacgacggccgcaagcatgtgcccgtgtatgttaccgagtccatggttggtcacaagctcggcgagttcgcgccgactcgtacgttccgtggccacaaggccaaatagggggttaaccgtaaatggcaactaagtctattgaaactgaggccaccgaggttcgcgccgtcgctaagtacgtgcgtgtttcccccagcaaggcccgcctggtggtcgatctgatccgccgcaagcctgtcgctcaggccttcgacatcctccacttctgcgaccgcgccgtcgccgtggatgtcgagaaggttctccgttccgccgttgcgaacgccgagaacaacaacggtctgcgtgccgacaacctggttgtcgccgctgcctatgttgacgagggtccgacgcttaagcgcatccgtccccgcgccaagggttccgcttctcgcattctgaagcgtacttcccacatcaccgtcgtcgttgctcctcgaaaggaggcgtaaagctgtatgggtcagaaagtctaccccaccggcttccgtcttggcattaccgagaactggcgctcccgctggttcgcagagaaggattacgctaagaccctcggtaacgatctcgagattcgcaagtacctcgagaagcgtctttcccgcgcagctgtctcccgcgtcgagatcgagcgcgctggcgacaaggtgaaggtcatcatcctcaccgctcgccccggcgttgtcatcggtaagaagggtgccgagatcgatactctccgtaccgagctcgagaaggtcgctggcgtctccaagggccagctctccgtcgacgttgtcgaggtcaagcgccccgagctcgacgccaacctcgttgctcagtctatcgccgagcagctcgagggccgcgttgccttccgtcgcgctatgcgcaaggctgtccagtctgcccgcaaggccggcgctaagggcatccgtatccagtgctccggtcgtctcggcggtgccgagatgggccgtcgtgagtggtaccgcgagggtcgcgtgcctctgcacaccctccgtgccaagatcgactacggcacggctgtcgccagcaccactatgggcgcttgcggcgtgaaggtctggatctacctaggcgagaagctcccgggccagcctgttcccaaccctgcactcgagggctcttcccgtcctcgtcgtcgtaactccgagaggaggggtcagtagtgcttgcccctaagcgtattcttcaccgcaaggtgcagcgtggctccatgaagggccaggccaagggtaataccgagctgcatttcggcgagtttggtatccaggctctcgaggcccattggatcaccaaccgtcagatcgaggccgctcgtattgccatgacccgctacatgaagcgtggcggtcgtgtctacatcacgatcttccccgataagcccatcaccaagaagcctgccgagactcgcatgggttctggtaagggtaaccccgaggagtgggtggccgtcgtcaagcccggccgcatcatgttcgaggtcaagggcgtgcccgaggaggtcgctcgcgaggctctgcgtcttgcacagcacaagcttcccatcaagaccaagattgttgctgctaagaacgctgagcagcgcatcgagaaggagatggctgaggaggccgctctcgaggccaagtgggctgctgaggacgccgccgccgccaaggaggagaactaatgaagcccgcagagattcgtgagctctcggacgctcagctcgttgagaagctgaaggaaatgcgcgccgagctctttaaccttcgtttccagatggccaccagccagctggacaacaccgctcgcgtcaacaccgtgaagaaggacattgctcgcgtcctcacggagcagcgcgcccgcgagatcgcagcggagaagtccgctgtcgccgagtaggacctaaggagagaacatgactgattcgcgtaactcgcgtaaggtccgtacgggtgtcgttacctccgtctccggtgccaagaccattgtcgtcaccatcaccgagcgcaagcgtcaccccaagtacggcaagatgatgaccagctccaagaagctgcacgctcacgacgaggagtgcacggctggcgtgggcgataccgtccgcgttatggagacccgtcctatgtccaagatgaagcgttggcgcctcatcgaggtcgtcgagcgcgctaaataagcagtcgctcttacgacttgtacgtttccgaagatgtgcgtatgcctggtttgcataccacaggccgtctaaaggctgcgcacctctcttcggttcttagttcggaggaacatctaccatgattcagatgcaaaccatgctgaacgtcgccgacaactccggcgctcgcaagattcgctgcatcaaggtgcttggcggttccaagcgtcgttatgcaggcatcggcgatgtgttcatcggtgctgtccaggaggctacccctggcgccaatgtcaagaagaaggacgttgtccgttgcgtcgtcgttcgcaccgttaaggagatccgccgcaaggatggctcctacattcgctttgatgagaacgcctgcgttgtcatcaacaacgatggttcgcccgtcggcacccgtatcttcgggcccgtcgctcgcgagcttcgtgacaagaagtacatgaagatcgtctcgctcgctcccgagaccctgtagttaggggagatatatgtatatcaagaagggcgataaggtccaggttctctctggtaaggatcgcggcaagcagggcgttgtcctgcgtgctctccccgccgagaacaaggtcgttgtcgagggcgtttcggtcgtcaagaaggccgtcaagcccaacgctgccaaccagcagggcggcatcgtttcgcaggaggctcccatcgacgcctccaacgtcaatctcgtctgccccgagtgcggtaaggttacccgcgtcggtcacgagaaggacggcaagaacaagctgcgcgtctgcaagaagtgcggccacaagttctaagctgcccgcaacatcaagttgctagcaaaggcccggatgccccacggcatccgggcctttttctatccccactcattggggacagacttaaatgagtggccttgattggcagtcattggggacagacttaaatgactagttgatagggacggtctttagatctgtatatctggccatctaggataggcttcaacgaaagcggcacctagggacagtccttcgatgtctggtgtccccagaggggtgaagtaatacagctggctctgtctttagggctttggtgctccgcccctatatgtttcacaaggattgtcgcatgcgcatttacgcgcagagtcttgcgcgatgattcgcatggccgcgcaaatatctgctaactatggctaaataatgaccgacaagcaaataaacacgcaaatacgagcaaatgcgcgcgcatttgtgcgaatatagggctgttggaaatgaagaacttccgatgattcaggaggcacatatggcagattccaaacaggctccgctcgacgccgaggcagccgcaaaggcggtgtttgcctcggtccaggatcagccgttccccgatgatatctttacggcccccgagctccgctgggccgtgatcgggtgcggcgttatcgccaaccaaatggcccagtccctcgctctggccggccgcaagctcgcgggtgtcgccaaccgtacgctgtccaaggcccaggcttttgccgagcagtatggcgtcgagaaggtgtacgagacgattgaggacctctacgccgatccagacatcgatgccgtctatatcaccacgccgcacaacacgcatatcacctatctgcgtgccgcgctggccgccggcaagcacgtgctctgcgaaaaggccattaccctcaactccgccgagctcgacgaggcccgtgccatcgccgacgagcataacgtggtccttatggacgccaccacggtgcttcacatgccgctgtatcaggagctgcgccgtcgcatggatgctggcgagttcggccgcatgaatctcgctcagctcaactttggcagctataaggagtacggcgacctgaccaaccgcttctacaaccgtagccttgccggcggcgccatgctcgacattggcgtgtatgccctgtccgtcatgcgcctgtttatggccagccagccagccgaggtcgtgtctctgggcaatacctgcgagactggcgttgacgtcgcgggtggcattgtctgccgtaatgctgagcagcagctgggcgtcgtgagccttacgctccactccaaacagcccaagcgctcggtcatcagtttcgataagtgctatatcgaggtcaacgattatccgcgcgccgaccatgcaaccatcgtgtggactgcagacggtcaccgtgaggaggtccacgctggcaccgaggcatacgctctgtgctacgagatggccgacctggagaaggccgttgccggcgatgattcgaagcgcgagcttctgggctatgcttccgatgttatggagcttatgaccaagctccgcgccgattggggagtcgtgtaccccgaggaggagtaagcgatgcttgcggaagataggctcaacgcgattgtgtcgatgatacagcagaccggctcggtcaccgtaccggaacttgccgaagccctgggcgtgacaccgtccaccattcgccgtgacttgcaaacgctcgaccgcgcgcaccgtatcgccaaggtgcacggaggcgcgacaagtctggagcgcgcgcacgtgacgcgcgacctaacgctcaatgagcgcagcgatctccataatgatgacaaggagcgcatctgcgcccgtgcggcggcgcttgtggagcccgagagctttgtgtacatcgattcaggttcgacgacgcttaggctcatcgagcatcttccgcgccttgagggcgtcacctatgtgaccgattccgtgctccatgctcagcacctcgctctgcgcggcatgcgcaccgtggtgctgggcggcgagctcaagcccgagaccgaagcactcgttggccccgatgccttggcaaccctggaccgctataacttcaactgcggtttttggggttccaatggcatcgccgccgagcaaggtctcaccacaccggatatcgaggaagcgcaggtcaagcgtatctcgatgcgccataccgccaaacgcttcgtaatctcggacgccagcaaatttggcatggtggcgcccgtcaagtttgcggacttccgcgacgcaacgatcattaccgcaggtgaggtccccgccaagtatcgggcgatggataacgtcatcacggtctagcgacagggcaaggtcaaaaccatttaggttcctcaatagaaaagcggcaacaccctcgatgggcgatgccgcttttgttgtctgccgttttgtctaaatctgtaacaactagaccgttaaaagtgggctaggtgttacagattgagatgcttccgaaccttgccgtccctttgtctcgatctgtaacatctgggaccgattttgacgagttattgttacagattgagattttcccttgagggggattcgaatgtctcgatctgtaacagatagaccggaaaatgggttctaactgttacagatcgagacgttttgggaccgcggctgagccattggggcaaaaccaccacgaaggtgcctgtccccattgtggtggtttagggctcccaggggcagggggcttcgatgtggatgtgctcgccggttacgggatgcgtaaaggacacgctgtgggcgtggagcatcaggccgcaggggcgcggcgttccgtacaggtcgtcgccaaccagggggtgatgctcgctggccagatgcacgcgaatctgatgcttgcggccggtgagcagctcgacatcaatatacgagcgcgtgggcaggccacgacggctcttaagacgtttgagcaccttcacgcgcgtttgagacggcttgccgctggcgccgacgcgcatctttcggctgtcgtgacggtcgcgggcgatgggcttgtcgatgagcttctcgttccagtcgatcttgccctcggcgagcgctaggtagtgcttttcgaaagcgtggtcgataatcatctggtcaaaggcgggctgcgtctgcttgtcgagcgagaacagcaccacgccggtggtgttgcggtccaggcggttgagcggctgcatgtcggtcgcggcaaagccgtcgcccatcgccagcagcaggtcgctggcgtagtcggtgagcgtgcgctcgccggtgccgtcgccgtggacgatcatgccggcgggcttgtcgatggccataagccaggcgtcgcagtagaggacttgaggttcttcgttcacgtgtaagcctttcggttagctgattcccacaaacatgcagcccgaagtcgccccgcgcaggcgggcggcgggcttgcggccggcttgagctgcctcgacggcgcgacggacgcgagcgacggcacgggcgatctcatccgtctcgagcagcgttccgtccaccatgagacgacgcacgccggcatcgagcagctgaggaacctgaggcgtgaggtcgatggggtaggcgtcgtacaggcgcgagcggccgtggatgtcggtacgcaccggcatgacctttccgtcgatattcttgagcgagagcttgcgggcacgcaggcggcagttggcgcaatcgtggatgcagccgttggcaacctgcagaatgcaatgctcgcttgtcatgacgcgcgggcggccaaagacggtgatgcccagagccgcgggcgcggcggcgccgagcgagacaatctcgtcgagcgtgatctcgggcgagagccaaaacgcaccggctccgcgcccggcaagcgcctccatgcagggcgtgttgtgcaccggcaggcaagagcgaatctcggccgtggcgccggcatgcgcggccagggcaagctcagagatgttgccaatagcgaccgtggcgccggcaacaacccacgggtcgacgcgtacgtggtcaacggcgcggcagacctcgtcgagtacgggtacgatgccctgctcaaatacatcggcgggggagagctcggccgcatcgagcgcgtcggtggtcatgtagatgcgcgttacgccctcggcgcgagcggcctcggcggcctcgagcgaggtgacggtggcgcagatctgcggctcatcgcggtagtgctcgggcgcggggcgggaatcactggttacaatcgccggcagctcgagcgttttcgcgcgctcctcgtacggtgccagaatggccttttccagtgccttacaagcggcggcgcgcaccttgtgcacggcggaaaagcccataccgcagccctcatcgagcgccacatcaaagctcgcggcctcaaagggagaggagcccatgcgcccgacgtgctcaatcagatcggatgcctcgacggcgcgggtcttggcggcctcgacggtgaagcccgtggcggtggcggtgagcgcggggttgtcacagcaggtgagtgtgacagtaaacggctcgcccagacgcgccacgacggttacatcaacgacgcggcggcgcagtacatcgcgcttgagcgcggcgccggcggcgtcgatggcgcgctggcttcgaatcacgcgcacgcggcagccctcgggcatgctgcggggcacgcgacactcaatgatgtcaccggcggcggcatcatcggcggcaatggtggtcaggaactggtcaaactcgttatcgtggcgaagctccagcaggtcgcccttgcccacgggctcaagcagctcaatgcgggcgatggcggcgcggcgacggcgatcgtcgggcttgagtccgcgtacatcgcggttggccagacggctgcccagcaccgtgcccacaatctggccgcggttgttggagcgctcgtagctcatcatctcgtcgcccgaggtgccatcctggtaggcgtgcgtaaagtcgcgattaaagcagcgcttgagctggcgctggcgggctgcatcctcatccttggaggtcgaaacatcggccagcatgtcatcaatctgatgacggtacacgtcgacgatggaatacacgtaatcgggggccttcatgcggccctcgagcttgagcgatgcggcgccggcgtcatacagacggcgaacaagcagcgacgtgttggtgtcgcgcgggcacagcgcgcgctcgcgaccggcaggggagagcgagcggccgttctcgtcaattagctcgtagggtaggcggcagggctgggcgcacatgccgcggttggccgagcggcccgccatggcaaagctcgagagcaggcacagacccgagtagcaaaagcagatggcaccgtggctaaagacctcgaggtcgacatcgggcgcggcgtcgtggatggcggcgatctcgtcgatggagagctcgcgcgagagggtcacgcggtcggcgccctgctcgcggcaccagatagttccgcggtcgtcatggatgttcgcctgggtcgagatgtgcgtctcgatgccgggcatcgtgcgtttgacctcaaagaacaggccccagtcctggatgatgaaggcgtcggcgcccagcgtggagcagcgatggatgagttgcagcgcatcgcccatctcggactgcttgatgacgatgttgaccgtgacgtagacgcgcgacccggctagatgtgcggcgcggcaggcttgctcaaaggcctcgtcggtaaagttggttgccttgcggcgggcgttgaagctgcccatgccgcagtagatggcgtctgcccccgcggcgagtgcggcggcaaagggctcgggccctccggcgggcgccaaaagctcgggtctgcggttggtggttcgactggcggttgcggtcatatcctgcctttcaaaatgctcagatactcaaaagtatagtggcgtcgctgcggtgggcgatgcccgcagcctaagcaggacaaagtcttcagcagcttggactggctgaccccgcggagaaccgttcagcggttcggggaaaccgttgggcgataaaatattctcgcaacgtgataataatcttgcatcgcacggaaaccttgagtactatcccaatcaagcgcggtgttcagaccgaattgtgcctcccggtgcgaacgccgcgctcacgctctctatttgattgtaaggagaaaaacatgagcaagaccgtcgtgtcttccgataacgcaccggccgccatcggcccgtattcccccggtatccaggccggcaacatggtgttcctgtccggccagctgggcatcgaccccgcgaccggcaagatgcccgagggcgtcgaggcccaggccaagcagtccctcgccaatgtcgaggccctgctgaccgctgccggcgccacctttgccgatgtcgtcaagaccacggtctacctggccgacatcgccgacttcgccgccgtgaacgagatctacgcctccaagttcgaggccccgttccccgcgcgcagcgccttccaggttgccgcccttccggctggcggtctggtcgagatcgaggtcgtcgccgctctctaaggcgttggccacaactaaacatgacatgcaaaaagaccctgcagcgcagtgcgagctgcagggtcttttgtcaagtgacggatcgcttgtggagccgcgctccatgttgctcgttagccctccttgcgaactttttgcaggtagcggtagacgctgggctccgagatgcccagcgcggtggcggcgcaggccacggcgcccttgagcatgaacaccccgttgccgttgaggtggcgaatgacgtccacgcggtcgctctggccaagcgacgccacatccagcccgcgcgcgctcagcagctcggcaatactgcggtcgatgagctcctgtgtggactctgaaaggctttcgacctcgataggggcgggctccgtgcgcgtcggcgccgcgtcgaagcacgccatgagctgctgcgccatggcgttgatggagcgcacggtcgagaggtcggtgttgacgcagagcataccgacgatctcgtcattctcgcggataaagtacgtcgccgactccagcgtcttgccgccggcaccgcgcccctcgtagcccgtaataaacggcaggtcgcgatacttgggatcgtgcatgatcttgagtgccagatcggtggcgggaccgcctaccttgcggccgctcacgatgccgttgcgaatatcgacgatggcgtggtcgggatccgagaaatcgtgcagcacgatttcgctgtttttgccgagtatctgctccagaaaatcgaccatcggcaaaaagcgacgtacggtctcgttcacgggcaactcctttgggtgaaatcggaaatgttcataacaattttttctcatggtaacacgctgcccatcatctcgtatatccgcaggtacattgcgtaatgcagacgaacggtaggaatttagcggtaaacggttgaccaaaagaaaagttagatgctatttttaccagacacttttctgacctgcggaaatgcgttatttcagctgaagaatagtctgataacaaaaaattattattgagaatgagaatcatctttaatacgatatgcaatgaaggcacaacctcaaccccgcactgcgtcacaatagagcgttagatgcgaaaacaactacttcgaggattggtggtcaaatgacccaggagacggttacgaacggcactgaagccctgttcactcgcgaaggcatgcctcccgttaaggaaatgatcccgtgtgcccttcagcacgtactggcatcgtttgccggcatcattaccccggcggtcatcatggccggcgtctacggctttaatagccagcagagcaccgacatcatccaggtcgcgctcattctttcggcaatcgacacggcccttcaggccttcgctcccttccgtcgcatcggcggcggcctgcccatcgtcatgggcgtttcgttcgcgttcctcccggccctccaggccatgggtgcctcgggctttagctttggtgcgctgctgggcggcgagatcgtcggcggcgccgtcgcggtcctctttggtctggcctacagcaagatcaagtggctgttcccgcccgtcgtgaccggtacggtcatcttctccattggcgtctctctctatcccacggccgtcaagtacatggccggcggtatgggtacgccgctgtggggcaccccgcaggcctggtgcgttgctcttatcaccttcgccgtggtctttgcgctcgccaactttggcaagggcacgctcaagctgggatctgtgttctttggcatgattgttggcatgatcgtctccatcccctttggcatgatcgacttctccagcgtcgctaccgcccaggtcttcgcccttcccaagctcatgccctacgcgctcgagtttgatcccgaggtctgcattaccctcgctgtcgtgttccccatggtcgccatccaggttatcggtgacgtttccgccgcctgcctgggctccatcgaccgtatgcccaccgagcgcgagctctccggcgctattgtgtcccagggcctcacctctatggtcggcggtctgctgggcggtcttcccaccagcgcccttggccagaacgtgggcatcatctgctccaacaaggtcgtcaacaagtgggtctttgtgatcattgcggccgtctttgccatcgccggtctgttcccgcagctctctgccgtcctttccgctatcccgcagcccgtcatcggcggcgcgaccgtcggcgtctttggcaccatcaccatgaacggcgtgcgcatgttcacccgcgagggcctcacgcagcgcactaccaccatcgtcggcacctccgtcgtctttggcctgggtatctggatggccagcggttgccttgccggcgagggtatgcccgcctgggtgtccaccgtcatcggctccaatgccgtaacccccaccgccatcatggccattgtccttaacctgatccttccgcagacgccggtcgtggctcagcacatcgatgctgccaaggacgctgccgtggatctggtcttgcccgagagcaagaagtaaccaattcggtgctattcgtcggcggacgcatcgcctcgtccgccgacgccatgcggcaccaagccgcacttcaaagggtttgtccctttggtgaagcgttgacgggagagggcccgtttccggtgtaggccggcgcttcgcactccgccatgtcagaggtgtcaaaccccgcctctgatgttgaagggagcatccatgcttctggtcgctaacggttccgtctttacccgcaacgctcagaccccgtttattccaaacggtgcggtcgccattgacggagatacgatcgtcgaagtgggccccgagcgcgagctcaaggccaagtacccggatgccgagtacgtcgatgcccagggcaacctcatcatgcccggactcatcaactgccacacccacatctactcgggtctggcccgcggccttgccattaagggctgcaaccccaccaacttcctggagaatcttgagcagcagtggtggaagatcgacgacaacctgacgctcgacggcaccaaggccagcgcctatgccacgattttggactccatccgtgatggcgtcaccacgatcttcgatcaccatgcgagcttctgcgagatcccgggaagcctctttaccattaaggatgcagctcaggagctgggcatgcgttcgtgcctgtgctacgaggtttccgatcgccgtggccaggaaaaatgcgaccaggccattgccgagaacgccgaatttgcccagtgggccgccaaggagcgtcgcgataacgacaaccacatgatcgctgccatgtttggcgggcatgccacctttacgctgtcggacgagaccatggacaagatggccgaggccaacaacggcctgaccggcttccacatccatgtgtgcgagggcatgaatgacgtgtgggactcccgcctcaaccgcggtggcatcagccccgtcgagcgcctgctgcagcacaacctgcttggtcccgacaccatgctgggccactgcatccacgtgacgcctgccgagatggatatcgtcaaggagtccggcacctggctggtcaacaaccccgaatccaatatgggcaacgccgtgggctgcgcccccgtgctcgagttcttccgccgcggcatccccgtgtgcatgggtaccgacgcctacacccacgatatgctcgagagccttaaggtcttcctgatcattcagcgccacaacgctgccatgtccaacgtgggctggtgcgaggccatgacgatgctgtttgagaacaacgccaagatggcgagcaagtacttcgatcgcaagcttggtgtgctcgaggccggcgctgccgccgacgttatcgttatggactacaagccctttacgccgctgagcgaggagaacatcgacggccacatgctctttggcatgatgggcaaaaactgccgcaccaccatcatcaacggccgcgtcctgtacaaggatcgcgagttcgttgggattgatgaggacaagatcaacgcgtggaccatggctgagtccaagaagctctggagcacgctcaacgatcgcacctactaattcacaagtagattcacgcgcgtcgggtgtttcgccgcattcgacgcgcgtataggcgacctccgcggggtcgccggcgctgtgctagcgctacaccgtatttgcgcccgccgcgcggtctcgccgggcgttacagagaggagctcactatgagcgacatcatgaggccgatcccgttttcgcagctgatgaactggatcatcgaggagcacaagactcagggcgccgtctttggcgtgcgcaagatggtcacggccaaccaggagggtgcgcttcccatttttgacgagcgcatcgagaccccgtttggcccggccgccggacccaacacgcagcttgcccagaacatcgtggcctcttatgtggccggttcccgcttctttgagctcaagaccgttcaggttatggacggcgaggagctctccaagtgtgtgaacaagccctgcatcgtggcacaggacgagtgctacaactgcgagtggtcgaccgagctcgaggttccgcaggcctttgccgagtacgtgaaggcatggtttgcctgccacctgatcgctcgcgagtacggcctgggcagcccggacggctttgtcttcaacatgtccgtgggttatgacctggagggcatcaagagccccaaggtcgacgcctacatcgagggcatgaaggacgccagcggctccgacgtctggaacgagtgccgcgcatgggcgctcgccaacctggacaagtttgagcatgtcgacgccgcgttcgtcgagtccatcccggcacgcgtctccaactccatcaccgagtctaccctgcacggctgcccgcccgccgagatcgagcgcatcgcgacctacctcatcaccgagaagggcctcaacacctacatcaagtgcaaccccacgctgctgggctatgagtttgctcgccagcgcctcaacgagctgggctttgactacatcgtcttcgatgacacgcacttccgcgaggacctgcagtgggccgatgccgtgcctatgttcgagcgcctgattgccctgtgcgccgagcgcggcctggagtttggcgtcaagctcaccaataccttccccgtcgacgtgacgaggaacgagctgccttccaccgagatgtacatgtcgggccgttcgctgttctcactgaccatcgaggccgcccgtcgcattaccgagcagtttgatggcaagctgcgcatcagctactccggcggtgccacggtctacaacatccgcgccctgtacgatgccggcatttggcccgttaccctggcgaccgacgtgctcaagcccggtggctacgagcgctttagccagatggccggcgagtttaccgacctggacggcaagccgttcgcgggcgtctctctcgaggccgtgacggcgatccagaccgactcgctcaccaatccgctctacaagaagccgctgcgcccgctgcccgaccgcaaggtcgccggcaagagcccgctttccgactgctttaccacgccgtgccgcacgagctgccccatccagcaggatattcccgcctatctggcggctgttgacgagggccgctacgaggacgcactcaacatcatcatcgagcgcaacgccctgccgttcattactggcaccatctgcccgcatccctgcggccgtgcctgcgagcgtgcattctacgagcccgagggcgcccagattcgcgccagcaagctcaaggccgcccgcgaggccatgaccgccgtgctgcccaagctgcgtgctcaggccatcgccaacgacagcgagcgcaacgttgccgttatcggcggcggcccggccggtctggcgacggcgttcttcctgacgcgtgccggcgtgcccgtcaccatctttgaggctcgcgattcgctcggcggcgtggttcgtcacgtcattcccgagttccgcattgcgagcgacgatatctcccacgatgccgagctctgtctggcctttggcgccaaggtgcagctcaacgcccgcgtggagtccatcgacgagctcaaggcccagggctttaccgacgtggtcgtggccaccggtgcctggatgcccggctctgcgggcttgggcgagggcgccgagctcgatgtgctggagttcctcgaggccgccaagaggggcgagaagctcgagctgggcgaggacgtcgtggtcattggcgccggcaacaccgccatggatgcggctcgcgtggccaagcgcctggccggcgtgaagaacgtgcgcctggtgtatcgccgcaccaagaagcagatgcccgccgacgaggaagagcttgatcttgctcttgccgacggtgttgagttctgcgagctgctggtccccaaggcgcttaacggcgccgtgctgacctgcgacgtcatggagcttggcgagccggatgcaagcggccgtcgcagccccgtcgccacgggcgagaccgtcgagctttccgccaccacggtgatctgcgccgtgggcgagggcatcgatgccagcctgtacgatgccgcgggtgtcgagcacgaccgtcgcggccgccttgccgccacctccactggcgtcgagggcgtttgggctgcgggcgactgccgccgcggtcctgccaccgtggtcgaggctattgccgatgccgccgaggtcgcccgcgccatcgccggcgtggactttaacaagtacgccgactgcaacgagcaggccggccgcgaggacacttgctacgagcgcaaggggtcgctgtgccgcgacaagcgcaactgcaccaagactcgctgcctgggctgcggctcggtgtgcgaggtctgctgcgatgtgtgccccaaccgtgccaacgtggcaattaaggtgccgggcctggccaagcatcaggtcgtccacgtcgatggcatgtgcaacgagtgcggcaactgcgccgtgttctgtccctaccaggagggccgtccctacaaggacaagctcaccctgttctggagcgagcaggacatggagaactccgagaacgagggcttcctggctgtggacgaggaccactttaaggtccgcgtcgccggcacggtccgcaccgtctcggtcgatgccgtcaacaccggccttcccgaggccgtccgcctgaccatcagggctgtgcgcgacaactatccgtatctccttaagaaataggcgagtctcttatggccaaatccattcaacataacgtggcctacgttgcctgcggaagcggttgcgcctccgcaggcggcgacgcccgctgcagcgaaggctgcattggctgtggcgcctgcgtcacggcctgcccccacggtgccattgcgctggtcgatggcatcgcccgcgtggatcgctcaaagtgcacgggctgtggcctgtgcggcatggcgtgcccgcagcgcgtgattgccttcgtccccggctaccagaacattctggtgcgctgcaacaacaccgataagggtgccattgcgcgcaagatttgcgacacgagctgcatcggttgcggtatgtgcgccaaaaagtgccctgccggcgctatccgcatcgaggacaactgcgcccatatcgacggcgtggactgcctgtcgtgcggcatgtgcgccgtcgtctgcccgcatggcgccatccacgaccgcaccggcatcgccgccggcgtgtagaagggaatcaccatggcacaggaattcacttttaccgttaacggtgtcgagcacacgacgacggagaataaaccactgctgcgctatctgcgcgacgacctgcacattcactccgccaaggacggctgctccgagggcgcctgcggcacctgcaccatccatgtggacggtgcggccgtcaaggcgtgcgtgctgaccaccgctcttgccgccggccgcaacatcgtgaccgtcgagggcctgcccgaggacgtgcgcgaggcctttgtgtacgcctttggcgccgtgggcgccgtgcagtgcggtttttgcattcccggcatggtcatggcgggtgcggcgctcatcgccgaggaccccgagcccaccgaggagcagatcaagtacgccattcgcggtaacgtctgtcgctgcaccggctacaaaaagattatcgagggcatctcgctggccgctgcggtgctccgcggcgaaaagcagatcgacgaggacctggagcgcggcgatgactacggcgtgggcaagcgcgcctttcgtattgacgtgcgcaagaaggtgctcggcgagggcaagtatcccgacgacatcgacgagctcgatcagccgggcctgacctatgccagcgccgtgcgctccaagtatccgcgcgcccgcgtgctctccatcgacacctccaaggccgaggccctgcccggtgtggtgggcatcctgcgcgccgaggacgtgccggtcaaccaggtcggccaccttatccaggactgggacgtcatgatcgctcagggcgatatcacccgctgcgtgggcgatgccatcgtgctggtggtcgccgaggacgaggcgacgctcgagaaggccaagaagctcgtaaagattgactacgagccgctggagcccgtgcgcaacattgtcgaggccagggccgccgacgctccgcgcctgcatgacagcttctttgcctttggcaacacggtggagctcaaggacaacgtgtgccagagccgccacgtgacgcgcggcgacgccgccaaggcgctggccgaaagcgcgttcaccgtgacgcagcgctttaccacgccctttaccgagcatgccttcttggagcccgagtgtgccgttgccttcccgtacaagaacggcgtcaaggtgcagtcgaccgaccagggcgcctacgacacgcgcaaagagtgtgcccacatgtttggctgggacaacgaacccgagcgcgtggtcgtcgagaccatgctcgtgggcggcggctttggcggtaaggaggacgtgtccatccagcatctggccgcgctcgccgcatataagtttcagcgtcctgtgaagtgcaagctcacgcgtgccgagtcgctcgctttccatcccaagcgccatgccatggacggtacctttacgctgggctgcgacgccgagggcaactttaccggtctggactgcgagatcaactttgacaccggcgcctacgcgtcgctgtgtggcccggtgctcgagcgcgcctgcacacatgccgtcggcccctacaagtaccagaacaccgatattcgcggttatggctactacaccaacaacccgcccgccggcgcgtaccgcggctttggcgtttgccagtccgagtttgcgctcgagagcctaatcgacctgctggccgagaaggtcggcctggatccgtgggagattcgctaccgcaacgccatcgagccgggcgaggttttgcccaacggtcagattgccgactgctccacggcgctgaaggagacactgctcgaggtcaaggatgcctactatgcgcatcccggacacgccggcatcgcctgcgccatgaagaacgccggcgtgggcgtgggcctgcccgatgccggccgctgcaagattcgcatcgagaacggcgcggccgtggtctatgccgccacgtccgacattggccagggctgtaacaccgtctttttgcaggacgttgccgaggcatgcggcctgccgcttcgctgcatcgccaacggcgagtgctccaccgagaacgctcccgactccggcaccacgtctggttcgcgtcagacggtcgtgaccggcgaggccgtgcgcggcgccgccttcctgctgcgcgatgccatggttggcatcgaggccggcaagcccgcgcccgatgctcccgtgagcgcgcatggcgacggcgtcaagatcgagtacgatgacggtcgcgcctaccagctgcgcacgcaggagctcgtcgccggccagggtatgcatcctcaggatcccgcggccgccatcaaggcgcttgagggatgcgagtttggctacgtgtacctggagccgaccgacaaactgggtgcggatgttcccaaccccaagagccatatctgctacggctttgccacgcatgtggtcattctggatgatgacggccgcgtgagcgaggtctacgccgcgcacgattccggcaaggtggtcaaccccatctccatccagggtcagatcgaaggcggtgtgctcatgggtatgggctatgcgcttaccgaggactggccgctcaaggactgcgtgccccaggcaaggtacggtacgctcgggctgttccgtgcgcccgagattccggatatccatgccatctacgtggagaaggacgagctgctgcccgtggcatacggcggcaagggcatcggcgagatcgcaacgatccccacggcacccgccgtacagaacgcctatcgcgcatttgacggcaagctgcgtcccgatctgcccatggtggatacgccctacagccgcgctcgcaaccgcgggtagggtagggtgcggacgacccttgctgacgggctgttcgcgctcaacatcaactgcatatgctgcgcctctggccccagctccatcgtgagtcggggccttttgtttggagcgcctccgcatgcggaaactgcgtcccggaatcatgcctcagaatgggatgcaacttccggatcggcctcaggcggaaactgtgtcccggaatatggctccagcgtgggatgcattttccggttgaagcctcaagcggaaacggcgtcccggaattcggtctcggaacgggtcgtgctttccgctaggcccgccatccggaaagtgcatcccgttttgagcgctcaatttgggacatggtttccgcgggtgctgccaaccggaaagtgtgtcccagtttggtgggcaggcgggcataagctcagcagctcctacagctcaatatcgttgagccatgtcggcagcgcggtctgccggatgcctgccgtctgcagctttttggcgagcattcctgtcgagcggacctcgttcatggtaaagcgcagcagagggtggccgtagagcgataggtgcgcctcgcgctgtcgttcggcaacgagcgcctcggcggtggtgcgtccggccagcatggtctggtcggtatatttgatgagcccgtcgagctcgcccagcgtgagttcccgcgcctgacgctcccaggcaaagtccgttcgtatgggcttggccgaatcgaaggggtccgtcagctcgtattgaagccagtcgggcgcaaagcccgtctcgatcatgacggctcgggcgaccgattccccgccgctctcggcgcgggcgtcggcatatcgaagcgttgtgagggcggtgcgaatcgcgcgatcattgcgggcggtcactcgttgctcaacggcctccatcagctgttccggcgcaacgccgagctttgagatcgccgaatcggcaatgggcatgccatcggcaaaaccagtttgcagcaggcaatctgtggccgtttggatgggcggcgttaccgatatgccggccctgcgtattgctccggccggctcaatctggtgtcgctgaatatgtgcgcccggacgagccgacggctttgtcgagctgcaaacatgcacgacgttcaggtgtcgccacgagacctcgagccccagcaggcaagctgccgaaaacgagcagaacgtccaatcgggatggatgatcgcaagggcgcggataatctcgcaatggcgttgcgctcggttgagttcatcccagcgcgtttttcgcgcaaacaaccccggcatgggcgagacaaccgtgccgccggtgcgccgaaggagcgcttttcggatcgccgtactcgggggaatcagacagcgcccctcttgttcggcttgagtgggcagttggtcgatgagctggtcattgcaatgggtcatgagctaccgcctccttttgggtagcaaaaacgtatcagctggaacttgccgctcagctgaccaaaagctgaccaaaatctaaccatgcaggtagatgacctgcttttgacgacatatttcttgtttgaatcggtgggcggtaatcggcgaccttgaacggtgacgagatatgaagtcttggtaagtttcaggacgtgtacttttttgaaaaagagcattctatctgctgttttgcgtttctggatcgcatgtttgaaggcctgtgataagggcggcggatcgtcgtcttgtacctgaggaacccgtgacccggaattgccgctcggaatgggacgtgctttccggatcgcccttcaagcggaaactacatcccagatttcggctccaaaccgggatgtgctatcccggcggcgtctctggcggaaattgcaccccggaatgagcgctcagagcgggattcattttccagaacggtccatgagcggtggtgtaccgccccttttcgtgcgccgcttgtcgaattgcgttatagctagctatattataggaaagtataatatagctagctataacgcaaaggaaggatggccctatgtttatcggaagaacggcggaaatgtccgagctcaatcgactgtatggcacgggctcctttgagatgcctgtgatttacggccgtcgtcgtgtgggcaaaacgcgtctcatcacagaattcatccaagacaagaaggctatttactttcaagctcgtcgtaccaatgcagtggcaaacctgcacggctttagccaggcgatacttgcgggttcggttggtgctgcaggtgtgtcgtttcgtagttttgacgaggcgttcgatgcgttggccaccatggctcgcacggaacgtttgattgttgtgattgacgagtatccctatctcgcccaatcgaatcccgagatcagctcgttgctgcaagacaagatcgatcacttgtacaaagagaccaagctcatgcttatcctgtgcggctcgtctctttcgtttatggaggaacaggtgttgggctacgagagcccactatacggtaggcgtacggcccagtttaagatcttgccgctcgattttatgacgaccctcggcctgtggcagagcatgggtcgcgaagacgctgcagtttgctatggcatgacgggcggcattcctgcatatatcgagaaagtcgatcctgccgcaccgctcaaggacaacatcaaacgtctttttcttactcctacgggctatctctttgaggagccgagtaacctgctattgcaagagtgccgcaatcccgagcaatatgatgcgatcgtgcaagcaattgctcaggggcgctcgaggatctcggagattgcgagctctacgggaatccctgcgagcaacgtaaagagctatgtggataagctggcgtcacttgggattgtcgagcgcgagctgcccctaaacgaaacgagcaataagcgagccgtgtatctgctgagcgaccagatgtttaggttctggtacaagtttgttccgcagaacatcgggctgattcaaaacgatatggccgagatggcgtataagcgcattgagccgcacgtatcggattacatgggtacggtctttgagcttatatgcagacaatacgtgtacgaactcgcgcgcgcgggccagctcgatgtggttccggcgagtgtcgggcgctggtgggggacggataatcgcacgcatacgcaggaagaaatcgacttgattgttgacgatggcgagggcactgcgctgtttgcggagtgcaaatggcgcaatgaaccggcgggcgaagacgtgctgcaaaagctcgtgcaccgaagtgagctctttagacggcaacgaaaaagctatgcacttttctcaaaaagcggctttacgcagggatgtcgggatgccgcggagagtaggggagacgtcaagctgatctcgtttgacgagatgtgagggcggggataatgaagcgcgtcctgatttgatgccgggaatgggatgtgctttccttttgcgacctttggcggaaagtgcgttccagatttcggcttcagaatgggatgccgtttccggatcggccctcaggcggaaactacgacccggaattcggctccaaaacgggatacgctttcccggtggcatctctagcggaaactgcatcccggaatgagctctcggaacgggacacgctttcccatcggggcttcaaacggaaaccgtgtcccggaatcgagcctcagggtgggacgcattttccggtagaggcctgggacggaaggcgtgtcccagaatccggctaatccgatggccaggtggttgagcgagcgggctccgaggctccattactgaaaattcatttgttaaacctggcaaccgtgggtagaataaagtcgacggcagcccaagggtgatagctgggcagcgccgttacttagttcaaggggtcaatgccttaacggcgtcgacccctcttctaatatgagaaagccattgtcaataggcatgttcgtttgagcccggtttaaatccaccgcaggaagcttggatacgcctaggcgcggtccaagaaatcgtccgcaccccctaatgattgttccggctttgggcttgtctacaataacccccgtaaaagaaatgcggaaggttaccgagtcccctcggacgtgggcctaaccaaagtctttgatcgcgagcgtctcaatgggcgcattcgattgattttggttgggctatatttatgaagggacatgtcaccatgggtttcctttctcgcctgatgggcggttcggatgagcagaagactgcagcttccgagttcgaaatcctcgctcccgtttccggcgagcttgttcatctagaaaataccaatgaccccgcttttagcagccgtgctgtgggcgatggcgttgccgtggttccccaagagggaacggtgtgcgctcctgtttccggcaccgttgcggcgctgtttccgactgagcacgcgctgggcatcatgtccgacgacagctctgctcaggtgatgctgcatatcggaatcgacactgttaaacttgagggcaagggcttccatgcgcttgttgctcagggtgaccatgtcgacgcgggccagcccctcgtcgaggtcgatttcgacgcggtccgcgccgccggcttcgatcccacggtcttcgttatcgtgtgcgagcgttcggagaactcgactcttcgtgagcatgcttccggccctgttgctgttaaagagcctgttatctggctttccgagtaaattcttgtggtgggtgccgtggttatcaagcgagtttttaacaacaacgtcgcaatggtcacttcggacgatggctccgagctcatcgtcatcggtcgaggcctctgctttggccgtcatgccggcgatgccatcgatgaggcgtcggtcgaaaagacctacgcgttgcaggagggaacttctcaggactcgcgtacgattgaccgcttggcacatcttttggagtccatccccaccgtcaacctcgtgattgccgaggacattgttcagatgctccgtcgagagctcaatgttgatatcaacgacaagattctcattgctctcgcagaccatatcagccttgctttggagcgtgagcgcaagggcgtctcctgtgagaatccgttgctgctcgagatccagcagttctatcgcaaggagtatgcacttgcgggccgtgcactgcagattatcaaggagtatatgggcatccagatgagcgaagaagagcagggttttattacgctgcatatcgtcaacgccaccatgccgcaacgctccgatcgtttgattgtttcggtccagcttgttcgcgacgtgctcgcgattgtttctgagcgctatgctacgaccctcgatgacacctcgctgccttacgaacgtttcgttcgtcacctgcagtttttcgcacagcgagcgctcgatcctacggccgggcaaatcaacggagacgcgctgttccgaatcgatgaaacggcgtatccgtgcgcattctcgtgcgcggacgccatagccgcccacttgtcgtctacctataacgttgtcgttaccgatgccgagaagagttatctcgcatatcacattgttaacctgcttggagaacctggtctctaggcataacgtgcccacacatcgattgatataaggcagggctcacggccttgtccagggcacatctgtcttaatttgcggaaaaggaaggggagtaccgctatgaccgcaaaaaagaagttcaatttcaaagcgccgttggaggtgttcgcgaagtcgatcgttcagccgatgatgtatctctcggttgccggcatcctgctcatcgtgggcatcattctgaccaacaagaccatttgcgctttgatccccgtgctgggctccggtccgttccagcttgtgggcgccgttgtctatcagtcgttgatgtttatcatcaacaacctctcgattctgttctgcgtgggtatcgccggcgccatggcaaagaagaacaagggccatgcttcgctgatcgccctgatgtcgttcttcctgttcctgcaggctaacaacatcgtgctcaacgccaccggctctcttgccgatgcgagcggcatgctcggccttaccggaaccggccaggccaccgttatgggcatccaggtgctcgataccggcgtgtttggcggcatcattcttggttgcatcaccggtgccgtgttcaacaagtactcgaacaagcagtttcccattgccctttcgatgttctcgggcgttcgcttcccgttcctgatcatgatcatcatttcctggatcatgggcgctggcttctgcatcgtttggcctccggttcagggcgccatctcctccgttgccggcatcattaaggagtcgggcaacatcggtctgtttatctacggcatgctcaacaagctgctcgttcccaccggtctgcaccacctcatctacaccccgttccagttctccgatgtgggtggtaccctgacgctgggcgatcaggttatcgccggcgcctatcccatccgtgttgccgagatggcaatgacgggtcagcccttctccgatagcacgtatttcaacagctacaccttcaacaacctgtggccctacatcggtatcggtctcgcctttatcgtcaccgcttacaaggggaacaaggataagaccaaggccgttatcatcccgctgatcatcaccgccgtgctctcctgcgtgaccgagcccatggacttcctctttgtctttgccgctcccgtgctctttgtcgttcactcggttctttccggcatcttcctggttctgctcaaggtcctctccgtgcccgcttcgactgcaggcggcatcatcaacatcgtggtttccaacctggtcctcggtgtcgacaagaccaactggccggttatgctggtactcggagtcgtcaacgccgctctgtacttcttcctcttcaccttcctcatcaagaagctcaacctccacacgcctggtcgcgaggaggagtccgagctcgccgagtccgttgccgagggcgaggccgccgcgtctgtcgcggtgaagcagggcgctgttgccgcagctcccgcagagggcgtcgatgcaggtattgccgacctggtcgcaggtcttggcggcaaggacaacatcgaggagctcgagaactgctttacgcgtctccgcgtgaacgttaagaacccggacctcatcaatgaggacctcatcaaccacgtgcccaacagcggcatcaaccgcaacggcaataatatccagatcatctttggcatgaaggtcgccgagatgcgcgacaaggtcgaaaacgcaattgagaaggagcagtaaacaatgatcattactctgtgtggtggcggatccacctttacccccggcatcgtcaaatccatcgccctgcgcaaggacgagctcgacgttgacgagattcgtctgtacgacatcaacgaggagcgccagcgcaagatcggcgtgctcgtggactggattttgcacgaggacctcggccttgacatcaagctcacggtgaccaccgacaagaagacggcttttaccgacgcgagcttcgtgtttgcccagatgcgcgtgggcggctatgccatgcgcgagcaggacgagaagattccgcttcgtcatggctgcgtgggtcaggagacttgcggttgcggcggccttgcctacggcatgcgcaccatcttccccatggtcgagctgatcgatgacgttgagaagtacgccaagaaggactactggattctcaactactccaaccctgccgccatcgtctccgagggctgccgtgtgctgcgtcccaacgctcgcatcatcaacatctgcgacatgccgatcgcgattatcgacgtggtttgcgccgcgctcgatatcgacaagaaggatgtcgagtacgattactttggcctcaaccactttggttggttcacctcgatccgccacaagggcgaggaggtgctcccgcagctgcgtgagtacatcaaggagcatgagattctgctgcccgattcctacctcaagggcatgggctcgctcatggcaaagaagcccgaggagaccgccgacgagcaccccgagcagaatcgccacaccaagggcagctggtactacgtctggaagggcgagtacgagatcatggagtgcttcccggagtacctgcccaacacgtatctgaactactacctgcagcagaaggagttcgtcgagcactccaaccccgagcgcacccgtgctaacgaggttgaggagacgcgcgagaagaacctcttcgacggcatcgatcactacgagaagacgggcgagatcgacgagagcacgttctatgcgggcagccacggcgactggattgccgatctggccatcgctctgaagaacgacaccaagcagcgcttcctggtcatttgcgagaacaagggcgctatccccaacatgccctacgacgctatggtcgagctgcctgcctacattggcaagaacggccccgaggtcatcagccgtgacaacattcctctgttccagcagggcctcatgatgcagcagctgaactccgagaagctcgtggtcgaggctacgatcgagggttcgtacgagaaggcgctcaaggcctttacgctgaacaagaccgtgccttcgatgaaggtcgccaaggaggttctcgacgacatgatcgaggccaacaagggttactggcccgagcttaagtaaaagcaacagagtcgctggccgcatacctggagcaatgcccgtccacgtgattgcgtgggcggggcattgtcatttggtaacgcgttttatcaaatatggcatttatctgcggtaatgttctattccaccgctgatggtgacatttcatgccgcctgccgaactgcgtggaggcctaacaactttataggtcagtgttgtgcgtgtagcaatttcgcccggcctcgcctccgggctgccgcatgagaggggatcttatggcacgactgcacgtaatggaacgcagccacgctcaggccgtcatggacgacctgcacgatgcgcttggacgccgtctggcggtgagctcgctcgccccgtgccccgtcgagtttacggcggcgctcgtcaacctgtgctccacccagagctgcggcaaatgcacgccctgccgcgtgggcctgagcgcgctgagcgacctgctcgccgatgtgctcgagggccgcgccgacgagtccacgctcaacttgattgagcgcactgcccgcaccatctatctttcgagcgactgcgccatcggttacgaggccggtgccatggcgctcacggccattcgtggcttccgggacgactttgagcatcacatccgcgagcactcctgcggctttgaccgcgaggctcgcgtcccgtgcgtctcgggctgcccggcgcacgtcgacattcccgggtacatttcgctcgtcgaggccggccgctatgccgatgccgtcaaggtcatccgcaagaacaacccgctgccgctcgtctgcggtttggtgtgcgagcatccctgcgagatgcactgccgtcgcggcatggtcgacgatcccatgaacatcctcgccctcaagcgttttgccgttgagcacagcgacctcaatgattacaagcccagcgtggctgacaacaccggcaagcgcatcgccgtgattggcggcggcccggccggcctttcctgcgcctactacctggccgtgatgggccataaggtgacgatctttgagcagcgtcatcacctgggtggcatgctgcgctatggcattcccagctaccgtctgccgcgcgagcgcctgcaggccgagatcgactggatcttgagcgccggcatcaacgtggaactcgaccactccgtcaacggcgaggagcttgcccgcctgcgcgacgagttcgatgtcgtctatctggccattggtgcccacagcgataagaagctcggccttccgggcgaagaggctcccggcgtggagtcggccgtcaagatgctgcgtgccatcggcgacgacgagctgcccgacctgagcggccagcgcgtgtgcgtcatcggcggcggcaatgtggccatggacgtggcgcgctctgccgtgcgctgcggtgccgaaaaggtgagcatcgtctaccgccgtcgcatctgcgacatgacggcgcaggatgccgagattgccggcgcccaggccgagggctgcgaggttcttgagctcaccgcaccgctcgctatcgagatgggcgaggaaggtcgcgtgagcggtctgcgcgtgcagccgcagattatcggcgagccccgtcgtgggcgtccggccccgcgtgccgccgccacacccgagcgcgtcattccctgcgagcgcgtgtttgtggccatcggccaggacatcgactccaagccgtttgaggacatgggcgtcgcctgcaggtggggctgcgtggtcaccgattcggatggcgccgtgcccaacttcgatggcctctttagcggcggcgactgccagaccggtcccgccaccgtcatccgggccatcaacgccggtcgcgttgcttcggcaaatatcgatcgctatctgggctttgaccacaagatcaagcttgacgttgagctaccgaccgtacagtttaagggcaagcacgagtgcggccgctgcgagctgggcgagcgcgaggccggcgagcgcatccacgattggaatctggtcgagcagggccttaccgaggaggaggcacgccaggaggcaagccgctgcctgcgttgcgaccactttggctttggtgcgttccgcggagggaggaacctggaatggtagagctcaacaaccccactgtcagcgacaacaccgaaagcggagcactcaacatggtcaagctcactatcgataattgcgaggtcgtggtgcccgagcacaccacgatcctggacgcggccaagtccgtcggtatccagattcccaccctgtgctacctgcgcgatctaaacgagatcggcggctgccgcgtgtgcgtggtcgaggttgagggctgcgaccagctggttgccgcctgcaacaactacgtgctcgacggcatggtggtccgcaccaacagccccaaggcccgcgaggcgcgtcgcaccaacgtgcagctgctgctgtcccagcacgactcgcgctgtacgagttgcgtgcgcagtggtaactgcaacctgcagaccatcgccaacgacctgggcatcttctatttgccgtacgagcagcacctggcgcgcgagggctgggacttcgatttccccatcattcgcgataacgacaagtgcattaaatgcatgcgctgcatcaaggtgtgcgagagcgtgcagggcttagggatttgggacctgaccaaccgcgccacgcataccgccgtgggcacccgcgggcgtgcgccgatcggcaagaccgattgcgtcgcgtgtggtcagtgcatcacgcattgtccgacgggcgccctgcgcgagcgtgacgataccgagaccgtgttcgacgccatcgccgatcccgacaagatcgtgctggtgcagattgcgccggccgtgcgtagcgcctggggagaggaactcggcatatctcgcgaggaggccaccgttgagcgcttggcctgtgcgctgcgccgcgttggctttgagtacgtgttcgacaccgatttctcggccgacctcaccattatggaggagggctccgagctgctcgagcgcctgggtaaggccgccaagggcgagggcgacagccgtggctggcccatgttcacgagctgctgcccgggctgggtgcgctttgtgaaggcgcgttaccccgagtttgtcgacagcctgtctacgtcaaagtcgccgcagcagatgtttggcgccatcgccaagacctactacgccaaggtgctgggcgtggagcccgagcgtctgtttgtggtgtccgtgatgccgtgcacggccaagaaggccgagtgcgcgctgccgagcatggtgggcgaggacggcacgcccgatgtggacgttgcgctgacggtgcgcgagatggtacgtatgatccgcgcgaaccacgtgagcgtggacacgttggtcgaggagccgctcgacacgccgctgggctttggcacgggcgcgggtgtgatctttggcgccacgggcggcgtgatggaggccgccgtgcgctcggcctattacctggtgacgggcaagaaccccgatgccgatttctttaccgatgtgcgcgggctggacggctggaaggaagccgtggccgatatcgatggcaccggggtgcgcgtcgccgtggcgcacgggctgggcaacgccgcccgtctgctcgacgcgattcgcgacggccgtgcgagctatgacttcgttgaggtcatggcgtgcccgggcggctgcgtcggtggcggcggtcagcccatccacgacggctgcgagctggcagccgagcgtggccaggtgctctggggcctggatgccgctgcggacattcgcttctcgcacgagaatcccgatgtccaggcgtgctaccgcgagttcttgggcgagccgctctcgccgctggccgaggagctgctgcatactgaccatcacgcatggacgatgcccaacgaggggacgtactagcgatgcgcgcgtttgattttgagatgtcgcgccgggggtttgcctcggcgctcgccgcgggcgccctgtcgcttgcgctcgcgggctgtggcggcggggctgccggtgccgggtccgccgcgggttcggctgccgggcctgccgccgacggtgccactgccgagccggtcgaggtgcacgtcgcctcgctcaaggggccgacctcgattggtctggtgcagtttatggaccgggcggccgatggcgagacggacaatgagttcgactttgcgatgaatactgccgccgatgagattgtgcccaaggtcattcagggcgatatcgacattgccctggtacccgccaacgtggcgagcgtactctacaacaagaccgagggcgcggtgcaggtcatcgacatcaacacgctgggtgtgctgaacgttgtgacgggcgacgcgaatgtggcctcgtttggcgatctggcgggtcgcaccgtctacatgacgggcaagggcaccacgccagagtacgtcatgaacttcctgctggagcgcgcgggcctgaccggccaggtgacgctcgagtttaagagcgagcccaccgaggtgctgtcggccctgcttgccgacccgtctgccgtgggcgtgctgccggagccgttcaagaccgccgccatcgcaaagagcgaaggcaagctgtcggcgccggtaagtctgaccgatgtgtgggatgagctggcaggtgacacgggttcgcgcctgctgacgggtgtgaccgtggtgcgccgcgcgtttgccgaggaacatcccgaggccgtggcggagttcttgaactgccatgcggcgagcgttaaggccgtcaatgcggcgccggcagactgggcgcaggccgtggtcgatgctggcatcgtggacaacgccaagattgccgagaaggcgattcccgggtgcatgcttgtgtgccagacgggcaaggatatgaaggcggcacttagtgggtatctgcaggtgctggccgacgcggacgcgagcgccgtgggtggtaaacttccggctgacgatttctactacatggagtagcccgtgcgtgcgtttgctcgacacatgacagagcgtatgaaggcggtggcggcagcaggtgccgtcgccgccttttggcttgccgtgtgggtcttcgcggcggtgctggtggcgcagccactgatcttgccggggccgggtgctgttgccttggcgctgctgcgcctggtgtgcgatggcggtacctgggcgattttggtgggctcgggcgcgcggatactgggcgggctggcgcttgccgcggtgtgtggtggcgtgcttgccgggatttcgtcacggttgcgggcgtttgcgcgcctggtggctccggcactttcgtttgttaaggcgacgccggttgcctgcgtggtggtcctgctgcttatttggttgggatcggcgcgcgtgagcatcgccgcggtctttttgatggcgctgccgggcgtgtatttttcgctggccgagggcttggcacaggtgaataaaccgctggagcagatgttccgtctgcatggcgtgcgcggctggcgcctgttttgcgcccatacctggcgcgaagtcctgccgtttgtgctttcgtgcgcccgcgccgtgatcggcatgagctggaaggccggcgtggcagccgagctgatcggcatggcggtgggcaccgtgggcgagcgcatctatcaggcaaagcttttgattgagacggctgatttgctggcgtggaccgtgctggtcgttaccgcctcgtgggcgtgtgagcgcgtgctggtgtggctgctgcgggtttcgggacccgtggcgtggcgcgcggccgtgcgggcgcatgggcatggactgtgcgggcgtgcggggactgcgagcgatggcactgcagcggagcttgcgcttgccgtgggcgatcgtgcgccctgggcgccggcgctggatggtctggtgctcaacgtgcctgcgggtgggcgtatctgcgtgatgggcgcttcggggatgggcaagtcgacgctgctttcgttggcagcgggggagtgcgcgccgtgctcgatggtgtttcaggatgcacgcttggtagagggcagctcggctttggataacgtgctggtgtgtgccgatgcgcgcgtggatgcttcgaacgctacgaccttgctgcgccggttggtgccgggaatcgacgtgcatgttcgcgtggctgagctttcgggcgggcagcgccgtcgtgtcgagatcgctcgagccctgctgtgtggcggctgtgccgtcattctggatgagccctttaccggcctggacgccgccgcgcgcgatgcgacggccgaggccgtgctagacctgctcgacggtcgcacgctcttgctcgccacgcacgatgtcgtcgacgttcaggccctcgatatctcggacatcatcacgctctaaatactaactgagcaacaaaatgattcgttttcctccgtccccatggggtcgggtgtggtattctatctgcggggtaatacttaggaataccaagtaataccaacgccgcagaaacaaactccggatgcgggccaatcgggttgccttcacagcccgtcgcccagccgcgtggcccgcatctatccgcactaccgtcgtttcaaaaaaggaagcgccatggcagaacacatgacccccgtagtcgcgaaggtcttgcccgaggagaaggcagccttcgcggcggcaacccagctcgtgggcaccacgccgtccaacgccatccgcatgtttatcgccgcgttcaatcgctgcggcaccttcccgttcgacatctcgcccagcggggcctttggcaaagagtgtccccaacagctagtcgttgaagaacgtccccaatgactagtcgtcgggaggaggttggcatgctcaatgcgatgatttgggcgcttgcctgttttggcgtcgtcgctgccgatattgccctgagcgtcgttttgttttccgcccttggcgtcgcatcggtgttcatgggtttttcgatcgatgacctcgacattcaattgcttcaggccgtcgcgcagacagcatcgtttttgatggcgctgctgtggtggcgttatctgtggccgcgttcgtttatggcacgccggcaaagcgagcacccgctcggcgggggagcgcgtggggcgtggaaacgcatcgcctgcgttatcgtgatcggcctggccctgcaggtggttgttggctacgtgaccgacgccgcgctgtcgttgttgcccgatgccgcggccgactacagcgagcttgtcgaggaaacaggcatgggcgacaccagctatctcgccgtcctgaccacggtgctcggcgccccgttttgtgaagagctgctggtgcgcggcattatttttgagttttcgctccgagcgtttaatccgcagtgccgcccactttggaagcgccggcgtcgtgcgagcgcgcaggacggcgccatggtgccctgggcggccccaagcacgtggggtatcgctgcggcgattgtgctgcaggcggcaatcttcggctttatgcacatgaattgggtgcaaggttgctacgcgggtgccgccggcctcatctttggttgggtgctcgtgacgaccggaaagctccgctacacgatcctgctgcactttgcctttaatgccgggtcgtatctcatgacgttgctctggtttgtgaacacctcgctcgacgtggtggtcacggtcgccatcgccggcgtcatcctcgttgaggcaatgcgctcgctgcgccacgcgtgtgggatggacgcagcgagcgcaccgctgccctagttgcgcctgccgcctccgttggcgccctgccgtccctgggccgcgcgattgcgacctgcggtgttttgcgcacgcgacatgccgccgtggcccttgctgcctttgggtcccttgccagcgccaccgccatgtggtttgccgcccttcttgccggttccatgcccaccgccagcagatgtctcgcccgggcgcgggggcacgggacgaatcaggcaatgcttggtgtagccgatcagatcgcggcggccagccttttccagcgcctcgcgcacgagcttgtagttctcgggcttgcgatactggatgagcgcacgctgcatggccttctcgtgcgggtcgcgcgccacgtagatcggctgcatggtgcgcggatccacgccggtgtagtacatgcacgtcgacatggtggacggcgtggggtagaagtcctgcacctgttcgggcatgtagcccatgtcgcgcacggcttcggcaaggtccacagcttccttcatcgtcgagccggggtggctcgagatcaggtatggcaccacgtactgcttgagtccgtattcgcggttcaggcgttcaaatttacggcagaacgcgtcgtagacggctcggctcggcttgcccatcacggacaacaccgcgtcgctcacgtgctcgggtgccacgcgcagctggcccgagacatggtgctccagcagctcgcgcaaaaactcgtccgaggcatcggccatggtgtagtcaaaacggatgccgctgcggacgaagaccttcttgacgcccggcagctggcgcaggtcgcgcagcagctgtgtgtagccgctctcgtcgaccaccatgttcttgcatacgctcggccacaggcagcgtttgttcttgcacacgccgtgcttgagctgcttgtcgcaggcagggcggctaaagtttgccgtcggtccgcccacgtcgttgatgtagcccttaaactcgggatcgcgcgtgagcagctcggcctcgcgcatgatcgaatcgtggctgcgcatctgcagcacgcgcccctggtggaaggtgagggcgcaaaacgagcactcgccaaaacagccacggttggagctaatggaaaacttgatctcggcaaaggccggcacgccgcctgccgcgtcgtagtcgggatgccaatcgcgtgcgtaggggagctcggccacctcgtccatctcatcggtggtgagcgtcgccgatggcgggttctgcaccacatagacgctgttggggtagggctctaccaggcggtgtccggtgatggggtccatattctgctgctgcacattgaagctgcgtgcgtagttgagcttgtcggcggtaaggtcgtcccagctgggcagcaggtcgtagtcgtagacctcgtcgagcgaacccgtgcggtagacggtgccgttgatataggtgatctgatcgacgggcagtcccgcgtcgagcgcgtcggcgatctcgacaatcgcgtgctcgcccatgccgtagatgaggatgtcggcgcccgagtcgagcagtaccgagcgcttgagcttgtcctgccagtagtcgtagtgagccaggcggcgcaggcttgcctcgatgccgccgatgatgatgggagcgtccttgaacgtctgacggatgaggttgccgtagaccgtgacggcacgattggggcggtgcccctcctcgccaccgggggtataggcgtcggtatggcgacggtgcttggtcaccgaatagtggttgaccatggagtccatgttgccggcgctgaccaaaaagcccaggcgcggctcgccgagcacgctgatgctggcaggatcggtccagtcgggctggcagatgatgcccaccttgtagccgtgcgcgtcgagtacgcggctgacgatggccatgccaaagctggggtggtccacgtaggcgtcgccgcagatgtagacaaagtcgcactggtcccagccgcgcgcgtccatatcggcgcggctgacggggaggaacttgtcgcggcccgggcgccagggacgggcaggcgctgccggggtatgagtggcgtggccgccctgggccttgccgccgcgcttttgctgctggccctgtttgccctgctgactgcgctggttgttctgagcgtactgaggcttttttgccacgatccctcccggtgtttgtatgctgcacgtaattgtaaccagtctttttgggacggggctaaaaagactggtggagtacatgggctggcggatcggcgcgtcgatgcgggtgtcgtttgtttccagactgtgtatccctgtgtcgaaggggtcgtctcgcgcgcacgccatgttgtcaatgggttacagtatgaacggcggctatgtttccgccaacgcacgagagagtcgtcaacaaggaggatgcacgacgatgcagcgtgccaaacagatatcggagtctattgagctgggcatcatcttggcgctcgccggtggctttatggacgtgtattcgtacattgggcgcgaccatgttttcgccaacgcgcagacaggcaacatcctgctcgtgggcgtgagcatctcggagggcaactgggcacttgcggggcgctacttcttccctgtggtgtcgtttgccgtgggtattatgcttgccgatctggtacacgagcggtttggcagcgtgatccactggcgtcaggtgacggtgttctttgaagccgtcatcttactgggcgtgagctttatcccgggcggcaatttcaacctgctcgccaactgcctcacctcgtttgcctgcggcatgcaggtcgagagcttccgcaagatccacggtcacggcatcgctacgaccatgtgcatcggcaacttgcgcaacgcgctgcaaaacgtggacgattacatcatcacccacaggcgcggctttttggaaaacggcctgctgtactttggcgtgatctttacctttgtgtttggcgctgtgttgggcaactggtgtattgagcgcatgggcctgcacgccatcgtcgtggcgagcttgctgctgtttgtcgcgtttgccatcatgttcatcgaccgcgagcgcgacttgcgcttacgctggaaggttgcggccgaggcttggaaagagggctgccgaaagtaaccgaatgcggcaaaggggctgtccctttgtcagatagatcgataatggggaggggacggccatctcagccgcccttttttgagtcttaagcctaaggtgcatgtttgtaatgacaagatttgacgtcagcaaagcgtgctgcttaaggctatagaataaaaatgtcatctttctagctataattattagttgaggggatggacatatgccagagctttttattcaaaataagacgacagtaatcaagttgatggcgctctgcattttatctgccctggtggagctgtctgttgttaaagctgaatcgttgataatagactatggcctgcttcgctctaattatcgcaacgttttatgcattgggttaggcctgctagtattgctctcagttgagctggtgacaaatctgttcagatcaaaatatgcggagcaattggcttccgatggtgctaactgcttctatagattgcttgcccgccatgctttagagcggcccttagttttagcaaaagacagtgactacctgttatcgcgcattgaagaggccgggaacctacagccgatgattggaatatttacaactgcgtttcttccgtgcctagtgacgggtttggtatcgtttgtggcgctatctaatatctctatgttgcttttgattcctgtttgtgtttcggcattgtttatttcgcttctatatccgttcgctcttagtaagctatcgactaagagcgaaaaggcattggaggcccaggcgaggggttctgcttatttagcccagctaataaattgtcgactttacattcgtatttctcgttcaattaacttggaattacttcactataaaaagatgcttaaagcctgcaggaactctcgagttgaggagagcgtctttgcgagattggcaactgaaatagttgacgctggcaacatcattactggcttgctttcagttctgctgcttattttccttgtgttaaagcgcgggctgacggtcgggattgcagtgcagagttatcaacttgtacttctatgctattctccttttcctcttgttctgaattgttgggctcagcttcagccgtcgtttagatcgttgcaccgtgtcttggaattacgtcgtcttttggaagctgaaaaacctaatttgatatgcttcgatcacgctgatcgaattagttggaaaggaatcagtctctcgttttcgtcgaacgaaactaatgagaggataacaattccagattgcacgatacaggcaccttgtctggttttagtaagcggccctaatgcatgcggtaaatcttcatttctggaagtattgaatggattattgtctccagttgctggcagactgtgtgttaatgagtctactgtcattttcgatggttcgactttaatccagctaccctgcgcaactatgccgcaaagacatttgataatggggggaactttcaggaaggctctttactatggtcttgtagatattgactctgaaaaactcatctatcttttgaggggttttagcctcgataaattatttgaatcaaatcccatcattggagctaggggacacaatttgtctggcggagaactggcttctctattactttgtagggcctttctgagcagttattctattgttattttggatgagccttgcaacaatttagataatgcttcgatatcctttttgaaggtggttgttgcgcaggagatgaaagagcgaatcgtcatcattgcggatcatggacatggtttcgaacaatttgcggactatgtaatacagtttcaggagccagaaaaaactatctagctcctgaacgttgctacgaactgctttttgcgatttattcgagatgctcttcaatccgagccctcagaagggcaatggctgtgggtattccaattgcggcggctaattcggctttatccaaaacctgtatgctaaagcacgattgtttatcacattgaaggacgataactgaagatagcttcacttcccgttggctgaatatgtcgtaatccccaaataggaagttaccttttattgtgtaattcggtatgttcgttacgcacttcatctcaagtctgtttaggccataatcgaacaccgcaacttccttgtgttcgatgatgagcgcaaccctgggcatgttactaaaaccaccgtcgacgacagtaaagagtttttcatttgcatcgtcataaacggtatattttagactcaatagctgtcctagtggacccgtgaacccatgtcttttgatattgaggttgtctccggctgggttgatgagagctagagcatgcggataagggttaccttcaattgagattcgatattcgtttgtaaccgtcttgctcgatttaggaccagtagccaccacgcgtcatcgcctcgatcgaattggaaccgacttctgcttcgtgcggagaattgcgcagtatgttgcagtacatgcagctgcaataaccgcatgggcaatttctaacaaaatgaatgacgctatttactgcatgcatgttaaatggacgaatacttctcatgatctgcctcccattgttcgattgtttctgactgttctattaccttcttcacctcctcaacactgttgaaccctaggttttcaatcgacgagtactcaacgtaaacagaaaacctgctttcaagataaataagcagtcgaactaaatctgatgaggacaagttgaatggcgggtcggtcaattgctgatttcttagattttggtcaaattgagtcaaatccaaatctctaatattgtttatcgctttttcgatttctgcgtagatggtttcatctttacgatatgctgtcatttcagcaccccaatatcgaaatcaaacaactcgttctcgattgttttgcagcatagtaatgattcttctggatctaagctggctgagaaacagggcattcctcttagtcgaagttctcttgctgcttgaattgctttatcgctagatgaatagcttatttgaaacctatgcgtctccaacccttcagtggcgtcaagtacttcgtttgtaatttcaaattgaactttctctgcttgcgttagcgtttcaattatgggcatgagtccaagcattatgtcgtagtcggctatcgtgtatgggatattgataatggccaagtcagggcagaaagctcgacatgcagcaatcgatcctaatccgtaatctccgtaaatgtggtcgtcgtatttcataagcacattgggcgtttctaatagagctaggtcggatttatcattctcaatgatgatgttgatctgctcattcattttgatgacggcggattggccaccatcaaaactaagggtgttgcagccccagatttcatttaaaggattgaagctcaaagcgcatagattgggatggtgctttctcatctcgctaacgatgctactaaacgtaattgttgaatcggcgggtgtatatagattcccgacaacaatttttggtatcagggctaattcctgcatgtcgcttttgctagactcaatttgttcagtggcgagttgactgacaaccttcttatttacagaatgtgcataggtttcagcgtgtttactaaattctatgagtcctgtggcgctttctttcgtcgataaaacgacaaccaggtctgattcatcgattgtcgttacatagttaattcgatttcttatgccaatttctttgcaattaacaaggttggcaacatctacgccgtccggcagaatgccgcatggtgttgatacccgaatattgtagccaactcctagcaatccaattagaagaggatagtcagctcccgtgaaagatataagtccaattgtcttcatgattattatcgcttgttccttttaagagccgttgtaatggacacttcgtgtctatgaagctcaaagcgaagtattttctgattaagtcgatcaaaggcaattcgttttgagttgtcgcatgctgttcgtttgtaatcagggctaattactcctttgcaatctgcgcttttaatgcattgagtgcacagctgaaatgcccaacattttttacatgaatcgctggtcagctttgaaacattgatcatcttttcaatttgacctaaatcaaatcctgaatccaatgtaccgatatacatgtccttggttgtttcgctgaccctttcgcaaggaagaagcgctcctgctgttgtcacaaatagacgcgtaactcctggctcgcatggaccaccgggtatagcttttgttgggatgttcgaaggtgcaaatcgcttaatgttttggttgatgcttgcaagcgtatatgaagcgagcctatcgctacagtttcctttttcgatcttgcgctcgtccataattcttgctttaaataaggcgtaattcagttgacttgagaacttgtcattgtagggggcgatacgtccgttgcgttccaagtagttgaattgaacatcgcaagcctcgatatccttatcatttataaaggaagagactgttttatagatgttgttcgtgtcgactacggcattaaaatgaatatatttgttgcgttcaggatggttgtctaaaatcatatgaacattgtctataactgcttggtatgaggactcaccattagcgtaatgcctagacttatcatggatttgctgcggcccgtcaagactgattagcaaatagaattcatgtccagaatcgaagaagaatttaaccatatcttcagataaaagagagcaattggttgtaattcgaaatgagatgtgttttccttcaaattcctgttctgcatattgagtaattagcttaatttcactaaatcgaaggagaggttctcctccataaaatgctacgaccgggtttgggttgtcaatcgagtgcatcttaaagaattcgattgcatgtttggccgtcgaaacagacatagagttatgactgtgggttctgttgtataaggagttttcggaatagatacagtaatcacatcggaagttgcaagattgagtcagctgaagggttatcatccgtaaatttctttccagcttaactttcaaaaggtcaattgatggataagcgacatcctgcaatggcgaatcgcagcagtagccacatgattgtagtaactggaattcttggtctgatttataggagtcggggcaaacttcgcctgcttggacttctgagatgtaattgaagagatctttgcttactgcaagtatctcgtttcgattggcatcataaatgtagtggcccaagagggtctttatgggtagaactaacatctctaccgcctttttcatttcactaatgttattttagtgaactaagatgtttactataaggtaaccatttataaacgtattgtcaaacatatattgctaaaacagaaacaatttatagactgagtggtcgtatcctttgggcgattgcttctataatctagccttcgctgctgtcgggagggaaggtctaggactccgttatcatgttgaaacgctttaactaatttgacgttctcacgtgtttttcgtttcaaaagcgttaggatgggactcatagcgtggggcgtaatgggtgccccgcacacgatgggaggctatcaatggctaatcgtttcgttctcaataccatctcttatcatggttccggcgccatcaaggagatccccggcgagctccagcgtcgcggctacaagaagattttcgtctgctccgaccccgatctggtcaagtttggcgttaccgctaaggtaaccgacgagctcgacgctgccggcatcgcttggagcctctactccgagattaagcccaaccccacgatccagaacgtcaaggacggcgtcgaggccttcaaggccgccgaagctgacgctatcgtgaccatcggtggcggctcctccatggacaccgctaaggccatcggcattatcatcaacaaccccgagttcgccgacgtccgcagcctcgagggcgttgctccgactaagaaccacgccgtgttcaccatcgccgtgccgacgaccgccggtaccgctgccgaggtgaccatcaactacgtcatcaccgaccccgagaaggtccgcaagttcgtgtgtgtcgacaccaacgacgcccccgaggtcgccgtcgtcgaccccgacatgatggcttccatgcccgccggtctgaccgcttccactggcatggacgctctgacccacgccatcgagggctacaccaccaagggcgcttgggagctttccgacatgttccactttgaggctatcaagctgatcagcgagaacctgcgcgactccgtcgccgaggccaagtccggtcagcccggctccggccgcgagggcatggctcttggccagtatgtcgccggcatgggcttctccaacgttggcctgggcatcgaccacgccatggctcacaccctgtccgctcactacgacaccccgcacggcgtcgcctgcgccatgctgctgccgatcgccatggagttcaacaagccggtttgcgccgagcgcctggccaaggtcgccgtcgccatgggcgttgacaccacgggcatgagcaccgacgaggctgccgacgccgccatcgccgccgtcaagcagctctctgccgacgtgaacatcccgcacgtctgcgaggccatgaaggctgacgagatcgaggtcctggccaaggacgccatggccgacgcctgcttcccgggcaacccgcgcgaggcgacgctcgacgacgtcatcgagctcttcaagaagatctgcccggctgcctaacttggttcggcgggcccctgcccgttagccccacaatcgtcctcggacatgtcggaagcccccgctgcgcacttcgtgcggcgggggcttcctccgtcctgcggaaagattgtggggctaacgggcagggggcccgccggctcgttatcgtggcgggcgcagttctgaagaactcaatgggtcatctcgctaggtaaaaagatggttcgcggtggtatcgttgctgtgggtttaattcgatatgaaagggtgactttggtgtccaagatggattctacgctctcctatattactgaccagttgaaggcgctgacttctatcgcttcgcctacgggctatacccgtgcggcgactgattatctgatggagacgttgcgcgatatgggctttgggcccgagcgctccaataagggcaatgtgctcgttgagcttggtggtgagggtgagccgctcgtgttggcgagccatgtcgataccctgggcgccatggtgcgctccattaaggacaatggtcgcctgcgccccacgactctcggcgggcatcagtggtctacggccgatggcgagaactgcaccgtttatacgcgcgacggcaatgtctacacgggcgtggtcctcaataccgagccttcggcgcacgtggccgatgagccggtcaagaccatcgagaagaacatggaaatcctgctcgacgagaacgttgacagcaaggacgatgtgctcgagctgggtattcaaaccggcgacatcatcgctatggatccgcgcaccacggtgacggagagcggctacatcaagagtcgcttccttgacgataagctgtccgcgtcgattctgctgggtttggcccgcgccgtcgccgaaggcgaggtgacgctttcgcgcaaggtttcgttgctctttacggtgtacgaggaggtcggccacggcggtgcctttgtgccggccgacacgcgcgagatgatcagcgtggacatgggctgcgtgggtgacgacctgggctgcaccgagcgcatggtttcgatttgcgccaaggattcgggcggtccgtacaactacgacctggtaaccacgctgtctaacatcgcgcgcgagctggagctcgattacgccatcgatgtgtacccgcactatggctccgacgtcgaggccacgctctcggccggctacgacattcgccatggtctgatcggccccggcgtgtacgcgagccacaactacgagcgcagccacatcgacggcgtgcgcaatacctacgagctggttcgcgcctacgttcagcgctaggggagtagcttgcgactcggctgaccaatcgctaaggcccgatttctcgggccttttttcgctttgggtcgtttagtatcatgatgtatgtaatctattaactaaacgtttaaattacttaacgaggtgatgcggtgtatggatacgtctgagtacttgtctatgggtgatgctgcccgtctgctgggcgttacgaaagcccgcatatctcaacttgccgcatcgggaacgctcgcgtgcgatattgtgggcggacggaagatggtcgagtacaattccgcggtcgcttatcaaaaggtccgcaaacgtggacgccgtcctgcggccgatgtggggcgcaagtttacgctgatgtccgccgattacgaggttgcgcgtgtctcatttgatccgacgcgtgagtttcccttcgaaatcgccgaggtactcgatgcgcggaggatgccgtttggcacgtgctcgagctcttctcctacggtgaataaacgggagctcaacgtgtggtggagccatcggtcggtgcctgacgtccgccctggactcgtctcgcgctatcgtgaactgggaattgccagtggcatcgaggttccggttcggtgcctgggcctatcgctttcggattgttattggctgcggccggccgattgcgacgaactcaaatggcaaaacctcaattacttcgagaatgattttgagcgatcggcgcccgaggggcgttcgggttggctggaaggcatcggtcttaaaaatccggacaacacgtccgagggcgagctccctaaatcgtggatgattcgcaacggtgttcgcgttctggtcaaggggtgcggcatggacgaccaacggccctttaacgaggcggttgcaacggctctacatcgtcgcttgctgtcggagggcgagtttgttccttatacggttgagcggatgttcgatggccctgtgtgtctgtgcgacgactttcttgacggccgcgaggaatacgttccggctgtttacgttaaaggcgcacttggtagccagcggggaaactcgacatacgaccggtactgccgcttccttggtaagcatggtgtcgatgaggctgctgtgagaaggtctatgtcgcagatgattgtctgcgatgcccttttggccaacagcgaccgccattggcgaaacttcggcatcatccgcaatgttgacaccctggagataaggcctgctccgctgttcgatagcggcaactgcctgtggtacaacgtaccaactgccgtgctcgcagctggggagtttgggttttccactaagccgtttgggcccgactcttccgtccagctggcgcttgcggactcgctcgattggttcgatccatcgcggctcaacggatttgttgatgaggcgatcgagattctttcgcagagcgaatgggcgacggcggagggtcgactcgaggccatttgccgcggcctcgagcgtcgcgtaatcgaggttagtgccgctgttgaggtgcttcgacacgtgcagcgataaacctgcggctacttaagtgcgccggtcaccgtaccgccacccaggacgatgtcgccgcgatagacgacgacggcttggccgggggcgatggctcgttgcggctcgtcaaaagttagcagcatttgtccgtcggcgtcacgcgtaagggtcgctgcctggtccttttgacggtagcggtacttggcacctacgcgaatgccgccggcgtcgagctccgcctccatgcgtgcgtccggcgcgctccagatccactcatcggccgtgagggcagcggcggtcaggtcctcggcctcacccagatgcacggtgttgttggcggcgtcgacgcccgtcacatacacgggatgcgccatcgcgacgcccaggcccttgcgctggccgatggtatagcgcagcgcgccgttgtggtgcccgaccacgctgccgtcgcgccacacaatgtcgcccggtgcagcggcatgtccgcagcggcgctcgatatagcctgcgtagtcaccgtccgcgataaagcagatgtcctcgctttcggccttctgggcgttggtaaagccctgctcggcggctatgcggcgcacgtcgcgctctttgtccaggccagccagcggaaagatcgtgtgcgccaggcgctcctgcgtaagtgaatacaaaaagtagctttggtcctttttggggtcctcgccgcgatgtagctgccaggtgccgtctgccgcctggcttgttttggcgtaatgtcccgttgcgatgtagtcgcagcccatgtccagcgccgcatcgagcagtgcgccaaacttaatgtggcggttgcagataatgcacgggttgggcgtcagcccctcctggtaggcgttcacaaagcgctcgataacactgcggtcgaaggtctgctgcaggtcgagcacatgatggggtatccccagacgctcggcgaccgccttcgcgtcggcgatgtcgcggccgaccttactcatgcccgtggcggggtcgggtgcggggcaggtgaggcgcatggtggcaccgacgcattcgtagccctggcttttgagcaggtacgcggtcacgctggaatcgacgccgccgctcatggcgacgagcacgcgcttgttgtgcatggggaggttctccttggtggcatgtggccaaaaaagaaaagcggcgcgggaggctggttccgcgccgcagacattgtagcaagttcgggcgtcgtgtgggacaccctaacgagatgggctcaggcggccagaagagagggtagaccggcgtgccttgggcctatcgacaagtgacgggcccttagtcctggaagagcgccgtggacaggtagcgctcgccggtgtcggcaagcagggccacgatggtcttgccctcgttctcggggcgcttggccagttgcagtgcggcccacacggcggcaccggacgaaatgcccacgagcacgccctccttgtggcccacggcgcggccggtggcaaaggcgtcgtcgttctcgacggggatgatctcgtcgtagacctgggtgtcgaggacgtcgggcacaaagccggcaccgatgccctggatcttgtgcgggccggcctggcccttagagagcaccggtgaggtggcgggctcaacggcgacgacctgaatctcggggttctgctccttgaggaattcgcccacgccggtcacggtaccgccggtgccaacgccggcgacgaaaatgtcgacctggccgtcggtgtcgtcccagatctcggggccggtcgtggccttgtgaatggccgggttggcggggttcacaaactggccggcgatgatgctgttgggagtctccttctgcagctcctcggccttggcgatagcgcccttcatacccttggagccgtcggtgagcacaagctgcgcaccgtatgcctgcatcagcttgcggcgctcgacggacatggtctcgggcatggtgatgatcaccttgtagccgcgggcggcggccacagaggcgatgccgacgccggtgttgccgctcgtgggctcgatgattgtgtagtcgccgccgcgcacgagcttgcctgccttctcggcctcgtcaatcatgttcttggcgacgcggtctttaacggatccggcggggttgaagtattccagtttgacgagcacgcgagccttgaggtcctcgtcggcctcaaagtgagtgagctccagaagcggggtgtggccgataagctgatcgatggacgtgtaaaccttgctcatggtgaacctccaaagtgttcaagttgctggttgccgtgtggttttacggcgtgtctagcagctaaacccataaaccttataggttgttcgtttagctgttggcaagcatagtagacactaaagcctagtaatgcaataggaaatagaagattattacgagtcgattaaccatcttgaccggaacgggtatttccaaagccgatttttcggctagaatttcaacggactaaaagaccgaaaggcagcactatatatgttggtttctactaagggcaggtacgccctgcgcgttatggttgacctggccgagcaccaggcggctggtcgcatcccgctcaaagagatcgcggcgcgacaggggatttccgagaaatatctcgagaacatcttggctacgctcgtgcgcgccaatatgctctcgggcatgcgcggcaagggcggcggttatgtgctcacgcgtccgcccgagcagtacacggtgggcgagatcctgcgcctgaccgagggcagcctggcgccggtcgcctgcctggatggcgactgcaagggttgctcgcgatctgatgagtgccccacgctcgacgtgtggaagaacctggacaagctcatcaacgactacctcgacggtgtgacgctcgatcaacttgtcgctcccaaccatggctacgactatgtcatctaacccacgcctgccatgtggggacggggtggaaatggtagattttcttgccctctgagacttggcaaataagaaggccgcccattttttgcgatgggcggcctttgatttggttcgatgcgtctgtgtatcgggggtgttctactcttcggcaatactatcgaggatgctgcgcatgatggacactaggatgctgcccataaaggccgagccaaagccggcgatggagatgccgacgcccaacaggttgaccgacaggtagctggcgagctccagcataaagctgttgagcacgagctggaaaatgccgagcgtaatgattgtgagcggcagcgagatgaccgtgaggaacggtttgacgaacgaatctacgatgttgaggaacagtcccacaaaggcaaagcagacccaggcctcggcaaagccgaagggttggataccggggacgaggaacgtggcaatcgcgatggcgatcgaggtgaagagccagttaagcataaagcgcatggcgtgaatcctttcttgcgccggggttgctggcgtcgcgtgaagcggcttgcggcggcgacttggatggttgcgcgggcgcgccgcggtgtttgggcgcccattgtctcaaatattcgtggagcttacgtgcgcattcggtttctaaacggcgttcgtcctgaaaaacgtgccgctgacagagagtcttgtcactttagtttggtggtgtgctacactgctacgggcaaatggcccatgcatagttttattgcatatttacgggcgaacgatgcccgatgtcagtatcaacttcgatgccttatggcgggtttggcggtgatcgatgaatatcgagaacatgtttgacaagcctgatgtcaagcagctggtccacgcatttagtcttttggacgacgagaacgatatccaggcgtttttaaccgatatctgcacaccgcgcgagatctgcgatctttctcagcgcctacaggtcgcgcgttatctggatgagggcgagccctatgttgaggttcaggcccgcaccggcgcttcgtccaccacggtgagccgcgtgtccaaggcgcttaatggcgagtacggtggctatcgcaagatcctcatcaaactggaggatggcgagtaggccggcggcaacaaacgaattgcgcagaaccgtcccttcgggggcggttttttgatctctcggggacggaggaaaacaggtcaccgggttagactgaccccctcggtgatccgttttcctccgtccccaagggatcaaatctgttggcgtggggcaaatctgtccgcgcgggcgggtaggatggatgcattgattattgcgaacggtttgagtggaggaccatgcctgttcgaatctataccaccaataccgggacggacttgagcgatgccgaggcggcgttgctcgccgacctggttgcccgccacgggcgtgccgttttgctggcgccctcgtttgccgagctcgacgtgtgccgtcacgatgctgcggttgctggcgcctcgctgggcgttgactacaaaacccccgcgtcgtggcttcgttcgctgtgggagcttatgggcgatggccgcagcttcgtcgacaacatgcagcgccagatgctgttctcggacatgatcgcccgtcgcggcgataccgacctgcagccgctttcgcgcagtcagggcacggtgcgcatgctcgcgcgcatggcccgcgatgtgctgccgggcgtagcgggaacgggtgccgagcgctgctgcggcgacgtttgccggtacgatcccaagagcgacgccgaggctcgcgtgttcgagctgttgagtgcctatgcgagcggcttggaccgtcgagacatggtcgagccctgcgaggcggctgaccttatggccgaggtgctggccgacaaccttccggcgtgcgcccgcgcggtatgtgtgcgcggcatcacaacgtttacgcacggcttgctcgagctgctgtctgccgtggcgaataacgggggagaggtcgttgtgctgcttgcccgcgagcagacggcgatgcgcgaggagcttgccgccgcctttgatgcccgcggtgtgatgtttgaggctgcgccgctgggggagggtgccgctgcgccccagactgcctccaagcccgccactcagcctacctttgtagaggttgccggccctcacgcccgcgcccacgcctatgtgggtgcaatcgatgagctggtaaaaacgtgtgaggacgccgcggtcgacggcggtgtcgcggcgtccgcggaccccgtgcgcgtgctcgtggtgtctgcccgggcgccccagctgttcggtgaactcgctgcccgtttggcggcgcgtcacattgcggccgagacaaccgagttcacggcgttttcccaatccatcgcgggcgggcagttcacggcgctcgccaatctgatcgagcgcatgaaggccgccgacgagggcaccgcctccaagaccgagtggtggcccgcgccggagcttaccgactggatttacagtccgctttcgggtgccgacgccgccagcgcgcgcaccttcgacaagaacatgcgcctgtcgcgcggcaagaccaccgcggccgtcaagagcctgctgcagagcgtgcagggccaggtcaggggcacgcgcaaggccgccagtgatgataactggtttaagaacgtgccgtgcgtggtctcggacgtgttccaagcgctgtggcgcgacaaacccgtgacggcgctcaaggcaatgctcgccgtcgccgaggcgttgcccgatcgcgcccttggaggccttgacggtcaggctcgtcgccaggcggagaccgccctgctgcgacatgccatcgacatccttatgaacgatgctcgcgcgctcgacgtgtcgcaggccgcgaccgtgcccgtgctcgacgacgttcgtaccaaggtggacacgcgcagcaccgcatacgattacgagacctacgaggtcgaccgcgcgccgcgcgcccaggtgcgctttacgtcgcttgccgatgcggcagccctgcgccccgacagctacgatgccgtgctgtttgccgacgtcgacttggacagttatccgctctcgcatgaggagggcccgctggccacgctgacggccgagctggggcgcagcggcgtgacgcttgagcccgcggccctgctgcgcgtgcgctttggccgcgcgatgcaggcggcacgcggccccgttgcgctcgcccgcgtgacccacgatcgccaggcgcgcgagtgctacccggctgccgtgtggaccgagctgcgggcgcacgccgaggccactggcgccgtcaaggttgcgtgcgtgggcgagggcggtatcgtcgccgattttgaccctgcagccggcgagggcatcgggcgcaagcgcgtcgcgtgcgaggctcctcagcatttgagtgaggcggccgtgccgtacctggtcctgcgtcgccgcgatggcgagggcgagaacgcgccgctcgtgccgcgtctgacgtccgcctcgcagatcgaggcgtactcgacgtgtccgctgtgctggttcgtgtcgtatcgcgtgaagccccagtccatcgacgcgggctttggcaacatggagaagggcaactttgtccacgatgtgctggagcatctgcatgcccgcctgccccaggagggcatggagcgcgtgacgcccgagaatctgccgcgcgctcaggggctgttgcgcgaggtctttgacgagacgttggccgagcacgccggcaagcgcggcacggagggcccgctggtgccgctttctgcggtggaggagcgccaggtggccgagatcttgccgcagctggagggtgtgcttgcctacgagtccgaggcacttgccccctttgccccgcgctacctggagttcgcctttaacgagctcaaggttgagtatgccggttggccgcttggcgggcgcatcgaccgcgtggacgtggacgccgagaatcgtgccgtggtgatcgactacaagcatcgcacgggcgttgaggagtttaagctcgccgaccctacggtgcgcgacgaggaatcgggcgcggcgcccatcgacgacccgcgctggttgccgccacatacccaaacgctcatctatgctcaggccatgcgccgggcgctggatttggacacccgcgcggcgctctacttttcgaccaagggcggcaagccggcgctgcgcggcgccgcgagcgccgagctgctcgaggaagagcgcggcgacggtcgcatcccgggccttaagaaaggtttccccggcgagggtggcaacatggacttcgacgccctgctcgatcgcgtggaggccggcatcgccgagcgcctgcgcgagctcgaggcaggcaacgttgccgccgtcgacccgacgtcggctcaggccgcgcatgcgcgctgctcgtataaccacgaaggaacgtttgtaaggagggacgtgtagaccatggatctttcgactttgatgccgcaacagctgcagatcgtcaaaacgctcgaccgtccgctgtttgtctcggcgggcgccggttcgggcaagacctttaccctcacgcgccgcatcgtctacgcgctctcgcccgaatccggtccgttcgttgagcatctggaccaggtgctcgccattacctttaccaaagacgccgcggccgagatccgtgaccgcgtgcgccgcgcgctcatcgacgagggcatggacgaggaagcgctgaccgtcgacgacgcgtggatctcgaccattcacggcatgtgctcgcgtatcctgcgcgcacacgcgttggagctgggcatcgatcccgagttcacggtgctcaccgataccgacgagctcatggaccaggctgttgagcatgtgctggcccgcgcgacggcgcccgatgccgcccccgagctcgccgcttcgctcaaggccctttacgcctggtatcccatggcgggcgagggcgggccgtttggtgccggcaccaccatcaagggtctggtgcgcgagctgctggagctctcgagccagctgccgggcggcatggacgacgtgcatgtggcgcgcggacaggccgacacctcggcgcttgccgatgcatatcgcgcagcactgggtgcgagcaaggccgcgaccgagaaggcacaggtggcactcgacgccatcgatgcgttcgaggcgagcggcaagaccatggccgatgcggcgcgactcatgatgtcgtgcaccatgccacgggcgagcaaggcatttcctaaggagcaggtcgagctgctcaaggccgaggccgccgatgcatttatcaatatcgtgctggcttgcggtggtccggcactcgatgcgctggtgggcttggcccgctctgtagaggctgagtatcgcgcgctgaaggccggccagtctgccctcgacaacaacgacctgctgtgtatggcctacgaggccctgcgcgattacccggccatccgagcggcatacgagggccgctttaagatggtcatgatcgacgagttccaggataccgaccagatgcaggtcgatctgatccgctacctgacgggtgcgggggagcgcgcgctgtgtaccgtgggcgatgcacagcagtcgatctatcgtttccgcggcgccgaggtcgaggtcttccgccgccaggagcgcaaggtgggctcgtctgccgcgcccgaggcgactgccgtgaccgacgcccctgctggcgagctcgtcaaactcgtgcgcaacttccgcagtcacgacgaggtactgcgttacgtggcacgcgtcttcgacggcgatgacggcggcctgatgcagggctttttggatcttgaggcgagcgacggccgcaaggacacgctggtggcagatgcctcgcgtcgccaggccctctttgttgccggcggcagcacgcaggagcgcacacaggccaaggcccgtgcaatcgcggagcgattccgcgcgcttgccgatgccggccagccccagggcggcatggtgctgctgctgggccgcatgaccaacgcagacgtctacgcacaggccttccgcgaccaggggctcgactgcgtcatcgcgggcggctcggtctttgcccaagccgccgaggtgcagacggtgcgcgccctggtttgtgcgctcgccaatccggccgatacggcgcagggccttatgccgctgctggcctcgccgatgtttgcgctcggcgcccaggagttcctagcgctggcgaccaagctcgacgagcagacgggggagacctcgcgcaggaatatcgacgtgggcatcatgagcgattccgatgtgccgggcctgcaagacctgccgctcgtgacgcgcgcccgcgaggtactgcggtgtgcgcttcgtcgcgtgggccgcgattcgttcgcagccatcgcgcgcgacgtggtcaacgcctccggctggtttgtgcgtctggcacagcgtggtcccgagggcaaggccattgccgccaacgtgctcaaggcgctcgacgctgtggccgaggcggaggccgagttcggcaactcgccgcgttccatcgcgcttgccttcgatcgcttcctagcgggcaaggaagccccgggtgccctcaacgaggagggcgacggcgcggtgcgcatcatgacggtgcacgcatccaagggcctggaatatccggtcgtggcggtcgccgagtgctttggcgtgcgcaaatcgtccggtgcggctcagatggggcgtgtcgagggcggggcgcaggttgtggcactgcctgcacgcttcgacggcgttaagctcgccgacggaacctttgtgaagggcgacgacgttaaaaagcagtttgagcatgcgtttaagggcaagggcacgtcgctatggctgccgccggagctcatggaggacgtctgcgcgacgggttctcccgctgaggcatttgctcgcctgcgcaacgacgacctgcagctttcgctcgaagagcgggctcgtttgctctatgtcgccatgacgcgtgcgcgcgagctggtgatcttggcgatggatgccggcgtgagccgtggcaaggtgacggcgccgaccttcgacgtcgagaccgatctgacctacgacgtgctgcgccgtattttgccgaccgacgctctggacatgccacagctcgatagtgatcgtttgacgttcgacaactccaagccgggcgactacgagctcatttcgctcgcggactttacctttggcgagcaggcgtttgaggccaacgcttcgctggatgccgagggcaggcttgtccgcggcgatgcggagccggagggcgccggtgcagatgcccgcgccgccgttcccggtcctgccgaccctgagcccgatgcgtttgagctcgtgtatccccaggcggtgggcgtgcgaatgggcatctgcccgtatccggcgcgcgattcgtacagctactcgtcaattgccgcggcgctgcatgccgagtccgaggaccgtgccgccgaggcacgcgtgcccatggacgaggctggcgatgatgcggagtcggatggttccgagatgacggatgcagacgtggccgccgttgagcccgccggcaaccccatggcgctgggctcggcgttccatgccgcctgccagtggctgatcgagatgggtgccgatgcgctgcccgccgcgcgtgccgatgcgctggcgcgcctgtggtgcctgacgccggagcagcgcgaacgctttgacgttgccctggaccgctggctcaagtcggctgttcgtgccgacctgctcgcgtggccgtgcgttcgcgccgaggtgccgttcttttcgctgggctgcgaggacgaggacatcgcccgctacggtgcatatgccgaaggcgccatcgacgctttggcgacgaacccggcggattcgtcacgcgcgctggtaatcgactacaagacgggcggcacaccggacgagacgccagaacagctgcaggagaagcacgccctgcaggcgcgcgtctacgccgacgtgttgcacaaggcggactttgaggccgtgaccgtcaagttcgtccgcgtggagcaagtcgacctcgccaacccgtgcgagcctcaggtggtcacctacagccgctagccctcaataacttgcggtggaatacggactgttttggccaaaaaagccgccaaacagtccgcatttcaccgcaacgcatgggagagcctggggcggtacaatggctcgaacggttcaaacgaataaggagccatcatgcagctcaccaaaacgcttaaggtgacgccggaggagctttttgacgctctggcggggtccatcatgcaggatatcgagaacgccacgggcaagcgtcccagccgcaacaagctcaacggctataagtacgagaagcgcgcccagtccgcaaaaggcaaggccaagggcatggcgatcaaggttaaaatcaagcactttgactacccgtgtctctatgaggtccgttttcagtatgcggcgggcatcaatactatgcgctatgaggctgcacctgctggcgatggtgtctgcgagctcacctataccgaggattttcagggtgtgggtggcaacacgtctggcacgcgcggcaagctcggcctcttcttctatgagcgcaagctcaagagccacgccaaccagacgattgatcaaatcgtcaaatatatcgagggtgagcgccgcgtaaaggctaatcccgccttcgccgatgatactgccgaaaacgcttcggatgtattccattgataccctgtgcaaaagttttaccgctcttcacatcaactgtgaacacttcaggcttcgagtcagtagcgagcggcccgacaaaagtagttgatggaagtgccaaatgaataagaatgccgctgcgcagctgcacatctattccgcctttttcgttctcgcgggatttgttttaaatcggggagtgtttctacttttccttgcggagaaaggaatgtctgtcacggaaatcgcgctttatcaagccctgtttaacattgcaacggtcgtcctcgagctgccaacagggctgataggcgatttctttggaaagaagttttcgattcaagtgggcgtgctgctgcttttcttccatacggctggcatgctgttgctctcaggtccctttcttgtcgtgctttcccttgttgaggcactcgcctactcccttcaatcgggatccgaacaagcacttttatatgaaattgcccggaatgccggtcaaggagagcgtttcctcaccatcaacgctcggctgcttgccgcgcaatcaatcgctacgggaatggcgattgtgctcggatctttcattgcccaagtatcttggagcgccctctacgtatgtgtctctgttttctatctcctgcagcttttccttctgtatcccattgagaggacggaagcgacccgttctgaaagctctgaaaagggaagatttgacgcggccaagatgttcagacgcgaaacctggcgtgttggagaatccgcttttgcggtattgcttcttctaatcggcacaagcatgctcgatggattctatgggagttattacaacttgaatcagttggtattcgacgcatttgatgctcccgtctccataataggaatctttttcggtgcatcctatgcagtaaatgcgacggcctacattgcagcagatttcttctcattgcgtttcgggaaaagaaataccatgctcggctcgatgctaatcgaggctggccttttcatgattcttccgtggttcgcttcaaatccgctgtgtttgtttggccttagcatggtgctttgttttctcccagaagtggtgtacatcacttcggaaaacttaatccaagacgcgatagcggacgatctccgcgcgacgatcctttccgtcgcgtctctggtaagggctctcttttctgcagtgtttttctccatatttggacatgtgttggggttatatcccattcagatagcgctcggtattattggtgcaatcgcgatagcaattaccgccgttgtttcattaaaaatggttggaatacaggtctccaagaattgatatatcgattgacgagctatccgaagcgtcgagccttcttgatggacatgactattcgtcacaaatcattccgcgcatcgccggggttccagtaatactcgatatatctggatgccctcattcccctttttgaaggtcccaaaaagactgcccgtgttggtttggctaggttcgggtgctgtccgtgccgtggggtaaaatcgttcagtcagaacacgaacccgcatcggagctcatcacatggcattcgtccatctgcacaatcacactgttttctctatgctcgacggcgcaacccgtatccaggatatggtcaaccgtgccgttgagctgggcatgcccgccgtcgccattaccgaccatggctacatgtacggcgtgcccgacctggcgctggcctgcgacgccgtcaaccacaacacgcccgagtacaaaacctggagccacgacaaggccttcttggaaaaggaccgccgcgacgagctggtggagcccgatcccgaggaaaacccgcgcgagcatgcccagtatgtgaaggacatggccatgtgggacgagaagggcaacatcgacgagctcaagccgcccctggtcatcaaacccatctttggctgcgaggtctactttacgccggacgagacgctcgcccgcgaccataagcccgagctctaccacatgatccttctggccaaggaccaggagggctacgtcaacctgatgcagacggtctccgaggccgccgtgcagggcttttactacaagccgcgcgtgacgctcgacaacctgcgccgtcatgccaagggcatgatctgcaccagcgcctgtatcgcgggcattattcccaagtacatcgaccgcggtgacatggagggtgccatcaaatgggccgagaccttccgcgataccttcgaccccggcgacttttatatcgagatccaggaacacggcattaccaccgataacggcctgaccgacgagcagatggaccgcacgctcatcgatatcgccaagcaggtgggtgtcaaggtcatcgccaccaacgacttccattacctgcgccgcgaggacgcccccgtgcaggacgtcatcatgtgcatcggtatgaacgccaaggtcgacgaccccaaccgcatgcgtatgaccggctcggagttttacatgaagaccgaggaggagatgcgggcaatgttcccgtattgccccgaggcctgcgacaacacgctcgagatcgccgacaagtgctacgtggagctcgactgggactccatcatcctgccgcgcttcccgctgctcgatcccggcgagacgcacgagagccagttccgccgcgagtgcgagaagggcctgcgccagcactacggtgacgactgggccacgcgcgagatcggcggagtcaacatcaaagagcgctttgagtacgaatacaaggtcatctgcgacaagggctttgccgcctacttcctcatcgttgccgagtacgtgcaatgggccaaggacaacggcatcggcgtcggccccggccgtggttctgccgccggcgctatcgttgcctacgccatgaacatcaccgcgttcgacccgctcgagaacggcctgatgtttgagaggttcctctccccgcagcgtaccgagatgcccgatatcgatatggacttcgacgatgagcggcgcctcgaggtcgtggagcacgttcgccagctctacggccccgagaaggtcacccacgtcatcacctactcgaccatcaaggccaagcaggccatcaatgatgccgcgcgcgttctggactacccggtctacatgggccagcgcctgtccaagatggtctcgagcgaccccaaggtcaagctcaagcaggtgctcgacaaacaacccggcaaagaggatctgtttaaccccgattttgccgaggcctataaaaaggacgacgacgctcgccgcatcatcgacacggcgctctcgatcgagggcctcacccgtggcgagggcgtgcacgcgtgcgccgttctgatctgccgcgaccccgtcaacgagcacgtgcccaccaagctcgacaccaagggcggcgtcgagattacccagtacgagggccataccgttgccgacatgggcctgctcaagatggacttcttgggcctgcgcacgctgacggttatctccaaggccaaggcaaacatcaaaaagaacttcggcatcgacatcaaagaggaagagattccctttgacgaccccgagatctttaagctcatgggttccggccacaccgccggcgtcttccaggtcgagtccgccggcatgacggccacgatcaagaacatgaagcccacagagtacaagcacgtcgtggcattgatcgccctgtaccgtccgggcccgctaggcgccggcatggtctcgtcctacatcaaccgtatgaacggcaaggagccggccgtctcctacgacgaccgtctggacgacatcctgggcgaaacctacggcaccatggtctaccaggagcaggttatgctcatctccgtcgagatgtgcggcttctccaagggcgagtcggactcgcgtatccgtaagcccgtggctaagaaaaagatcaagctgctcacgtcgacggtgctccactgggaggatggctcggacgagaccacctacgaccactggatgaacggcgctatcaagaacaactacacgcgcgaggtcgcccagaagatttgggacgatgttctcgagttcgcgtcctacgccttcaacaagtcgcactccgccggctacgccatcctggttatgcagacggcatggctcaaggcgcactatccgcacgagtacatggcggccgttctgacgtcctacacgggcaagaccgacaagatcgtacactacgtctcggcatgccgtcacgacggcatccccgtgctttcgccagatgtcaacgagtccggcaccgagttcacggctaccaaggaaggcgtgcgctttggtctggccggcatccgcggcgtgggcaccggcgtggcgcaggcgattatcgccgagcgcgaggcgggcggcccgtttaagacgctgcacgactttgtcgagcgcgtggactcgagccaggccaaccgccgcgtgatcgaatcgctgatcaaggcaggtgccttcgactccacgggctatccgcgccgccagatgatgcactttgtggacaagaacaaccccgagaacatcatcgacgccgcgataaagcgccagaaggaccgcgcgagcggccagacctcgttcttcgacatgtttggtgatgttgagggctcgggtttcgaggtcagcgtgcccgatccggacggccaggaatgggaccgccaccttaagctgagccaggagaaggaggttctgggcatctatgtctcggaccacccgctgcgcccgtttgagtatgcgctcagcaaagcgcgcgacttctcgttctcgcagatcgacaccggctacgaagttcagaatcctacgggcggcaccatcaaccaggagattcccgagggcaaagcgctgtggtgggccggcatggtctcgagcgtgtccaagcgcgtgaccaaaaacggcgaccccatgggcatcgtgcagctcgaggacatggaaggcgaggccaccgtcgtcgtgttccccaagacctataaagaggccgaggggtacctgtacggcgaggtcgatcccgagaccggtgcgcagctgtccgacgcctttgtgcgcatcaagggcaaactcgagcgctcggaccgcggcgaccagatcatcgcgcaggagatcgtgccgcttgagctcaacgaggagaacaacaagcccaaggtgtttgaggtcatggtgcccaacagccgctttagccagggcaatatggcgcgcctggccacggtgctcaccgctaacccgggcggcgaccgcgtggagatctttatcgagcaggtggacgggcgcgtgctgcgcgccgaggtgcctgccaaggtcaacgcgcgctcgattccgctgctggccgaggccaaggccattgtgggtaaccaaggccgcgtgacggttatctagggacggcgttgctgagaggtactcggtgcgagattggaggaagtgatggcgcaggggacgtttgtgcaggcgctccggaaagaggcggcgctgagcggcacctttatgaagggccgctcgctcatgctcaacggcgccgtgctgtcgatcgaggacagcggctcgcgcttctccaaaaacgtgacggttgagggctcagtgcgcggctcgcgcggtgacctgtacaagacgcacgtggcgctcgacatggacgagcaggaggtgatcgactacgactgcgattgccccgctgcctatcgctaccccggcatgtgcaagcacgccatcgccacggcgctagcgtacctggacgccagcggcattgagcctgttgaggggctgcgcacgccggtccgcacgtttacggcggcgcccaagcaagccgcgcgtcctgcgtctgccgcaccggcggtcaaccctaactttcccttcccggcgccagttcccacgagcccgagcctcatgaaggcgctctccgatctttcggacgcgcgcatggatgagctggcgagcatgcgccgcaagctcgccagcagtgtggatcccgatgcccccaaggcggtgttggagccctcgctggtgccgtattacaatccactgtttgccgaccactttagctgggcgctcgagcttcgcattcgctgtggatcggtctcctacgtggttaaggacatcgacggcatggccgatgcctacgtgcgcggcggcaccttctcgtacggcaagaagctcacgtttgtccatacgcccgaagccttcgaagacgtgtcgacaaagctgctcaaccttgtcgtgacgacagttgcctatctcgatgacatcacgagttcgcgttcggcgtcgtacgattttgcacgcagcggctttgtcgccgagcgccagctgccgctgtccgagcatgacatcgtatacatgctggacttgctgcgtggccggaccatttcctttgagcccgcctggtcgcggggaacgacgacgcatcgttcctacgaggttgcggttgagttgtcgccggtaggggaggacgaggcctcggcgaaacaaccgccgctccttgccgccaaaatcgcgccggcggctggtggcagctacgatctgcgcctgccggccgatgcatactgctttgcttcgggcgacgttgcctatttggtcgacacccgccgtgcgcgccgcaccgatgtagcgtttgcccagcatgcggcgccgttcctatcgcgcttgctgccctgtcgcacgccgatccatatcgctgtcgaccaggtgggggagttctgtcgtatggcgctgcccattttgcgcgactacaccgaccttaccgcgcccgccgcgctcgataccgtggcgcccgagccgagctttgccatggcaatcggtgtcgacgatgggcttgtgacctgcaaaattacggttacctacggcgactggtcggcagatctctttagcctgggcgctccgggcagtctcttcgaagagcaacgccccggcgtgccgccccgcgacgaggtggcagagtttcgcgttatggacacggcggccctatatttcgacttttacgagggcggtctggcgtttgaggaacgcgatgacgagagcctgttctgcttgctgaccgagggcctgtctgccctgtccgagttgggtgaggttatgctcagcgaccgtctgcgccagatctcggtccgcccagcgcccaagctttcggtgcgcgcgaccgtcaagagcaacctgctcgacgtcgagctgggcgcgagtgggctttcggccgcagaccttgccatctatctggactcgtacaagcgccatcagacgtttgcgcgcctgacgtccggcgacatcgtgcgcctggacgagggcgctcgcgccgcctttggtcttgccgaggacctgggcgtcgatgccgtcgacctgctcgatggcgtgtctcttcccgcgtcgagcaccctgtttgtcgatagtatgctcgcgcgcacgccagcgctcgaggccgatcgcgatgccgcgttccgtcgcaccgtcgagcgtctggacacgctcggcaagatggactttacggtgccggcatcgctcaaggcaacgatgcgcggctaccaggtcgacggataccagtggctcggctcgctcgaacacctgggccttggcggcatcttggccgacgacatgggcctgggcaaaacgttgcagatgatcgcgcatatcctggcgcgcgtggaggcgggggacgccaagcccacgctcgtggtgtgccctgcgtcgctcgtgtacaactggactgccgagctggagcgctttgcgccttcgctcgacgtgtgcgccatcgtgggtgccaaggcgcagcgccgtgtgcagatagccggcgccgctgagcataacgtggtcgtgacctcgtatgacctcatgcggcgcgatatcgacgagtacgtcgagcaggactttgcccgcgtggtgcttgacgaggcccagtacattaaaaacccgctcacgcaggtggcgcgcgccgccaagcgcctgccggccggtgtgcgctttgccctgacgggcacgcccatcgaaaaccgcctgtccgagctctggagcatcttcgactttttgatgccggggcttttgggcacgcgcgagtcgtttgccaagcgctttgagagcccggtcgagcatgccgagggcgatagcgccgctcgcctgcaggcactcgtgtcgccgtttgtgctgcgccgcgttaaagaagacgtggtggccgacctgcccgagaagatcgaggacaccgtcatggcgcagctcaccggcgagcagcgcaaactctatctggccaaccaggaccacatcgcccagcaggtgcagcatcgcgaggccaacgagtttaagaaggacaagctcaaggtgctcgccgagctcaccaagctgcgccagatctgctgcgacccgcatctgcactacgaggactacaaggcgggcagcgccaagctcgacgcttgcatggaactcgtgcacggcgcgctcgacggcggacaccacatcctgctgttcagccagtttacgggtatgctcgatatcatcggtaagcgcttggccaaggaagacatcgccttccttaagctcacgggcgcttcgtctaaggagagccgcgccaagatggtcgcgcagttccaagcgggcgaggttccggtctttttgatttcgctcaaggcgggcggcgtgggcctcaacctgacggcggccgacgtggtcatccactatgacccgtggtggaacgtggcggcgcaggaccaagcgaccgaccgcgcgcatcgtattggccagcaacataccgtgaccgtgtacaagctcatcgccaaggacacgatcgaggaacgcattatgcagatgcaggagtccaaacgcgacctggtcaacagcgtgctcggcggcgacggcatctcgtcggcgctgtttacccgcgaagatgttctggcactgctgggcggcgacgggcgctaacccgctcgggtggggccgccaaggcggatggcacacgctgccccatcgtccccgcccgttatgtgttcatttgcaatgccgtggatggtttgtctgcctttgggcataagaaccatcaagaacattggcacatcagcaaaggagaacatcatggcgaaattctttaaggaccccaatggcaagctcattgccgccctgggcaacgacgttgcaacccctgccggctgcacggagctgaccgcgaacaccgaggatgcggcgcacgagaagcacgtgccggtcgtcgagactgagcgcgacggtcacgtgatccgcgcacgcgttggctcggtcgagcaccccagcctgcccgagcactacattgagtggatcgcccttgaggccgagggccgcttggaggtccattaccttgagcccggcatgaagcccgcgacgttttttgccggcggttccaggaccggtaccgtctatgcctactgcaacctgcacgggctgtggtccgcgacattctaggagcgcgcccccgctcggggtatcatagctagcatatgcacatgcaagcgccgactgcattatgcggccggcgcttttactacgacaacgatggtttacgacggaaagggctgagccatgaagctcgcacttgcacagatcgatatgcgcctgggtgatattgagggcatttgcggccgcatcgaggaccaggctcgtctggcccacgagcgcggggcgcgcgtgctgtgcgttccggctccgctctttatgggcgccatacccgggggcctggtgggcgctgccgactttgagcacgacatgcttgccggcttgactggtgtcgccgagcgtatccaggagcttgacatgatctgcatcgtgcccgcggcggtttcgtttgagggccagccgctactcgactacatgatgctcaaggacggtcatgtggtgccggcgcgttcgagcattgccctgcagcgtggtgagaacaacgacacgcgttgggcgccgccggtgttcgacgtggacggcgtgcgcattgccgtgatttttgacttggaccgcgaactcgagatgttgccgaccggtgttgacctcattgcgtatttccaattcaacgcgtttgacatgaccgaccgcgagactgctgccattgccgccgttcgcagcggcgcttaccgcaagatcgcatccaagcgcagcgtgtggtttgcctgcatggcgccggtcggtgcctatgacgagtcggtgtataccggcggttcgtttgtgctcgacgactgcggtcgcgtggtggcccaggcgccgtgttttgaggagagcctgctggttcaggagattcagcgcggcgtgatgctcgatgccctggaagatcacgaactgcccgagttccgttccgaggagtggctgtggcaggcgctggtgcttgccgtgcgcgacaacgcccgatcccacggtgcgtcgcgtgctgtggtagcactcgagggtgacttgccgtcgtccctgctggcggcgctggccgtcgacgctctgggcccgcgcaacgtgattggcctggtgctggggcgcaaccgtatctttacgccggcgcaggaagaggccgaggctgcccgctgtgccgccgtccgcgccatcgccgagcgtttgcacattcgcaccgtcgagcgcgatgcaccggatgcggcgcgtgtgctcgatcgcgacgtgtcggcgggcgatgccgagcgtctgcgctcgcgcacgctgggcctcatgctggaggacacggcgctcgagttgggtgcgatggcgctgagcccgctgtccaaaaccgagtacgcgctggcggcgccggcgctttgcggcggctaccagggcgattatgcgccctttggcgatgtgtacctgtcgacgcttgagtttgtggcgcgcgtgcgcaaccgcacgtctgccgtggtgccccaagagctcgtgacgctcaacgcggtggaagattgtatggagcgagtgctggcgcaggcgctctcgacgctcgacggtccggtcgatatgctcgaccgcgcggcacagctgctcggcgggctcgagccgggtgaggtcgatggtgcgctcgagtcgcacgtggaccgcaatcgatctttcgacgacatcccgatggccgctggcaagcctgaggcctgctcgctgctgctgatgctcgtgcgtcagggcgaggccgcccgccgcatgctgccggcggtgccgatcgtctctgcccgttcgtttgccgagcgcgcctggccgtacatgcttgcgtggtccgatctggggctcaacggcaaggagcgcatgacggttgattcgctggcgcgcgccgaggtgcgtcgctttgccgacgacgatacgagtgaccgtatgcgcggtgagatgatgggcattttgggtgagctgctgggtatttcgcccgagcagatggaggagctgcgctctgaggacggccagcgccgtttacacgagggaatgaaaaagttcgagggcgaggttcaggacgccatcgataagatgatgggcggccagggtggcccgcagggtgggccccagggtggcccgatgccgcatccgccggttgatccccgacaatttccgttcttctctcagaactaggtcgctgcgcgcccgccagagcggcaatctgcctttcaatcgtcggacatgaccgccaggtcaatgccctcctctttcaaggcaccttgctcgctctggcgggcgctcgcttgcgtatactcaacctacaattcgatctcggctgacttatagggctagcgttgtgttattctagaacagacgttcgtgaatgatgcgcggggccttgtcttgcgctgtgcttgtggcgaggggaggttggcttggttatcttgggcatcgaccccggtttggcccatacgggttgggggattatcgaggagcggcgcggcgaggttcgctgccgtgcctatggctgcatcgagaccagtgccggaagtccgctcgcggtgcgcctgtcgcatatcgcccgtgaccttaaggatgtcgtcgagcgttatcgacccgacacggctgctgtcgagagtatctactttggcgccaacgttcgttcggccatccccacggcgcatgcccgcggtgctgcactcgtagcgctttcggaatgcgcgctcgagattggcgagtacacgcccatgcagatcaaacaggctgtggtgggcaccggcgccgcggacaagcggcaggtcgcctacatggtacgcactctaacacagctcgaccacgacccgcatcccgaccatgccgccgatgccctggcctgcgccatctgccacgtaaacctcagccgcacccgcgccctcaccggtggcgagttctatcaacagagaggaaccggatactgatgatctcccagctccacggaacgcttgtcgaggccacgatgagctcggctgtcgtcgatgtgtcgggcgttggctttgagctcggcatctcgggcagcactgcggccacgttgccgacgcccggcggcgaggtccgcctctacacgcgtatgcaggtgcgcgaggacgccatgacacttttcggtttttcctcaaaggatgagcgcacgatgttcgaccggctcgtgtccgtttcgggcgttggcccgcgcctggcgctcgccgtgctttccacctataccgtggggcagctgtattcgctggtgatggccgaggacgacaagggcatggccaaggtacccggtgtgggcaaaaagacagctcagcgcctgatcctggaactcaagagcacctttgccaaggataagggctttgtgccggtcgacgtgatttccggacaggttgcgatgcccgtgcccgctgccgctccctcggtgatcgatgatgcccgtgcggcgctcctttccatgggctttagcccgcaggagaccgatgttgccctgagcgggtatgatgggcagaatatgcgtgtcgaggatctgctcggcgcggcgcttaagcgactcggaatggatgcgtgatgtgggaagccgatgactctcaggacttgtgggcgacgcccggtaactcgccggcggcatccatggcgcacggcgagcgcatggtgggctcggagctgacggccgaggatctcgatgtcgaccgcactttgcgccctcagcgcctggacgattactgcggccaggagcacatcaagcagggcctgcgcgtgttgatcgaagcggcgcagagccgtggcgagacgctcgaccacgtgatcttctcgggtcctccgggcctgggcaagaccacgctggccaccgttatcgccaacgagctgggcgctcagatcaagaccacgagtggccctgccatcgcgcgcacgggcgacctggcggccatccttactaacttgcagccgggcgatgtgctgtttatcgacgagatccaccgcctcaaccgttcggtcgaggaggtcctgtaccccgcgatggaggactttgccctcgatatcgtgattggcaagggtccggcggcgcgctcgattcgcctggatatccccaagtttacgctggtggcggcaacgacccgctcaggcatgttgaccggcccgttgcgcgaccgctttggcatttcatatcgcctggattactacacggtcgaggagctcgcgcagattgtgacgcgctcggcgactatcctgggcgtgacgatcgaccatcccagtgcactcgagatcggctcgcgttcgcgcggcacgccacgtcttgccaaccgtctgctcaagcgcgtgcgcgattacgcacaggtgcgcggcaacggccccatcgagctcgatatctgtcgccaggcgctcgagttcttcgagatcgacgagctcggtctggactggatggatattcgcattttggagacgctcgccaagacgttctccggtcgcgccgtgggacttacgacccttgccagcgcggtgggcgaggacccaggcacgctcgaggatgtctatgagccctatttgctgcagtgcggattgatgattcgtacgccgcagggccgtcaggcaaccctccgcacctttgagcacctggggattgaacctaccgtttagggcgttttgttttggcgggctgttggactatcgctgggcatcgggtaaacatatcgccgttcatcggttatgggcgttttactgttgcgcgcccgtgctatgctgaattggtctttttctcattcggtaacgaaaggaccgcccatgcctactgacatcgaaatcgcacgttctgtcacgccgctgcctattaccgaggtggccaagaacgccggcgtcgacgttaagcaccttattccgtacggcttcgacaaggctaaggtcgactattcactgctcaacgagccgactgatcaccaggccaagctcgtcctcgtgaccgctatcaacccaacgcccgcgggcgagggcaagaccaccacgaccatcggtctggccgatggcctgcgtcgtcgcggtatcaagagcgccgtggccctgcgtgagccttcgctcggtcccgtctttggcgtcaagggcggtgccgctggcggcggttgggcccaggtcattcccatggaggacatcaacctgcactttaccggcgacttccatgccatcggtgctgccaacaacctgctggccgccatgctcgataaccacatccagcagggcaaccagctcggtattgacgttaagcgcatcacttggaagcgcgtcgtcgatatgaacgaccgtcagctgcgccacgtcatcgacggcattggcggtaaggctcagggcgtgccgcgcgaggacggcttcgatatcaccgtcgcctccgaggtcatggcaatcctgtgcctgtctacgagcatcagcgatctcaaggagcgcctgggcgagattgtcgtcggctatagctttgccggcgagcccgtccgtgcccgcgaccttaaggcccagggtgccatggccgcgttgcttaaggacgcgctcaagcccaacctggtgcaaacgctcgagggcacgcccgcgtttgtccacggcggtcccttcgccaacattgcccacggctgcaactccatcatggctacgcgcatggccatgcgttttggcgatgtcgccattaccgaggccggcttcggcgccgatctgggcgccgaaaagttcctcgacattaagtgccgcatgacgggcgttcgccccagcgccgtcgtggtcgttgcgaccgctcgtgcgctgaagtacaacggtggcgtcgccaaggccgacctcaacgaggagaacctcgaggcactcaaggctggcatgcccaacctgctgcgtcacgtcgacaacatccagaacgtttatggtctgccctgcgtggtcgccatcaaccgcttcccgacggacaccgaggccgagcttgcgctcatcgagtccgagtgccagaagctcggcgtcaacgttaagctttccgaggtctgggccaagggcggcgagggcgcgctcgagctggccgatgaggtcatgcgtctgattgagcagccgagcgagctcaagtttgcctatgaggacggcgccgatgtggccgacgccctcgatgctgttgccaccaaggtttaccgcgccgacggcgttgactttacgccggccgccaagcgtcagcttgccgagctgcgcgagaacggctttggcaacctgccggtatgcgtggccaagacgcagtacagctttagcgacaacgccaaggccctgggcgctcccgagaacttccgcatcacggtgcgtgagctcaaggtttccgccggcgcccactttgtggtcgcactgactggcagtgttctgaccatgccgggcctgcccaaggtccctgcggccgagaacatcgacgtcgacaacgacggcaacatcaccggcctgttctaagctcgctgctcatagccgcttgcccgccccgtcgcgcctaccaaggcccggcggggctttttgatccttaggcccgcgcatgtcttgtagataccgacggactctgcccatcataggcttttgcgctggtagaatgcatggataacttgatgcttacaggcgacggaaaggaatcgttgcatggatcaggacaagacaaccgtgatgggcggctgcggttccgcgcaggctggcgatagcgccgatgcgacccgcgttgttcccaaccccggttatgtcgaccccgccgcgacgcagccttctgccgagcccacacgagttatgggctatggcgacgcggcgcaggacccttacgctgcatctttgcaaagcccctatggcaacgcggcggcagacccgtttgattacgcgccgcaggattcttatgccgcctcgacgccgaatccctatgatgacctgccgcagaatcccattccgctgcctcagcagacgacgtatatgcctcgcacggcgcagcctcgctacgagtcgcgcgagccgtatcgcgagtaccccaagtcgattccgcaatatggcgaggacgaggaagagacgccgtcgcgttcgtcgagcgtgattaagaagatcctcatcgtgctggcgatcttctttgcgctgtcggttgtgtttgccatcgtgtcgggcatgctcaacaagcgagggagttcaacggccgataccgctgccgagcaaaccgagtccgcctcgtctagcaccgtcgatctgagtgatatcccggggcagtactggtccaacgccaagaagatcctcaagtcgcgcggcgccgatctttcgaatgccgtggtcctgactgatgatggctcaacgcccgtcgtcgatgccaactgggtcgttacatctgcctactataacgacaacggcaacctcgaaattcaactcacgcacaagaacagttcgggcaactcgtccgacggccaaagcggtaccgacagctcgagctccaatacgctggaggacttgagcaacaaggcgcaggagttgggagacaaggcgcaagagctgggcgatacggcacaaaatctgggcgataccgcgcagaacttgggcgacatggcgacggatgcctggaacgccctacaaaacggcatctcgggcgcgcagggaaactagctgttaagtgggctacagctgctcggccggacggtcgggcgagctaaagcccgagtcaaacgtaacgacgcatgaggcatcgggtcggcgctcgtgcacgatgcgcgtgacgagccccagcagctcctcgtcggatatgtcaaagccgtcgggacgcacaaggtcaaatgacacaaagccatcgtgctcgtgcaggtcgtggatggagagcgcaggatcgatctgcatgatgccgcgcttgacccagccgcgcaggtcgtcgccggtggtggcgatggggtcgcagtgtagcgtgataccgatgcccatctgatgcttgatatcgtgttcgatggtgtccagaatctcgtggtgctcaaaggcatcgccctcgccgggcatttccacgtgtgcgctggcaaactgacggccggggccgtagtcgtgcaccatgaggtcgtgtgtgcccaggacctgcggataggacatgatcttgtcgcggattgcctggacgagcttggggtcgggcgcttgccccagcaacgggctgatggcgtcgcgcaccaggcccatgccgctgatgcaaatgaagatgcccacgcccaggcccgcccagccgtcgaggtcaaagcctgtcgcttgcgaaataagcgccgccgctaagaccgagcccgaggtgatgacgtcgtttttggagtcctgcgccgtggcgatgagtgtctcggaatcgatgcggttgcccagcgtgcggttgaacgctgccatccagagcttaacgagcatggacgtagccagtgccgcaagggaaataaacgtgtaagcggtgggcgagggcttgatgatcttggtgaccgactcgagaatcaggttgatgccgacggcgcaaaccaggacggcgacgaacaggccggctaggtactcgtagcggccgtgaccataggggtggccttcgtctgccgggcggctggcaaggcggaaaccgagcaggctcacaatgttgctcgaggcatcggagaggttgttgaaagcgtcggcgatgagggagacggagccggcgagcagacccgcgatgcccttggccaggcacagggtgatgttgaggccaatgcagacgaggcttgcggaaaagcccgcgttggtgcggcaagatgcatcgaccggctcgctctcgctgccgggaacaagcgtatgtaccagccgatttacaaatagcatagcggtcgtcctcacaatcatgtttaaggggatagtgtagctcgcacgggggcgccgtgcgccgatgctcagaaaatgcagcaatagtctgccggtgctaacgaacgagccttctcgtctgcctgggtggtccattttgggccacatgggtatgggcatgtgcctgcttgctcgacatacttaatgtcgacagcccctgtgcaaaggaggacgtttccatggacgagatgtttgccataaaatgtcaaaactgcggcggccctatgtactcgcaccaggctaagcgcagctttgagtgcgcctattgcggcacggtggttccgtggcaggcggacgccggagagcccaagagcgctttgggtattcgccatacgccgttgacggtggtggatggactgctcaaactcacgcatgtgtcgcaactcgagcgcccgcaggacccggactggtatttcttcaatgcgcactggcgcaatcagtcggtcctggaacatctgctgtgggaggatcgcggcacggcgcaggagttccaagaggccacgcatgtgagcattccttgccccttctgcggagcgtcctttgagggcgagtcaacgcagcgtgtgtttgagtgcccgtcctgcggcaataagatcggcattgcggacctgctcaagccggggacgtttagcaagcgcctgaccatgggcgttggtgcggagtatgtgcccgagcagggtattccctgcgaaatctcgccgcagcaggcacgtgccaacgcgctgcagctggtgcgccagtatccggatgcctttgccgggcacgacgtggaagacgcgatccaaaacgacatgatgctcttctatttccccatggcgctggcggacttgcgcatgatggcgagcttcccgggcaagggcctgagcaaacgaggccttggtgtactacgaggtgctcgactgggcataccccagggcaaactacctggacgttcgcctcatgggcattttggagccgtgggactttgccaaggtcggtccgttcgatcccgccatgcaggaaggtgactttcgcgttgtctcagtcgatgcgtctaccaaggaccaggtggtcattgataagttggcgctcgacgttgcgggcaacgacgccgaggctgtactggggctcaataaaaagagcattcgcatgtgggcgcgcaaggcccgcaaacataaggacggcctggtgatggtgccggtctactttgtcgatcgtccggcgacagacggccgcgatggcgagcaggtgcgcattgccgtaaacggccagacgggccgcgcggccgcggtggtgtttagcgacaagcgcgaaacgcatatcgtggcgccgctcagcccgagcctgcatctgtccggtgagagcaccgtgcacgccacgcccttcgaggtcaaatacgttaaatcgcccttcctgtaccagatcgtgcgccgtggaggcggcgagcaaccgcgccaggttgcagccgccgtcgagggttcctaccgagaggagaagcccaaacgccgcggtctgctgggtgcgctatttgggaagtaggggagtagcaccggttgttgccgtaaggtgatggccgggggtgcggggcagctctcaggagtgcgggctgccgtctgattgtttgagggtgccagatgtaaataaacagtggagcggctgcaaaagagcctcctcactgggtaaaatcaggttgtgccgcggaacccgctcctcagctagtcacacttcggaagcgcgggcaacgcaggtattatcgtctaaagggccggctgcaaccggcccttttctgtggcagccaatggacccacatcagacgaaggccgcgtctttgcctgtcaggtcacgctcgccagccacggctagaatgtcgttgccggcgtccatgaccggtattgtttcgtagcgtgcgtcgcaaccgcgagtgcgcctgcgacggctgcggtggcttcggtcgcaacgtgctgctacccttgcgtttcgccattagtcgcttcgttgatggcgcggtactcggcactcagctcgcgcgccagctcttccttgcttggaagatacggcaggtatttggcggtaaacacttggtcgttgtcttcgggcagcgtgtactcgacaatcgaatcgcttttgtccgcgcagagcacgatgcctatgggcggattgtcgccttcgttcatgagctcgcgcgtgtagtagttcacatacatttgcatctggcccaggtcctgatgcgtaaggtcgtccgtcttaaggtcgatgagcacgaagcagcgcatcagatagttgtaaaaaacaaggtcaatatagaaatggcgcccatcaaaggtgatgcgcttttggcgcgcctcgaaagcgaaaccacggccaagctccagcaggaacttctgaagatgcgtgatgagcgcctgctctagatcgctctcgcgaaacgcagtatcgtccgagaaacctaaaaactccagtacatatgggtcgcggatgatatcctcggggcgacgagccggggcgctcttttggatttcctgggtgacggcctccttgtccttgctggcaagtaggcgctcgcggaacatggtgttgatctggcgttcgagctgacgcgtgctccaacgagaatcggcgcattcgttcatgtaccatgttcgagcatcagggtcggttatacgcgataacctgcggtaatgtgtccaattcaattcggaacgcagcgcgttccggattgggaacgcaagataaaactgacgcatgtatcttaagcttctggcgttgaagcctctgccaaaatccttagtcaatctaacggcaagttcgtcgatcagtgcatcgccatacttggcgcgcccctctccgccctgttcatcaacaatactcttgccgatctcccaatatgcctcaaccatcgcaaagttaacggcggtataggccttgtcgcgagcggcgttgagaatcgaggagacctgcttgtaaaaaccttcgggcacgattgccgattctccacggtttaccagttcgcccatcactgtcgccccactttccttttgtggaatgcgtctttatcgcatttagtttaaagcctcgcgcggacacgaattgctgtgctgtctgacatcttcgcatggggccttgcggtgactaaaatgtgaccatagaggcagttttagcgaatcccacgggagtgacgcgtatggacaataacacgctgctattccaggacaaaggttcgggtaggtataaagacgtcaagatctaccccaaccgtattgaggtgctcaagaagggcacttttggtggcaagcacaccgagattgtctatcttaaggacattacgggggtcaacaggatcaagggccgcgatgtttttctgcgtaacaggctgttgactgcttgtgtttttagcctgagcagccgtgcgaaggcccaggagtttgttaacgcgctgaacatggtgatgtagcctatggcggcgtttgggccaaggtaaaaatcgggggcacagaacggtgtcctgcgccccccattgagtcgatgtgtctaaaaggccggcttgcctattcgctaccgtccccagcgttttcgcggtcgttggcaagcattgccgcgccggcgaccgttgtcgctacggcggcggcagcgagcccggcggcaatgccggagccgtcgcccgtgtcggcgagttttccgcccgagttcttgcccttgttgcccttaccgttcttatcagcgctgcctgcgttggaacccgtgccaccgtcggtgccggtgccgcctgcactgctcgaggccgctacggtaaagctcgcggctccgtcattagcaagcttgtagttttgcgccgcgtcgcccaaaagaccgttcgcgcgcacccagtacgttcccgcggtaaatgcctcgccctcgaccattgccgtgcccggagcgccgtccgcgtcgtgcacaaactcgagctgagccgtgcaggcatcgttttcgagtttgccctcgagcagcgccgcgacctttgtgcgcacatcctcgccggccttaaggccttcgagcccctcaaagtggggtgtcagtgcgcgcggatcgatatcgatgggcacggatccctgcagccccgtaacggtctcgttgcccaaggcgtcgacatccacgtattcgatggtaaacgcatggcccgaagccgccacgttgagtacgttgctgctgtcgacaaggcggaaatggccctcgccaacggtcttgccatcctggagcgaggcatcgctcagcgagtcgccgtacgtcatgcgcatgcgggtcgggaggcagcacgaagccgactgcgtgtgcttcgtatcgtaattgtaattgcgctggtagatgctccgggccagcgccgcatcaacaaagtcggatgcgatgatgccaatgtgcttgaggtaatctgactttgtatcctcgatgccgctgggattgatgtacgggctcttatacagatgctcgttgactactcgtgccgaggtaaaaggattgcctccgtgcgacaagcccgtgcagctggtgtagttgatagaccagcaacgctccaggactttctccttggccccgttatcgtcctcgacatctacctcgttgcgcgtgcgcccggtcgtttccttcagcgcattatcgacccagctgagcttgtcggttcccgtgagtttgtacttgtcctgggcgtataccttggtgcaatagggctctttgtcgcctgtttcccccgcggcttcaaagccccgcgcgtcttggacgagacacatggaactgctgtcggtgtgcactgcgattttgttatcccattcggtgaggtcgagtccccacgtgtggccgcttacgctgtcgccgtcgagtccaaatcgacgtagcaggacgatctttccgcgcacctcgcccagtgtgggaacgcggctcgacgtatagaacagtttggggttgtcgtccaaaaccttggcgaaagccgtcgtaacactttcgtcggtagcctcgtcgttgcctcgtgatacaagcatgatgagcgcttctgtcgggttttcgttcaaaaacgttttgaagtagcctatgacatcggagagatgcagatagttcccgtcttttttgagtaggtagaaaatcccgtggtcgatgccggggtcatcgccctttccgagccggatatcgaaatagcgaatgccttcgagcaactgcgtgggaatgtaatcctgctggcattttacttgcgaggattggggctcagtgtcgttgtccacgctgcaggtgcccgaatcgtgcgtacccgggatgctcagctcgtcgaggaacttgttgtcgtcgacgtatttcatccaacatggtccgtcgacgtagctgctgtacgtgatccagtcgaggctgctaaccgtggcatcgttctttttcatgtcctaaccgataagttcgagctcccacggaatgctcttactcttatggcagatcttattgttgtcctggtctttgccgttcgattctattgccaggtacttaatgtcttttttctcggtttctttctcgaccgtgcggtctcggatgatgtaggttccgtttgattgacgctcgaacgcaaaagcgcggctgggcttgttgtcatactcgccgccccatacgtggatgacctttccatctttgtccgagtcgtcgtcgaccgaccaaatgctgtagcccgtctttttatgctcttcgaaattgagcaaggtgcggatggcgtaccagtttgtatcgtcattcttggtcgttacgttctcaaggatgagcttgctggacgtgccgtcgttaaacaggtgacagacgttgccgcgaacgttgccgtcttggttgacgctcgcggtgcgaaaatagcccgcggggcgaaggcgaatgacgaaattgtggaggctgtccgacggtgcgggtgtgttgtctgcaaatgccgctcgcaggggaatgcccggcgctgcggtttcgggcaggcttgcaagtggtgacaacgccgcaagccctaggcccagcgtaaacgctcggcggctgatggcatggtgttcggtcataacttctccattcgcagagtgcggttatgcgatagttttggtcactatactgcccagatgtttaaagatgctggtttaattgtctgcgcggcgcaataaatcggtgggcggacgtgttggggtgtttgtcgttttcgtactgttgccacatttggggcggttccggcgtccggcatcctcgcgttcgtcggctacaggcataagaaagggagggtcggtttaccggccctccctgggtacgaagcgctggggtaccgtcgcttgtttgcactgcgaccgtgtttcccgttgcgctcgccagtcgcttagcgcttgatctcgatatcgtcgagcttgacgtccatggcctcggtcttggcctcggcgatgtcgtcggcaaattccagagacttcatcatggtctcgacggcgtccttgtgctcctcgacgttgtcgatacgcacatacacactgccgccgtcaacgtcggtgaagtattcggtcgttacgccgcccgagtgtgtataggaagcgttgcgccaagtcttgccgttgtacttgacggggtcattctcggtccactcaaagctggcattccactttgcctcgtagtcgaacagttcatcggcgttcttgtcagagtcgaagacggggatgaagcgatcgctggcgtgctcgctctcggtgaacttaaactgggccctgtcggcggtgtcgcctgcgacgtcggtgatctcgacgccctcggggacctcgaccttaaaccaaatgaagtcggtcctcatatccacggctggcttttctgctccgccgccacctccactgccggtagcgccgccgctgccaccgcagcccaccagggcaaccgcggcaaagagactgatgcagagggtgagaatcgcaaaggccttctttttcatggtcgtgtcctcctcgatctgtaaccgcccatggattacctgcctttactgtacgcgtggacggctcgctagggtgggccatgtgtcccattctgagggccggatttgcgccgttaagtggcaatatgcacgggtccaaaagaggggagggccggtgctgtcggccctccccgggttgggcgcccgttgttttaatggggcgcatgtgcgcgggtgcgcgtaggcgcgtgcgggtgtcccgttacttgatctcgatgctcgaaatctcgacttcgcgtgcctcggaaactgcctctaccatgtcatcggggaactcgatggagttgaggagtgcctcggcttctttcttgtgctggtcgaagttcgagatgaggacgtagacgcttcccggctcaacatcggtaaaaagcatggttgagatgccgctgttgtcctcgtatgttccgacgagccacgtcctgccgttatactcgacggacccgccatccttccactggaacgtatcccccttcttttccgcctggtcggcgtgggattcctcggccgtcagcgcttttttccaaacggggataaagcgatcggccgaggcgttctcgtcttcggggaaggtgagctggaccctgtcggcattcttgccggcagagtcgcttacgccgacgccctcgggcatctcgaccttaaaccagatgtagtcggtcttcttggcgacgggggccttttccttgctctcgctcttgggggcgctgccgccgcccgatgcgctcccgccgcagcccacaagggcgagcgcggcaaagagggcgatgcaaagggaaaggattgatagggtctttttcatcatggtggcgtcctccttgtctgctgatgacatcacggcgccgcatgctgttggggtactgattgcgctggcggcggatgtctctgtgtactgtgcgacttatgcctccgttcatcgcttgtggccgttgcgcggccgttccccaacgggttccttacttatagatatgccccagcttgtgctgctcgggagtctcgaaaggtgggccatgtgtcccatgtttgcgttggcatggcctatcgtgtgccatagaaatccgcgatggccaggtgcgctgacgctcgcgtacttatgggctagacttagcaccattacgtgatcgatgcggtcggccggcgtcggccgcccgaccgatatatatgacttgaaggtgcgtgtgcgtatgagccaagagatgatggataaaacctgtcgcggttttgccgaggcgctggccgcgcgcgagccggttcccggtggtggcagcgcgagcgcctttgtaggtgcgctgggcgcctcgctttgcggaatggttgcccgctatggggcgacaaaccccgcgcttgccgatcgcgcagacgatctgacgcgcgcgtttgcccaggcggatgagttggcgcaggaacttgtgggtctggttgccgaggacgttcgtgcctacgggcaggtgtccgcggcgtacggtattccgcgtgacgatccggctcgagcgaccgcgattcaggatgcgctgcatgtggccgctctgccgccgtatcgcattatggatgcctgcgggcgtgcgctggcgctgctcgaggacatggccgacaagggttcgcgtcagctgctgtccgatgtggcgtgcggcgccgtgttctgccgtgccgctatgcaaggcgcgagtttgacgctctttgcgaacaccacgtctatgaaggatcgcgttcgtgccgaggagctcgagacggcgtgtgatgagctgctcgacacatggttgccgcgcgccgaggcgctggcgcgccgcgcctccgacgctgcaaggaagagaggatagccatggctgaactgctgaagggtgctcccgttgctcgcgctttgactgaggaacttgctgctcgctgcgcagccctgcgcgagcggggcgttgttccgacgttggctattgtgcgtgtaggtgaacgcgaggacgacctatcctacgagcgcggtgcgctcaagcgctgcgaaaaagtggggattgaggctcgtcgcgttttgctttctgccgatgtttcgcaggacgagctgttgacggctatcgaggacatcaatgccgattcggctgttcatggctgtctgatgttccgcccgctgcccgccggccttgacgagaacgccgtcgccgcagcgctcgatcccgccaaggatgttgactccatgacgccggcttcgctgctcaccacgctttcggggcgcggcgagggttttgccccctgcacagccgaagctgtgcttgctttgctggatcattacggcgttgagctggatggagctaaggttgctgtggtcgggcgctcgctggtgatcgggcgtcccgttgccgccatgcttacggcgtgcaatgccaccgtgacgacgtgccatacgcatacgcgcgaccttgctgccgagtgccgtgcggctgatattgtggttgcggccgttgggcgcgcgcacacgattggtgtggacgcggttcgcgagggccagacaatcatcgatgttggcattaattgggacgaggccgctggcaagttggtcggggacgttgattttgatgctgcagagccggttgttgacaccatcacgcctgtgccgggcggcgtgggagctgtgaccaccgcgattctcgccaaacacgtgattgaggcggcggagcgcgcatcgaaataggcgttttgggctgtttgagggggttagctatataccacgtggtcaaacaatgccaaatatgagtactgttgccaagatagtcaggtagcgcgcagagatgtggtgtaagaggcggggcatgacccgcctcttccctttccctcccgtctcctgcgcccctcccggaactgtccacatcagtgtagccaatccacggcgcggctggcggcgaggccgggcaggtgggcgaccccgagccccgcggcgcgggcccgcctcacggcgagggaccctatgttgcggaactggtcgacgacgacgagcgtgccggcgggcgcggaggcgaacagcgcgtcgagctcggcctccctgttgcggacgggggcgctgtccagcacctccccgtcgcggtcgatcaggcaggcccagtgcgatgacttgccgacgtccaggccgagcacggccgcgggtctggtggatggcgctttcacggtggtatccttccggtagtcgttcgaccggatggcctccccctcggcactcacattaccagccgcggcacctgcccggcactttcctatcagccgtcgggggcggcgcgccccgcgccggcagcacccaacgggccctctcggggcagggacgttcggccgtgcgcgggcgcccggtcggcggcccgttctgggcgcgcctcaatcgtagcccgagacggtcccgggctgacaatttcgactgtaatggacgttcttaaacgactagtcattcaagaacgtccccaatgactgggtcggaaaatttcttaaaaaagttcttgctcttcgtccaatcgtccgtataataaacttcgttgcttgagagcacgcacctattcctcggtagctcaatggtagagcacgcggctgttaaccgcgctgttgtaggttcgagtcctacccggggagccagaatttctcagcccattccgctgggcttttaaattcctcggtagctcaatggtagagcacgcggctgttaaccgcgctgttgtaggttcgagtcctacccggggagccaggttgtaaaacccgtcgctatgcggcgggttttttcatgccgcgatcgccggtgccgaacgttaccgtatcaacatttcgtgtcgaggatgtaatcgcgaaccccgtggccttaacatggcgcggtcgttgtaaaatgttggaatgattgctcccacgacatggtgccgcgagcaccagaaaaggagattcttgtgtctgagaccattaacggcagcctgagcgtctcgaacgacgttattgccgatattgccggttatgccgcgatgacgtgctacggcgtcgtcggtatggctgaacagctgcagggcgccgagagcgtgcgcctgcttgccggccagcgcctccgcaagggcgtgcttgtttccgccgacgagaacggcctcacggtcgaccttcacgtcgtgctcgagaacggcgtcaacatgaagtccgtctgccacaatctttcgagctccgtcgccttcaccctgcaggagatcgcccagatcgatcccgccagccttaagatcggcattcacatcgacgcgctcaagagccgtctgaactagcatccgaatacggagatttcaccactcatgattgcaaagaccattcgcacctgttttccgatcgctgcggctgccgtttccgaaaaggccgaggagatcaacaaactcaacgtcttccccgtacccgacggtgacaccggcactaacatgtcgctcacgctcgcctcggtgaccaaggagctttccgcccttcccgccgatgccggcatggaggccattgccggcgccatcacccacggctccctgatgggtgctcgcggcaactccggcgtcatcacctcgcagatcctgcgcggtgtggccgagggccttgtctctgccgatgagcccattacgtctgccaacatcgccttcgccttccgtcgtgccgtcaaggtcgccttccaggccgtccgcaagcccatcgaaggcacgatcctcacggtgctgcgcgatgtctcgaccaaggccgacgagtgcgaaaagaagaagttctcggccgaggacgcgctcgacgccatcgtcgtcgaggcctaccagtccgtcgcccgcacgcccgacctgctgcccgttctgaaggagaacggcgtggtcgactccggcgcctttggctttgccatcttcctggagaactttgttgccgccgctcttggccgcagcaccgttgtcgaggatttctccgccacgtttgattccgctggctctgcccgcgacgcggccctcggtcgcgttgagatcgaggccaacgacgactgggagggctcggagttccgctactgcaacgagttcctctttaaggccgacgccccgtttgacgaggacgagtgccttaagttcctgggttccatgggcgactgcgagctgctcgtgggtgcctaccccgactacaagattcacgtgcactccaacacccccaacttggtgctcgagcacatgctgcagcttggccagatctacgaggtctttatccacaacatggagatggaggcccacgaccgtaccgccaagattcatgaggaccaggagaaggccgccgagcccgccaaggcgttgggctttgtcgccgttgccgccggttcgggcgaggctgacatcctcaagtccctcggcgttgacgtgatcgtctcgggtggccagaccatgaacccctcgactgccgacctgctgggcgccgtcgaccaggtcaacgcgacctcggtcatcatcctgcccaataacggcaacatccgcatggctgccgaggctgccgcttctgcctgcaccgacaagaaggtcgccgtcgttcccaccaagaccgtcccgcaggcgttctccgcgctgttcgcggtcctgcccgattccgagctcgaggacgccgtcgccgccatggtcgacgccatcagcgaggttcgcgatggcgaggtcacccgtgccgtgcgcgattccagcgcctctgacggctctccgattcactccggtgacgtcatgggtatcattgccggctccatcgacgtggtcggctccgatgtgaaacaggtcacgctcgactgcatcaaccgcatgcaggaggaagaggagggcgatgcgctgacgattctggctggcgaggagctgtccgatgaggccttccgggagatcgtcgacgccattgaggaggctcagcccgacctggagatcgacgcccatcgtggcgagcagccgctctatcccgtgatcttctcgatcgagtaggcatctgcccatgtccgagctgtgctccgtgccgcgtgtctcggagcgctttgcccagagcaatgcgctcgacgaggatatcgcgcgactcaaatatgtttcgggtaaacgtgaggaggcccttcgccgtctgggaattcggacggtgggggacctccttctccatatccctcatcgatatctcgacttcacgcgcttctggtccatcgagatggcgcccatcggtaccgtttgcacgatagtcgccacggtcgatcgcattgttcaaaagcagcctcgcccgcgtatgcaggtgaccgaggtctcgctggtggacgagacgggcgtgctgcaagtcgcctttttccgtcagccatggattgcccagcagtttaagcagggagaccgcctggccgtgatgggtaaggtcgagtttgcctacggctttaagcagatggcctcgccgcatttcgaaaagctcgaggacgggcgtgccgcgggcaccatcctgccggtccattacgtgagcgatggcgtgagccaggcgtggatgcgccgcatcgtaagtggcgcgctcgaggtcgtcggcaatcccttcgacccgattcccgcgagcttgcgcgccaagcgccgcctgatgagcaatgcccgcgcgctgcgctcaattcactttccatcgagcatggccgagcgcgatattgcgcgtgcacggcttgcctatgaggagtgcctctacctgcagctggcgctgcgattgcgcaacgacggcggcttggtcgaagttgctccctacgcccacgtcgctggtgagcacctggcggcgctcaagcaagccctgccgttttcgctgagcgacgagcaggaggccgcgttccaagacatcctgcgcgacatgtgcgatggcgggcgcgtgatgaaccgccttctgctgggcgatgttggtaccggcaagacggccgtcgccgcctgcgcgctggctgtcgcggccgattcgggcactcagtcctgcgttatggcgcctacgggcgtgctggcgcgccaatatgccgataagaccggccccttgctctcgcaggccggcatgtcctgggcgctcctgacgggtgccacgccggcagccgagcgcgagcagatccatgcgcagctggaatcgggcgagctcgacgtcctctttggtacccatgcggtcctctcggatgacgtgacgtttaagcatctgtcgcttgtcgtcatcgacgagcagcaccgctttggtgtgggccagcgcaatgccctgcgtgccaagggcccgggtgccgacctgctcgttatgacggcgacgccgattccgcgcacgctggcgctctcggtctacggcgacctggatacgagcatcatccgccatcgtcccgttccgggtgccggcgttgagacgcgcgtcctcaccgagtcgagtcgcgacctggcctatggcgccattcgcgaggcgcacgaaaagggtcagcaagcctacgtgatctgtccgctcgtggagccgagcgattcggccgatgagctcgaagacgtacccggcatcgctcgcgacgacgagggccgcgtgaccgtgcccgtgccgttgcatgacacggcgaccgagctcgatcgccttcgtctggcattaccggggcttaccatcgagcgtcttcatggccgcatgtcggcgggggagaaggaccgggtcctcgatgcctttaagcgtggcgagatcgatgtgctcgtctcgaccacggtggtcgaggtgggcgttgacgtgcccaacgccaccgtcatggtcatcgagaacggcgagcgctttggtttgacggccttgcaccagctgcgcgggcgcgtaggccgcggcagcgtgtcgggtacgtgcctggtcatgacgcactccaagggcaacggcggcgcgtcggcggcacaagaccgcctccagtcactcgagaagacctcggacggctttacgctcgcccagatggacctgcgtctgcgccacgagggcgaaatcctgggttaccgccagcatggcggcgtgaccttgcgctttgtggacctggacgccgacgaggatcttatcgaatgggcccatttggacgcggtcgagctcttgcggtatgctagtaatcttgactctgtggcgacgcgtcccctgcgcgatgcggtcgccaagcgatatcgacatatttttaaggaggtcagcggaggatgagaatcatcggcggtgaatggcgcggtcgcaagatcgaagaaccgcgcggtcgcgatgttacgcgtccgacgaccgaccgcgtgcgcgaggcgtgtgcatccatggtcctatcggccttcggctttgatttggacgaggttcgcgtactggatgcctttggcggctccggtgccctaggcatcgagatgctctcgcggggcgcccgttcgctcacgacgttcgagatcgatcgcaatgccgcgaggctcataaccaagaatatcgagtcgctctgtcgcgatcgcgcgcgttggcgtgtggtgacgggcgatgtccttgcgagcgcttcgcgcggccgcgtgccgggcggccccttcgatctggtcttgctcgacccgccctatgcttttggtgccaagccggtcgatgagctgctgcagaacctggcccagcagggtctgctcaccccgggcgcctatgctctgtttgagcatgctgccgccgacgcgggtgcacatcctgccggctttgtaaccgtgcgtgagaaacgctatggcatcacctcggtcgatctgctccgttgggtcggcgagggcgaggatgacgacatcgccaccgatgccgatgacagcgacggcacgacgtttcaggaggatgcccatgagtgacaccattaaccgcgtcatcgttccgggtaccttcgatcccatcacgtttggccatatcgacgtcatccgccgcgcccgccgcatttttcccagtgtgatcgtggccgttgccgagtcgcagggcaaaaacggcgtgggcaccacgtttacgctcgatgaacgcgtggcgctggcccgtgaggcactcggtgatatcgatggcgtcgaggtcctgccctttaccggactgctcgtcgactttgctcgcgagcagggtgccggtgccgtggtcaagggcctacgcgccatgaccgactttgagtatgagctgcagcaagccgacctcaactaccgcttggataacgagctggagtccatctttgtcatgagtgctccgcagtatggctacatctcgagctcggttgtacgccagatcgcctcgctcggtagtgatgtttcgacgtttgtgccggctaatgtggtcgaggcgcttaaacatcgcttttcgtgacgttttttattgccaggtggcatgtggtaaactagcacgatgatatgttacctatgaaaggagaccggatgccgggcgagaattttcctggcgacaggatcgtgagccttgtcgacgagctcgaggggctcatccaagaggctaagacgccgttcggcaagaacgcccagatgaaggtcatcgatgccgacgtcttctttaacatcctcgatgagatccgcatgagctatcccgaggaatggcagaagtcccgccgtatcctcaaagagcgcgaggagcttatggcttccgccgccgctcaggccgattccatcatcgccgacgctcagcagcaggccctcactattgccggtgagcaggaaattgttcgccttgcgcagcagcaggccgacgatatccgcgaccgtgcccagcagtatgagcgcgagacgcgctatgctgccgaggattacgccgagcaggtctttacgcacctggaggagaacctcaagagtctgaccggcaccgtcacccgttgccgccagcagctcaatgagggcgccgcccagcagaatggtcagtggtaatggctgagttcccgagcgttaccgtcgatctttccgagcagctcgagtttcccggagactcgtatccgctgaccggtaaggtcgatgtcgctgcctacacggtgggcgagaaagagtaccagctgcaggacggtatcgactatgacgtggtctttaccaatgccggcaccggtgttctgcttaccggcatggttcgcgcgcacgccaccggcgagtgcgaccgttgcctggagcctgcctcgtttgacattgccggcgagatcgaggagttctatctcttccatgagcccgaggaccccgaggcctacgaagacggctatgagctcctgggcgaggatcgcgtcgtcgatctgggcgagcccatcaacgacgccgttgtcatggacacgccgtttgttgtgctctgcaagcccgattgccgcggtctttgtcccgtttgcggcgccaatctcaacgtggagcaatgcgattgtgctgcccaagccgaggccgaatgggccgaagccacggaaaatccatttgcagcattgaagaatctcaagcttgacgagtaaaactgtggtagtatcgctacttgcgcgtaatcgccacactggatagttcataaggaaggtcactatgcccgtacctaaacaaaagcagggtcgtatccgcactcacacccgccgttccgccaacatgaagatctcggctgcggctcagtccacgtgcccccgttgcggtgctgtcaagctcccgcaccacgtgtgccctagctgcggtttctacaaggaccgcgaggttatcgttaccgagtaacggtatactctggatacgatgccgttccaactggaaccacaatggccggctcattgagtcggccatttttgtataaggagcatgtatatgagtaacgttcgcgtttgcgtagacgttgtgggtggagacgagaagccgcaggttgtcctcgacggtattgaggctgcacttgccgccgatcccgatatcgaggtcttggcagctggtcccgccgaaatcgtcaatccctttgcagcttcccatgcacgtgttgaggcccttgaggcgcctgacgttatcgccatggatgacgatcccattcgcgccgtgatgaccaagcgtaagtcgtcgatcgtgctttcttgccgcgccattaagaagggcaacgcggatgcgttcttctccgccggctccaccggtgccatgaccgccgccgccaccgcctatgtgacgccgtttaggtatcaggccgaaggcaagaagcagccggtgcgtccctgtctgaccaatgcgctgcccaatcgcgccggcggtctgacggtgctgtgcgacatgggtgccaaccccgatgtggaggtcgatgacatggtgcgttttgcccagatgggtagcgcctatgcccgcgtcgtcctgggcatcgagcatcctcgcgtgggcctgcttgccaatggcaccgaggatgagaagggctccaactttaccaaggcctgtttccctgctatgaaggccgccgttcccggctttgttggtaactgcgagggcaccgacctcacctcaggtaacttcgatgtcgtcgttgccgatggcatgtcgggtaatatcgctctcaaagctaccgagggcgctgccaagtttttgctgcaggagctcaagggcgcctttatggcctcgctcggcaccaagatcgccgcgctgctcatcaaaaagcagatgcgcgagattaaggccaagctctctggcgacgccaagggcggcgcgattcttctgggcctgcgcggcgtggtcctgatcggccatggcgccacctcggtcgaggctgtcaaaaacggtacgctcgcggcggccgaagccgtgcgcgccgggctggtcgagaatgtcgccaactctatggacagtatcgttttgtaagagcgagttagagcgctgttatgtgcttcgcggcgcacgtcgtggggtagaatcagaaccgtgtcttggtaccgcccgggcggtaccattcttttggtattcatgtactatgagaggaagcgctatggaccgctccgaaatcttcgacaagatcgccgaggtcgctgctgacgttctgggcgtcgatgttgccgaaattagcgaggagaccacctttgacgacctcgatgccaactcgctcgagcgcctgcagctggttacggctatcgaggacgagttcaacctcgagatcgatgacgagaccctgctctcgctcaactctgtcgccgacgccgtcgacgctatcgaagctgccaaggaggcctaagtcttggctttatccgaacgacttacgcgcgcccaggaaatcctgggccacgagttcaacaataaggtgctgctgcgcgcggcccttacgcatccctcggcagtcgagggccagccggtttctgccagctatgagcgccttgagttcttgggcgattccattttgggcgctgtggtcgcacgctccctgtttgagtcctatcccgagtttgacgagggcaagctcactcgcttgaaggtgtcgctcgtctcgggcgccacgctatccgaggtttctcacgagttgggcatcgacgacatcattatctttggtgcctccgagaccggtaccggtgcgcgcggcctgcattcggccctcgagaacgtctatgagtcgctcgtgggcgcgctgtacctggatgccggctgggacgttgcggcggagttcattcaccgtacgcttaagccgcatttggcttccgagcgtgccgagcatcctgcgaaccccaagtcgtttttgcaggagtgcgtgcaagccgacggtcacgagcccccggcgtacaagctcgttggctccgagggcccggcgcatgcgcccacctttaccgctgtggttttgatcgatggtattcgccagggtcgcggctccggctcctcaaagaaggaagccgagggagctgccgcgcttgaagcgctcgaccgcatgggttacaccaccaacggcgtgattctgaacaagaagcacgtgtaagcgaggaaccgtgtatctcaagtcccttacgctcaaggggttcaagtcgtttgccgaccgcgcccatatgacgtttgagccgggcctgaccgtcatcgtcggtcccaacggctcgggaaaatcgaacatctccgactcgattctgtgggtcctgggcgagcagagtgccaagcagctgcgcggccaggccatggaggacgtcatcttctcgggctcgtcggcgcgcaagccggtgggtgtcgccgaggtcacgctggtgctcgataactcggaccatatgctgcccgtcgactttgacgaggtcgccatcacccgtcgtatgtatcgctcgggcgaaagcgagtacctcatcaactcgagcccgtgccgcctgatggacattcaggacatcctgcacgattcgggcctgggcaaggatacgcattccatcatcagccagggcaagctcgacgccattttgcagagccgccccgaggagcgccgcgccctgatcgaggaggctgccggcatctccaagcacaagcgccgcaaggaacgtgcgctcaaaaagattaaatcgatggacgagcacctgacccgtgcccgcgacatcaataaggagatcgcccgtcagctgcggccgctggagcgtcaggtcgatcgcgcgcgcaagtacaaagagctgtcctcgcgcgcgaacgagcttacgcagatgctggccgtcgacgagctccgttcgctgcagtcgcagtggaacgacctggagagccgctccaaggagggcgctgccgagcttgagcttgcgcagtaccgcctgggcgaaaaggagcgcgagctcgagaagctccaggtcatgctcgaggaaaagggcctttttgtgggcgatctgggcgagcagcgccgccatatgcaagacgtggtcggccgcattaactccgatatgcgcctgctcgaggaaaaaggccacaacatggtgtcgcgcctgtccgacatgcgcggccagatttcgagctccgaacatcagcgtcgtcgcgtggtcgaggagctcgaggatgcgcgtgcccagcttgaggaagttaccggtgcgcacatgcaggcccaggacgacgttgacgccgctgctcctgccgccgcccagctccacgagcgtcgcgttgcgctcgacaatcagatttcgcagcttacgcgcgagcagcgcgatgtgcagcgtgcggccgataacgccgcgctcgagcttgccaaggtgaaggactcgctgagcaacgccgaggtcgaggacaacatgtacgcctcgcgcctggagcagatcgacgagcagctcgaggaggtcacggcctcgctcgagagccgtcgcgaccgcgctgaggagctcgaaggtgcgctcgatcaggctcgccaagcccaggtcgatgcgcgtgaggccaccgaggtcgcccgtgcggcgttgaaggacctgcgtaatcgcgagagcgaggcgcgcaataaactgtccgaggttcgctctgagctcgcgagccaaaagaagctcgatgcccgcatggctgacagctcgccgcttgtgagccgtctgatgggcgcgttgggcgatgatgtctcgggtcgtctgggcgatgtgctcgaggcccctcgtgagctcgagggtctggtcgagcagctgcttgccggcgatatcgatgccctgctgtttgatgacgccgccacgcttgagcgtgccggccgtgcggctctggaccaaaagaaggcctcaggtgaggcgctgctgatggcgcgcggcgtgagcggcggtgctgctgctaagggcgctgccggttcgcgtttggtcgatcgtctgtccgtgcgttccggttatggcccggttgtcgaggccctgcttggcggctattacgtggtcgatgacttggctgccgcgctggcggcaccagtcgttgacggtgtgacctatgtgactcccgatggcgcccgcgtgagctgtggcggcctggtgcgcgttggactcgatgccggcgaggcttcgggcgccttggagcgcaagcgccgtattcgtgagctggagggcctggagcccgatttgactaccgtgtttgagcatgtgtcggaccaggttgtcgaggccaacgcggccgtcgaggaggcgcgttccgccgaaggcgatgtggccggcgagattgcccgccttgagggcgagcgtcgctcgctgctctccgagatcggccgcctggagcaaagcgccaacaatgccgaggtcgagcgcgtgcgcatttccaagcgccgcgagcaggctgccgaggccgttcgtgccgctcgtccacgcgtggatgaacttacccgttcgcgtgacgaagctcgtgcgcaggcgagcgacttaggtcttcagattgccgaagccaacgacgatctcgaccgcgtgcgtcgcgacgattccgaggccgccggcaagctcgccgacgctaaggtgcgcctggctcagacgagtgagcgcctgcgttctctgaagggccgcgtgcccgacctggagcatcgcctggagggcatcgaccgccgtatccgcggaacacgccaggcctcgcgctcgcttgagctgctgcgccttcgcgtcgatcccatgcacgagcgctattctgccctgttggagcgcgcctcggactgggcggcacgcctgcgcgatcaggcaacgcttgaggaggcggactcggcttcgcttaagaagaccatcgaggacgccaagaccgaggtcgcccgcgccaaagagagggtcgatgttgccgccacgacgcaaaatgagttcaaggtggcgcgcggcaagctcgaggtgcaggtagaggctgccattaaggccatcaccgccgacggcaccacggtgctcgaggaggcgctcatgctgccggcgcccaccgatcgcgacgccgccgagcgcgagcttaaccaactcgtgcgccagatcaacaacctgggtcctgtgaaccaagtcgccatggaggagtacgagcagctcaagcgccgcgccgattacatcgaggagcagctggccgatctggagagcgcgcgcaaggcgctcaccaagatcaccgtggcgatcgatcgcaagatgcgcaaggccttcctggtgacctttgagaaggtcgatgcgaacttccgcgagatcttcgccatgctcttcccgggcggtcaggcgcatctggagatgaccgaccccgagcatccggccgagacgggcattgaggtcgtggcgcagccgcgcggcaagcgcatcaccaagatgatgctcatgtcgggtggcgagaagagtctgacggcgctcgccctgctctttgccgtataccgtacgcgcacggtgccgttctatgtgctggacgaggtcgaggccgcgctcgacgacgccaacctgtccaagctcatcggtgctctcgatgtgctgcgttccgatacgcagctcttggtaatctcgcatcagcgccgtactatggaggatgctgacgttctctacggcgtctcgatgcaagccgacggcgtcagtcgcgtcgtctcgcaaaaactcgatcgcgaaaccggaaaggtcgtgaatgcataatgggattctttgacgcactctcgcgcggacttgagcgcagccgcgaggccctcaacgaggtcttctactttggcggtgaggtcgacgaggatttttgggaggaccttgaggacaccctcgttatgggtgacatgggtgccgaggtcgccattcaggtctccgatgacctgcgcgatgccgcggccaagaagaacctcaagaccgccccgcagcttcgccgcgccctggccgagcagctcgagggccattttgtgcctgttgagcgcgacccgttttccgatacgccgagctgcgtgctgtttgtcggtatcaacggcgccggcaagaccaccacggtcggcaagattgcgagcgccatggccgcccgcggcaagaacgtggtcatcggttcggccgacaccttccgcgccgccgctatcgagcagctcgatgtgtggggtcagcgtgccggcgtaccggttatcaagcgtgaccgcggttccgatccggcgagcgtgtgctatgacgtgctcgacgaggccgataagcgcggcagcgacctggtgctcattgataccgccggtcgtctgcacacgagccccgagctcatgcgcgagctcgccaaggtggtcaatgtgactcgtaagcgcgccgccaatatggccgccggtcccatgccggtctcggtcgtgcttgtgatcgatgccgccactggtcagaacggtctgaaccaggcgctcgagtttaacgaggcgctgggcctggacggtattatcatgactaagctcgacggcacggctaagggcggtatcgccatggccgtggccgagaagctcaagctcccgatcctgcgcatcggcgtgggcgagcaggtcgatgacctgcaggagtttaacgccaaagatttctgccgcgccctggtgggcgagtccaactaaggagtaaccagtgtttgattccctgagcgatcgcctcaacgacacatttgaccgcctgcgcggtaagggtaagctgaccgaggccgatattacctcggccatgcgcgatattcgtatggcgttactcgaggccgacgttaactttaaggtcgtcaaggagttcgttgccaagaccaaggagcgctgcatgaccgccgaggtcatggagtcgctgtcgccggcgcaaaacgtcgtcaagatcgtgctcgacgagctcaccgagatgcttggctcaaccgagagcaagctcgtctttagcaaccgcattcccaatgtcatcatgctcgtgggcctgcagggctccggtaagaccacggctgccgtaaagctggcctacctgctcaagaagcagggccgctcgccgctgctcgccgcgtgcgacgtctaccgtcccgccgctgccgaccagttggccacgctcggtggcgagatcggcgtgccggtcttccgcggcgacggtgcgcatccggtcgacatcgccaagggcgccatccaggaggccgtcgaccacctgcgcgacgtggtcatcgtcgataccgccggtcgccttcagatcgacgagcagatgatgcaggaggccgtcgacatcaagaaggccgtcaagcccgatcaggtgctgatggtcgtcgatgccatgaccggccaggatatcgtcaacgtcgtctcgaccttcgccgatcgcaccgactttgacggtgtgattatctccaagctcgacggtgacgcccgtggcggtggcgcactttcggtgcgtcaggtgactggcaagcccatcaagtttgtgagcatgggtgagaagcccgattcgctggagccgttctatcccgatcgcatggccaagcgcattttgggcatgggcgacgtcgtcggcatcatcgagaaggcccaggaggcagccgatgcagagcagctcgaggctgccgagcgtatgctgcgcgagggctttaccatgaacgatatgctcgaccagatgaaagccgtcaagaagatgggcggcatgaagggcattctgggtatgctccccggtggccagcgcgccctcaaccagatgggcggcaacctggacgagggcatcttcgacaagaatgaggccatcatcatgtcgatgaccaaggaggagcgccttcgcccctccattatcaacggccagcgtcgcgcccgtatcgccaggggcgccggcgtaacccccaccgaggtcaacagccttatgaagcagtggggcgagatgaacaagatgatgggccgcatgcgcacgatggccaatcaagcgcaggccggcggcaagaagggcaaaaagggtaagaagggcaagaagatgcgcatgcccaatatccctggcctggacgctatgggtctgggcggtatgggcggcctgggcacgggcggtcccaagtccgatatggagctgctgcgccagatggaagcgcagatgcgcaataagaaatagggctgtaattccagcttgatatggcaaaggccactcggaagctaccgggtggcctttgttgttggctttgattgttgggttgagttcggcgtcgcgccccgagctcgcggtgtcgtgccgttagtggcagctgcagccctcgtggccctcgtgctcgtgatggtcgtggcagctgcaggactcgccgtgttcgtgggcgtggtcgtggtcatggccgtggcagccgcacgtggcctcgccgttctgtgcgagcgtgccggcgataagggcctcgacgcaagcgtcgctgttgccctgggcacctgcgtataccgtgatgccggcttgggcaagcgcgttgatagcgccaccgccgatgccgccgcagatgagcgcgtccacgccaccgttggcgagcaggcccgcaagggcaccgtggccggtgccgccggtgcccacgacctgttcgttgagcaccttgccgtcctgaatgtcgtagatcttgaactgctcgctgcggccaaagtgcataaagatgttgccgttgtcgtacgtggttgccaccctcatggtgtcgacctcctttgctggccatgcggccgtcgttgtggtgatgggggagtacacgatattgccgcctttgatgatgagcgctcgtccgttgaccagcgcatttgctaccttgcgatgcgcacggctgcagattgccgccaccgtggcgcgcgcgatgcccatctgctgtgcgactgcctcttggttaaggccttccaggtcgcacaggcgcagcacctcgagttcgtcgatcgtcatgtcgatggcgtctccgctcgccaggccatcgggggtaaagccgcggtattcggggatgatcccgacgcggcgcagtttctcgcgtcttcctgccatgcaccctccttatctgacatatgtcaacaatagaataacgaaactgtagatttgcgcaaggaatttctggcatatgtcagaatatgagggcttatgtttgggctgtggggccgcgtgcgcctgggctacaatgaatctcgcttataggcgactgacaggagggtcaatgagcaaggctgatcagcagtttgtagctatgtgccgcgacatcttggaccatggcaccacgaccgagggccaaaaggtccgcccggtgtgggaggacggcacccctgcctataccattaaaaactttggagttacggcacgctacgacctgcgcgaggagttccccgcgctcaccctgcgtcgcacggcgcttaagtctgcgatggatgagatcctgtggatctatcagaagaagtccaataacgtgcatgacctcaacagccatatttgggatgagtgggccgacgagaccggctctatcggcaaagcctacggctaccagattgggcagaagagccattatgccgagggtgactttgatcagatggaccgcgtgctgtacgacctcaagcacacgccgtacagccgccgcattatgacgaacacctatgtgtttagcgacctgtccgagatgcacctgtatccgtgcgcctacagcgtgacgtataacgtgacgcagcgcccgcaggacgacaagccgacgctcaacatgattctcaaccagcgtagccaggatattttggccgcgaacaactggaatgtgtgccagtacgccattttgctgatgatggttgcgcagtcggtcgatatgatcgctggcgagctgctgcacgtgattgccgatgcccacatttacgaccgtcatgtcgatatcatccgcgaacttatcgagcgtccgcagtttgccgcgcccaaggtaacgctcaaccccgatgtgcatgacttctatgcgtttacgaccgatgacctgatcgtcgagggctatgagcacggcccgcaggtcaagaacatccccatcgcggtgtaggtgacgcgcatgacgtgtaagctttctgccattgtcgccgtgtgcgatgactggggcattgggtgcgagggcgacatggtggtgtccaatcgcgccgatatgcgccattttgtggcctgcaccaagggctgcccggttatcatgggacgcaagaccctgctgagttttcccggcgggcgtccgctcaagaaccgccgcaatatcgtgctcacccgcgacgagagctttgcccccgagggcgtcgacgtggtgcatagtatcgacgaggcgctcgccgcggttgccgatgagcccgttgcctgggtgatcggtggcggcgatgtctatcggcattttttgccgtattgcgtcgaggccgaggtcacgcataaccactgcgtccatgtcgtggatacgtactttcccgatttggaagccgatcctgcgtgggagattgcgcagcgtagcggggtcgcgacgattgccgccggtgagggtgacgagggcgtcgattatgagttcgtgacgtatcgtcgcatcgaggcgtaaatcgtctggcgtgaacggtatcatcgggttgattgaatgcatggggcggcgcttagcgtcgcctcgtttggtatagatgtgctgtatagaagggtgcgggctggctgctatgactgatgccgttgaggttctgcgaattgattcgctcgaggacgagcggctcgatgcctacgtgcgactgaccgagcgtgagcttcgctgcgtgctggagccgcagaagggcatttttatcgctgagagtgccaaggtcatcgagcgtgcggttcgcgccggatatgagccggtgagctttcttctgggcgagcgctggctcgaccagatgatgccgctgtttgaccagcttgtcgtgcgcgagggagcgggtccggttcccgtgttcgtggcctccatggagctcatggagcagttgacgggctttaacgtgacgcgcggcgcgctggcggcgttccgtcgcccgcgtcagattccggttgatgagttcttgggcggcgttgtcgaggcggcggggggtcgtccggtgcgcgtgtgcgtgcttgagggtattgtcgatcacaccaatgttggcgcgattttccgctcggctgccgcattgaacgttgacggtattttggtcagcccgacgtgctgcgatccactgtatcgtcgctcggcccgcgtgagcatgggcaccgtgtttcaggtgccgtggacgcgcattggcagcgaggctcgtgtgtggccgcatgatggtctgagcgcgttgcacgatgccggtttttcgtgtgccgctatggcgttgacggacgactctgtttcgcttgatgatcctgtactgcggaagattgatcgcttggcgatttttatgggcaccgagggtgccggcttgggcgccaagaccattgccggctgtgaccacgcggtgcgcattccgatggcgcacggggtcgattcgctcaacgtggccgcggcgagcgccgtcgccttttggcagctgtgcccgcacgtgagcaatgagtatcactaccagccgggtttgtatcactaggcagatattttgcactgggctctgattcggggtgtttcggtcgacgccggtcggtgctaagctggtatttgctttggtcttaaattgccgttttgttgtttaacatacgttggcggggagggcgtgtggctaagaaatctacggctatcgatgtaacgcagggtgtcatttggcaacagctgctgtcgctgtgcgttcccatcttttttagttcgttttttcagcaggcctacacgcttatcggtacgtatatcgttggccagtttggcggcaagctcgcgctgggtggcattcaagccacgatggtgctcaccgagctctgcattggcttttgcgttggcgtcggcgccggctgcgcggtcattaccggtcagtattttggccagcacgatgatgagcgactgagtcgttcggtccatacagccatgacgcttgcgctggtgggcggtatcgctttctcgattcttggcatagtgttcgttgagcccatgctggtgcttatgaacacgccgcatgaactattggccgagggcgtggcctatgctcgctgttattttgccgcgatggttgcggcactgctgcttaatatgggaaccgcactgctgcgtgccgtgggcgacacgcgcggccccgccgtgatcattgcctctggctgcctggttaacgtggtgctggatatcatttttgtcgctgtgttgcatatggaggcgctgggctgcggcatcgcggtggcgctgaccatttgctccaatgcaacgatgatcgtgttgcgcatgatgcgcgctccgggtgcatggcgtctttcgctgtctaagctcggtatcgatcgcggtatttgcaagagtatgatctcgtgtggtctgccactcggttttcaatcggctgcctattcgatctcgaacgtgctgatccaggtatcggttaattcgtttggcgccgatgtcacgactgcttggggtctatctgggcgcctggatggcattatctggatggtgaccgaggcgctcggcgtatcgatcactacgttctcggcgcagaactttggcgcgcgcaactacgagcgcatgcgcaagggctaccatacgtcgctcgtgctgtcgtttatgctcattggtggcctgtctgccgtgctgctggtgttctcgggcccgctgtcgcgtttgtttgtcgacgatgctttgatttcggcgtacaccacgactatcctccatttcattgcgccgttctatgcgattttctcgattatcgagaacgcctcgggttccatccgcggcgccggcgtgagtttgcagcctatgatgctcaccatctttggcaccgttgtcttgagggtgatctgggtgtttgcgatcatgcccttcgatccgtcgctcgagcatctactgctggtctaccccgtaacgtggctcattacggccacgatgttcaccatctaccaccacagcggcaactggctcggccgcgccaccgcctagccattcgggacgtccccaatggctagtattcgatgccttggcgggctaggagtccttcgtcgaagtagtgtttgatggggcgcatttcggtgacaaggtcggcgaggttcgcgaggggcagcaggccgcggccggttagcacgagctccgtggtggcgggcttctgcgcgatcagcccctccacatccttgcgcgttacaaagccgcggcgcatcgcttcgccgagttcgtccaggatgagcacatcgacctgcgagatctgctcgcgtgctagctccagaatctgtgccgcgcaggcctcgggcgtgtcgcggtcggcttgtacgatgcgcagacccaaacggggcgccgcatcatgctcggcgcagtgaagtttcttggcaaactgcagcctaagaacgtcgagtccgtagcccgtcgcgcgcagcgcgagccccagcgcagccgtcgtcttgcccttgccgtcgcctgtatagatttgaaccttgccgacttacagtgatgccatctctgtcctttcgtgcccggcgtcggtttatcgccggccgggttgggtattctagttagcattatcaaccccagtagatggagttcaagcagatggagatggatgacaacaagcgtagacggaatatgatcctctacgtgctcatcgccttcgtcgtctacctcgtgctctcgaccgttctgttccctaacatcggtcacacgcagcagattacgaagaccgattactcgacgtttgtcaaagcgctcgataagaagagtgtcgacaaggtcgagtacaacacggacgattactcgatttattacaccaagaagggcgaggacgagaacatcgcctataagacgaccggtgtgccgaacgatgcgggctttaccgatcgcgtgcttgagtctggcgcttcgctggagtcggtcgttcccgataaaaactcgggtttgatgacctactacctgctcacgctcattcttcccatggcgattttcttcctcatcggttggtggctcaaccgccgcatgaagaaggctatgggcgatgacggcccgtcgatgaactttggcggcggcggttttggcggcggcggactgggtaagtccggcgcgcgcgtgatcgcctccaaggacgtgggcgtgacctttaaggacgtcgccggccaggaagaggccaaggagtccctcaaggaggtcgtcgactttctggagaagccgcagcgctacgaggagattggcgccaagctgccgcgcggtgctctccttgttggccctccgggtaccggtaagaccctgctagccaaggctgttgccggcgaggctggtgttccgttctttagcatttcgggttctgagttcgtcgagatgttcgtcggccgtggcgccgccaaggtgcgtgacctttttaagcaggccaaggaaaaggccccgtgcatcgtgtttatcgacgagatcgataccatcggtaagaagcgcgatggcggcggttttagcggcaacgacgagcgtgagcagacgctcaatcagttgctgaccgagatggatggcttcgataaccacaagggtatcgttgtccttgccgcaaccaatcgccccgacagtctcgatccggcgctgctgcgccccggtcgttttgaccgccgcatccccgtcgagttgcccgatctgaccggccgtaagaacatcctcgagcttcacgccaagagtgtgaagaccgagccgccgatcgatctgaccgcgattgcccgcgccacgcccggtgcctcgggcgccgacctggccaatatcatcaacgagggcgccctgcgcgccgttcgcgagggtcgcaagcgtgcaacccaggacgacttcgaggagtcggtggaggtcgtcattgccggccaacagcgtaagtccacggtgctttccgaccacgagaagcaggtcgtttcctaccacgagatcggccatgctatcgtcgctgcccgccaaaagggttccgcgccggttaccaagatcaccatcgtgccgcgcacgagcggtgctcttggctataccatgcaggtcgaggaggacgagcgcttcctgacgacacgccaggaggtcttggacaagctcgccgtctactgcggcggccgtgcggccgaggaactcatctttggcgagatgacgaccggtgccgccaacgatatcgaacaggccaccaagcttgcccgtaacatggtgacgcgctttggtatgtccgacgagtttggcatgatggcgctcggtaccgtgcagaacgcgtatctcaatcaggacacgtcgctcacctgcgcccctggtacggccgagcgtgtggacgcgattgtcgctaagctgatcgaggacgcgcacgatcgcgccctgcagatcctcaaggaaaacaagttcaagctccatgagctggctcgttatctgtacaagaaggagaccatcacgggtgaggagttcatgaacctcctcacgcgcgagaatccgctgatgcccaagcaacagtaacgccgcggtcgagccagtaaacgccgacgccccatttgagcagctttctcaaatggggcgttttgcttgagagggatggaaatgaagatcgtggtgagcgcctgcttgatgggcgagagctgcaagtataacgggcttgacaactatcgtcgcgagttggtcgaggcctgcgagcgtacagggactgaggtcctcttggtgtgccctgaggtctttggcggcctgcccacgccgcgcaggccgtccgagattgtgaacggcgaggtccgtacctgcgagggtgcctcggtcgatcgcgagtttcgcctgggcgctcaacgtgcgctcgacatgtgcgagcaggcgggcggcccgtccgagatcgttgcgtgcattttgcaggatcgcagtccgtcgtgcggcgtgggccatatctacgacggatccttcagcggcacgctcacaacaggtaacggtgtcttcgttgacctgctcctgcgccacggctaccgcgttatcccggctagcgagttcgactcgagcatgttacggcaataaaaaaccgccacaaaggtattgtcccctttgtggcggttttggtcggttaggccaggatagaatggccgtaggcgttggcggccttgatggcggcggcgaacttttcgtcggtgaagggctccgggttgccttgcttccactcgttggtggcgtgcgcgtattcgcacagggccgggatatctgcctcggtaaggccaacctgctcaagcgttacgggcagccccatctgcttgttaaaggcggcgtagcgctcaaggttctcggtatcgcccgtataggcaaacagtaccagcacgcccaggctcacgacctcgccatgcaggtaggtgccctcacgcggaatgctgcaggtggcgttgtagaacgcgtgcgccacgctcgagttgtagtaataatcgttctggttggtcaggttcgagacatagcccgtgttgacaacgatgtcgagcgcgatctgcttgacggcctcgctcgacagattctggcgcacatcctcaagaccctgcacaccataggtaaacagcggctcggagcaggtgtgggcgagtgccaggccaagaccggcggtgtgctccaaattaccggcgctcgtggcgtactcgacctcgggctgcttggacagggcatcgcctacaccggcccagaagtactctgctggcgcctcggcgatgatcttggggttgatgaagatgtgcgcggggcggttggggtacgaatagccctcgagcgagccgtcgtcgttgtagacaacggcaatggcggtcgcggcggagcagttggagcagatcgtcggcacggtaaagacgatcttcttgagctcgatggccgccgtcttgacggtatcgagcgccttgccgccgccgcaagcaatgagcacgtcggcttcctggcaggcgggggagtttacgaccttggcgatattggcacgcgtactgttggtaccgtagacgcgcgtctccaggacctcgacatcggtaccttcaagggccgcctcgattcccggcagcgccgcagccagggctcgcttgccgccaatgatggcgactttcttcgcgccgtactccgccagtgcagttggcagcttggtaaagcaatcctcgccaacggtgtagtcgctcattccaattgtgcgcatagcagccttctttcgttcgataaagtgctttcaggtattttgctcctagtgaaggcttgtaatagcgagaaatttcgaacgtataaaaccagtgttgagggttttttgccgacgcggaacgtgctagcatacaccgcataagcgttgatggggacgagtagtcggccgtccgcatgctacagagagcgggaagcgctgagaacccgtgcatgcgaccgatgaaaatcaccccggagctgcggtcccaacggacgtgccgcgcagacacgtcttagtagatatcgccgagatggtcgtcgatacaggccagccgagtaacggatgcgagcgcgcgaatacgcgggcgagggcatctaagctgggtggttaaacgaagagcttttgcgggcgtacagctcgttttgtggcgcttcgtcccagcttgtagggacgggcgcttttttggtgcccaacgggcgtgtgcgcccatgacatgaaaggggtaccgtggcaaacgagtacaagcagacgatgaatctgcccaagaccggttttcccatgcgtgccggtctttccaagtccgagcccaagcgactcaaggactggcaggacaacaaggtctacgagcaggttctgaagaagaacgagggtcacaagaagttcgtgctgcacgacggtcctccgtacgccaacggcccgattcacatcggccatgccatgaacaagatctccaaggacatgatcaaccgttactggatgatgcagggctatgaggttccctatgttcccggttgggactgccatggccagccgatcgagcataaggtcgaggagaagctcggcaccgagaagttcaaccagacctccacggctaagatccgtgagctttgcaataagttcgctgtcgagaacatcgagctgcagaaggccggcttccgtcgcctgggcgtgctcggcgattgggacaacccctatctgacgctctatcaccagcatgacgccgccgacatcgatgttttcaaggccatgttcgacaagggcatgatctatcgcggtcacaagcccgtccactggtgcaagcactgccataccgcacttgctgaggccgagattgagtactccgacgagacgagcccgtccatcttcgtgcgctttgagatgacctccaagcccgccggcctcgagaacttcgacggcccggttgactttatcatctggacgaccacgccgtggaccatcccctccgaccaggcagtttctctcaagcccggtgccgcctacgtcgccgttgagcacgacggccgcgccgaggtcatgctcgaggacctagctcccaagtgctgcgaggagtttggctgggagtacaccccggttgtggtcgacggcaagccctatgtggttcccgccgagaccttccatcacattcactataagcagccgatctttgacggtgtcgagggcgttgcgctgttggccgattacgtcggtgtcgatgacggtaccggtatcgtccacaactcgcccggtcacggcgtcgacgactacttcgcctgcctcaaggagggcatcaccgacatttgcatgccggtcgatgacgacggcaagttctacaccggcgaggagtttggcaccggcggccccttcagcggcatggataccgacgaggccaacccgcacatcatcgagttcctgcgcgagcgcggcaccctggtcctcgagaagaagatcacgcacagctatccgcactgctggcgctgcaagcacccggtgctcttccgtgctaccgaccagtggtttgtctcgatggacaagactggtttgcgcgagcaggctggtaaggaggttcgcgagaacgtcaagtggtatccggctcacgccgccaaccgcatcggcgccatggttgagcagcgtcccgactggtgcatcagccgtcagcgcaactggggcgtgcctatccccagctacacctgtgccgactgcggcgagaaggtcatgaacgacgctacgctcgacgccgtcatcaagctcttccacgagaagggctccgacgcctggttcaccgacgctcccgagagctacctgggcgaggcctgcgtctgccccaagtgcggcggccatcacctcaaggccgataaggacatcctcgacgtgtggtgggattccggcgtctcctggaaggccgtctgcgagtaccgtcccgagctggagtatccggcggatgtgtacctcgagggctccgaccagcatcgcggttggttccagagctcgctgctcacttcggtgggcgccaacggccatgctccctacaaggcggtcgtctcgcagggcttcacgctcgacggccagggccgcaagatgtccaagtcgctcggcaacgtcatcgaccccaataaggtctgtgacgagatgggcgccgacatcatccgcctgtgggttgcttccgttgacaccagctccgacgtgtccatcgaccacgagattcttgcccgtacgtccgatgcctaccgtcgtttccgcaacacgctgcgcttcctgctttccgagctcgagggccagtttgagcctgagaccgacggtgtcgcctttgccgacctgctgccgctcgacaagctcatggttgcccgtctgacccaggttcaggccgaggtcgacgacgcttactcttgctacgagttcccgcgcgcttaccgtgcgctttatgacttcgtggttaccgagctttccaacgtgtacctcgacgccctgaaggaccgcctgtactgcgacaagcctggctcgctcgagcgccgcagcgcccagaccgtgctggccgagctcttctcgatgctcatgcgcgatctgcagccgattttgtcctacaccgtcgacgaggccatggcctacgcgcctgccggctgcgtcgaccaccagaagtacgccgcgctgctcgattggtataagtcgcctatcacggtcgacgaggccaatgagttcgagggcgtgctcgaggcttcactcgagctccgtagcgccgtgaccaaggcccttgaggatgcccgctccgtcggcaccttcactaagagccagcaggtccgcgtcaaggcggtcgttcccgccgagatgtacgcgctgctgaccggcgacaaggcggtcgacctggccgagttctacatcgtttccgatgttgagctgacccagggcgaggagctctccgttgccatcgaggctgccgagggcgagtgctgcgaccgttgctggaattaccgcaccaccgtcggcgagtacaacggtcacgcacatatctgcaagcgctgcgctgacgcgctgtaggttacggcgttcgtagaacgccgtaacctaccgacgctgcaaacgctcctaagcggcaatctgacgttcaatcgtcggtcgcgtaccaaagtacgcttccctcctctttcacgtcaccttgctcgcttagggacgttttcgctgttgatgacggtaatgcggcgtttctatggacctagtcgttggggacgttcttaaacgactagtcaaacaagaacgtccccaacgactacctgtgtcatatttaagcggcattctgtttttcggaatgtcgctttcgttttgtgctggttatttcgcttgcgttggtggatatgtcgtgcgctctgcgtatggcaatataagatggttaattgcgttcaacggaatccgattgttctgagggcaggggattgatttgggtcgtactggggatatgacgccgcctttgggttggcggttgggtgttgctggtggggtggcgctggttgtgctgcttgttgaccagttgaccaagcttgcggttcgtgccgtgggcgatgcactgcatgtgaccgtcatccccggcgtgatcgacttcctgtttgtccgcaatatcggcgctgcctttagcatgggcgaggggcatggcatcgcgtttgccgtgctggcgctggcggtcattgtcgctattgccgtgtacctcgttcgtgcacctcatctcgcccatcttgaggttgtgggcatggcgatggttgcgggcggtgctatcggcaacgctatcgatcgtttggcctttggcttcgtgaccgattttattgccaccaccttcatcgactttcccgtcttcaatgtggccgatatcggcattacggtcggtgttgtgctggcgcttatcggttacattttcttgagtcccgccgctcgcgaggtcgatgcgactgctgagctcaatgcccgtgatgaggcccgcgctaagcgcaaagccaagcagcgtggggagcgtgcccgcaagattcgcgaaaggaatgagcgttaatggccgacatccatattcttgttgccgacgattgctctggccagcgtctcgacggctttctgggtgccaacgacggctgccccacgcgctctgcctgcgcgcatttgatcgagggcggcgccgtaatcgtgaacggcgagacctgtctgtcaaaaaagtatgccgtacgcgccggtgaccgcatctcggtcgacctgcccgagccgcacgatcccaccgatgtgattcccgaggccatcccgctcgacattcgctatgaggacgactatctcattgtgctctccaagcagcgcgggctggtgtgccatcccgcccacggccacgagagcggcacgcttgcgaacgccttggtctaccactgcggtatcgatcatcttggtaccgtgcagggtgaggaccgccccggcatcgtgcatcgcctggatcgcgatacctcgggccttatgctcgcggcaaaagacgacgacacccagcgcgcgcttcaaaatctcattcgcacgcgtacgctcgaccgccgctatatcacgcttgtccacgggcacatcgccatggacgagggcaccatcaataccggtattgcccgatcgacgcgcgaccgtgtcaagatggcggtttctgacgatcctttcgcccgccaggccattacgacctttaaggtcctcgagcgcttcgattccatgcgttttgacgacggctatacgctcgttgagtgccatctgtttaccggtcgcacgcaccagattcgcgtgcatatgcgtcatatcaaccacgcctgcgtgggcgatccactctacggcaagtgcgatgcgcgcgccgaccagggcctgaccaggcagttccttcattcctggcgcgtggcgttcgaccatcccgtgacgggggagcgcattgagtgccgcgacgagttgccgtgggatctcgctgcggttctcgacgatctggctccgcgctcgctcggtcgcacggccgttggagatgaaatcgttccgcagctcggtcttctcgaagcctagccagtattaggtggtttcttgaactcggtaagcctgcggtaagatatacgattgtttacgttacgcgttgctgggagcctgcatgctcgcctttttacaaaccaacacacccatcgtgatcttcaaccagattgtcgtcacgctgctcacggtctgctttctgtaccaggtggtcttctttgtcattggtgctcttcgtggcgaggtcgcgcctcccaaggccaaaaaactccatcgctatgccttttttattgcggcgcataatgaggaggccgtgatcgccaacctcgttcgctccatcaaggaccaggattatccgtccgagctcatcgaggttttcgtggtcgccgatgcctgcaccgacaacacggcgcagctcgcgcgcgaggccggtgccattgtttacgagcgcaatgacctggcccgcaagggcaagagctgggtcatggactttggcttcgaccgcattctcaacgagtatcccgacacgtttgagggctactttatcttcgatgccgataacgttatctcccgcgattacgtttccaagatgaatgatgcctttgaccagggcttccatgtggtcacgagctatcgcaattccaagaacttcggcagctcgtggatctcggcagctaatgccacgtggtatctacgcgaggcgcgcttcctcaacaacgcgcgtaatatctgcaagacgtcctgcgctgtttcgggttcgggttaccttatctcgtcaagcgttatcgagggcatgcacggttggcagttccacacgctgaccgaggacattcagttcactacgttctgcgctattcacggtattcgcattggctatgcgccggcggagttctttgacgagcaacccgtgacgttcaaggcatcctggaagcagcgtatgcgctggaccaagggcttttaccaggtgttctttacctacggtaagcatctggtcaagtcgacgttccgctatcatcgctttgccgcctacgacatgttcatgacgatcgccccgggtatgctgctatcgctgatctcgatgctcgctaatgcgacgttcttgattgtgggtggcctttcgcatggtttcttggctaccgaagtcgagatgcaggcgtgcgccgcttcgctcattatgaccttcgccatgatgtatcagaccttctttatcctggcgctgctcacgactatctttgagtacaagcacattcactgcgcgcaaaagtggcgtctggtgactaacctgtttaccttcccgatctttatgttcagctatatccccatcacggtggccgcgctgttcctgaaggtcgactgggttcctacccagcacgccgtcaacgttacccttgacgaggtcatgcaaggcgccaaataaccaccaccaaaaccaccgcaaaggggacaggcacctttgtggtggtttttgcttttgcgatgcagctcgaggaggagtccgatggtctatatcccgttttggatttgcatctttgccggcgtggcaattgatgccctagagcgacggtttcccaatgggcttgccggcgcatgtgccgtggcggcgttggcgggcgtttggctcgacctcggtttgaacacagcgcttgaccacgccggtcttgcggtcatcgtctaccttgcccttgtgctcactgagtcgctctggcggcgccttcgccacgcgccgggcatcggcatgggggatgccaaggcgctcttcgcgctttgcacgctcgaccctatgggtggcatcgtggcatttgccgtcgcactcctggccctggccctctcctgcctcttcacaaaatcgcgctccctgccattgctcccgtttttagtgccgatttttgccataatcgaggtcgtgggctgcactttgtaaccgattgcgcatccttcttaaggagcatgccatggcaactaatcaagaaacggccgtcattaaggcgcgcatggaccgtattccctcggcgttgtcgcccgagcttgtcgagcgcattgccgccgatcgtgcttcgggctatgtcaacccgtatcgttgcaacgacgatcaggtcattcgtcgtattgatcgcgccgccgacaaaggcacgcttatgcgtccggcgtttatgcgcgatactgaaaagatacttcatcttccggcgtacacccgttatgcaggcaaaacgcaggtctttagcttccgttgcaatgacgatctgtcacgccgcggtttgcacgtgcagctcgtctcccgcattgcgcgcgatatcggtcgcgccctggggctcaattgcgatctgatcgaggcgattggcctgggtcacgacttgggacacacgcctttcggccatgccggcgagcgcttcctcaacgatatctatcatgagcgtacggggcgttattttttccataacgtgcagtcggtccgcgtgctcgacgcactgtacggccgcaacgtgtcgctccagacgctcgacggcgtgctatgccataacggcgagtacgagcaacgtgtgtttgagctctcggacatgggctcctttgaccagtttgaccagacggttgaggattgcattgccacgggctatagcgcaattgagcatctgcgtcccatgacgctcgagggctgcgtcgttcgcatctcggatattcttgcctacgtcggtcgtgaccgtcaggatgcgatcgcggcgggcctgctttcgcccgacgcttttgatgatggccggggcggtgcctacaacagttggatcctcacgcatgcctccatcgatatcgttgagcacagctatggtaagccgcgcatcgggatgagcgaggacctgtttgaggaaattcgccgagccaagcgcgagaactacgagaagatctatagcaagggcggtatcgaaggcgattccgaggcggagctgcgcgaggcgttcgtaaagctctacgaccgttgcctgcgggatcttaacagtggcgacgagtcctcttacatctttaagcaccatatttcgcgcattgagcagcagctttcctactatgatcgcacctatgcctggcaggacgacaaggatcaagccgtggtggattatatcgcgagcatgacggacggttatttctgcgagctgacgagcaagctgttccctggtctggagtttccgcaccgtacctatattaacgaacggtagttcgtattaattcggtatactgttagtggaaaacgtttttgattgatacacgggatggctatggacgaccttttttctgcttcgacgcgcgagcgttcctttcagaatgcgccgcttgcggtgcgcatgcgccccaattcgctcgacgagtacgtgggccagcaaaaggccgtcggtaagggttcatggctgcgtgccgcgatcgagcacgacgtgctttcgagcgtgattctgtacgggcctgccggtacgggcaagacgacgctggcccacattatcgccaaccataccaagagcgagtttgttgaggtcagcgccgtcacgggtaccgtgaaggacctgcgtcgtgtgattgatgaggccaagacgcgcctgaatacgtacgaccgccgcaccattctattcatcgatgagattcaccgcttctctaagtcgcagcaggatgccctgctgcatgcagttgagaaccgtaccgtcattatgattggcgctacgacagagaacccgtactttgaggtcaactcggcactgttgtcgcgcgggcgcgtggtggagcttgaacatctgaaggatgaggatatcgccacgcttattgagcgtgcgctcgaggcaccacagggcttgaacggaaagttctcggccgatgaggatacggtcaagaccatttgcacgctggcagcgggtgacgctcgctcggcgctcacgacgctcgagcttgcgagcgagattgccgtcacgcgttccgataccgagggaacgccagcgcctgcggcgggggagcgctatcccatcaccgtggatgacgtgaagattgccaacccgcgtcgcggctttacgtatgacaaaaacggcgacatgcactacgacatcatcagtgcgttcatcaagtccatgcgcggtagtgaccccgatgccacgatctattggctcgcgcgcatgatcgatgctggggaggatcctaagtttatcgctcgccgcattatgattcacgcttctgaggatgttggcaacgccgacccgcaggcgcttttggtggcgcatgccgcgtttaagtctgccgaggtcattggctatcccgagtgccgcattaacctggctcaggctgcactctatgtgtgcttggcgccaaaatccaacgcgtgtgaggcttcgatcgatgcggcgctggccgatatccattctagtgggcttcgcgaggtgccgagttatctgcgcgatcgccatcgcccgggcagcgatgaatacggtgtgtataagtatccacatgattatcccgaaggctgggtcgatcagcgctatttgcccgaaggcttggaacgcggtgcattttggcagcctgccgggcgcggctgggaagagtggcgcgtagagcaaagcgaacgagaccgcagcgggaatgcaccgaggtagctgctgataattttgtcccacgttgctgctcttggcatgttcggtcccctttggggtaccatgaaaagcgtctgtatttcgattcttccgggaggcttgtatgagtcccattcaaatcgccctgctgctgctcgccgttgccggcgtgtgggccatcgctgagctcgcgcttaccctgcgcaagacccgcaatgttgtcgactcgctcgataagaccgtgaacgacctcaacaacaccatcgccgaggctcagcctgtggtggcaaagctcgatggcgctgtcgatgagcttacgccggcgcttgcccagatggagccgctgcttaagtcgagcaagacggcagttgatgcccttacctccaatctcgtagaggtcgaagccgtggttcgcgacatttccgaggttacgggcagcatggccgaggccagcaatgctgtgtcgagcgtgaccgactctgccgccggtgctgtgcagaagctcttcaataaggtgaaggctcctgcagccgacgccgatcgcaagctcgccgctgccgctgcggaggccgagcagcctaccgagcgcgtcctaattggcgaggacgaggccgccgcgggcgacgatgatggtcagaagtctgtatccaagccggctcagtattacacctatacgcccgccgagacctctgaggagtcctgcgatgagtagcgaaacaacctgccctatcacgctgaccgttgccggtgacccgcgtctcgctcgccttgtgcgcatgacggcagccaacgttggtgccctgtgctctatgtctgtcgatcgcatcgaggacatccgcatggctgctgaggaggctttcatctttggttgcaccgcggtcgactgcgatgacatcaccatcaaattcgatgtcgatgagacccacgttggcatgactattacctttggcgaccaggctacggtcgatgaagacgaccaggctgcggtgtatgccgagctcatcctcgcgagcgtgtgcgactcctacgaaaagactacggcgcccctgacgctttccctcgacctcaaggcggatatctaatatgaccgaacgttcccggagcggcaagaccgcttgggacaaggagaaaacccgcgagctgtttcgtcgttacaaggagaccggtgatccggacgcccgtgagcagctcgtcatgtcccatatgaacctggtaaggtttcttgccaacaaatttaagaatcgcggcgagccgctcgacgacctcatgcaggtcggctatctgggcttgctcaaggctatcgaccgttttgatcccgagcgcggactcgagttcacgacgtttgcgacacccactatcctgggcgagatcaaacggcattttcgcgacaagggctggagtgtgcgcgtaccgcgtcgtctgcaggagctctcggccaaggtcaaccaggctactgacaaacttaccaacgagctgcagcgttcgcccaaggttgaggagatcgctgagtatctagatgtgactgtcgatgaggtcctcgaggctatggaatcgtcttcggcctatacctcggtgcccatcgaggctcctggtgcgtccgattccgacgatgccccttcgattctcgaccgttacgccgacgacgacaacgagctcgactttactgatgaccgcctagtgatcgaggaagccatccgtgatttctcgccgcgcgagcgcgaggtgatcgagctgcgctttctgaagggcatgacccagatcgagatcgccaagaagctgggtatttctcaggtgcaggtttcgcgtctgctgcgccgcacgcttaagaagattcaggacaagatcgaccccgacggagtgatgattcgttcatgagtgagcacccccaacaaaccgatcgcgtgctgcgcgacacccgcattctgacgctgcgcatttgggctgttgtcggctgcattgtcatcgccgctgtcatctttaaccttatgggcatcctggcgccggttatcgagtttctcgctgttggttccatcattgcctttgtgatgtccccgatcaccaactggctcgagcaccatggcgtgaatcgcggcatcggttcgcttatcgcgcttattgttgttgttgccgtgctcgtcggtgtcgttttcatcttgtcgccgattctctttggtcagatcatggaagtcctgagccgcctgcccgagcagcttcgtgttgcgggtggcgatctcaacgagatgatctcgcatgccaagacgctcaataacacgccgctcaaggagtatttggacgataatctttcgtcgctggttaccgtggcatcgaagtatgtgtctcagattgctgccgagcttggccgcggtgtgttcccgctcatcaccaatacggcctcgcagttgttcgtgatcttccttggtctggtgcttgcctactggatggcctgcgactaccctcgcatgcatcacgagatttgcaccatcatcggtcaggagaaggagacctcgtaccgctttatggtcgccatcctttctcgctctgtcggcggctacatgcgcggtatggtcgtgacgtccatctgcggtggtttcctcgcctttatcggcttcctgattatcggccatccgtatgcggcgctcatggctatcttcactggcatcatgcacttggttccggtcgtcggtccctgggtgagcgcggcaatcgccacggtactcggctttatgttcagccccatgttggcgttatggacgctcatcgtgacgatggtcgcgcaaaacgtcaccgacaatgtgatttcgcctaaggtcatgcagagctcagtgcaggtgcatcccattatgagccttacggctctcgttattggttcggcactcatggggcccatcggcatgattattgccatcccgctttgtgcggccctcaagggcatcttcgtgtactacttcgagaatgagaccggccgtcagcttgtggcctatgacggagccgtgtttaagggcacgccgtaccgcgatgccgatggcaacccggtcgccgcctacgacgcgctcggcgacgacaccttcatctatgagtccgagctcatcggtaacgagactgcgcccgaggcccaggccatgcccaaacccgagctcgataatccctggatgaagctctcgggccttcagcccgatgctacgggctttttcaagaatcccttcgccaaagacgacgatttcaatatgaacgacgacaccaaaaccggcatcgacggctccatggacgattcggattctaaataggttctattaacgtttcttgaagttgtaaatgacaagaaacgcgaccaaagcgattgataaggggccggctacatagaaaaagagaacgtcaattgcgcgtagagtgtaataagccttatcgccggacattactgtatacaatacgtatccaaatgatggttggtttgcgtaccagcatgagaaggccaagagcgctaaaagtgctacaaccagaagtgcattcaggacaaatcgtttgcttttcatcgatcgctccttccgggtgaatcttatatgcaattatacagcagtcctttttcaaaggatcgcgcagtactaaataacgtgcactttcgctggagggtcgctgtttggcgaccctcttttttgcacttgcgcggcgggatggtaatatcgttacgtttgaactgtttcgatgtgaaaccgaggagattccctctatgagtgctgactacccgtcaatgactacggccgagatccgctccaagttcctcaacttctttgaggagcgcggtcttaagctctatccttcttcgtccctcgtccccgacgatccttcactgctgcttgccaacgccggcatgaaccagtttaaggagtactaccagggcaagaagaccatgaaggagattggcgcgatctcctgccagaagtgcgtccgcaccaacgacatcgactgcatcggcgaggacggccgtcacctgtcgttcttcgagatgctcggcgatttctcttttggcggcgtctccaaggagcaggcttgcgcctgggcctttgagctcatcaccaaggagttcaagctgccgctcgaccgcctgtactttaccgtctttaccgaggacgatgagacccatgacgtgtggcgctccctgggcgttgccgaggaccacatctcccgcttgggcgaggacgacaacttctgggccgctggccccaccggcccctgcggtccgtgctccgagatctactttgacatgggcgaggaggtcggttgcggcagccccgactgcaagcccggctgcgactgcgaccgcttccttgagttctggaacctcgtgtttacccagtacgaccgccaggaggacggctccatgccggagctgccgcaccgcaacctcgatacgggcatgggcctggagcgcatggctgccatcatgcagcacaagaccgccaattacgacggcgatctgatgcagcacctcatcaaactcggtgaggagattagcggcaagacctatgacgccgatgactactccggcgccagccgctccctgcgcatcatcgccgaccactcccgtgctgtcgactttatgatctcggacggcatccttcccggcaacgagggtcgcgagtacgtccttcgccgtctgctccgccgtgccgtgttccacggtcgcctgctgggcatcgagggcgccttcctgaccaagttcatcgacgaggtcaacgctcaaatgggcgaggcctatcccgagttgctcaagaacgtcgcgctcgtcaagggtatcgttgcctccgaggaggagcgcttctccacgacgctcgacaacggccgcgtgtacctggacgaggccctggcagcgcttgccgagggcgctgtgcttccgggcgatgtcgcctttaagctgcacgacacctttggtttccccatcgatctgaccgtcgagatcgccggcaccgctggccacgacgtcgacatggacggcttcactgcctgcatggaggaccagaaggcccgcgcccgcgctaacgccaagggcgacgcctggggtagcttcaacgacgtgtgggtcgagctttccgacaaggtcgcagcgaccgagttcgacggctatgacaacgatgtgatcgagggcgccaaggttgtcgccatcgtgcgcaacggcgagtccgtcgagtccgcagccgcgggcgaggatgtcgaggtcgtgctcgaccgcaccccgttctatgccgagatgggtggtcagcagggcgatgccggcaagctttccgccgagggcgttgttctgaccgttgccgacaccaagaaccacaacggcctgtatgcccacgtcgcgcacgttgccgatggcacgctgactgtcggtgccgctgtgaccgccgctctcgacgccgagcgccgtggcttcctgcgccgcaaccacaccgccacgcacctgctcgacgctgcccttaagcaggtcctgggcgagcacgtctcccaggccggctcgctggtgacgcccgagcacctgcgctttgactttacgcacttcgaggccctttcctccgagcagctcaaggctgtcgaggacttggtcaaccagcagatcttcgcctccaagccggtcgtgacccgtgttatgggcatcgacgaggctaaggctgccggcgctgttgctctgtttggagagaagtacggcgatgtcgtccgcgtcgtctccgtgggcgccgaggaccagccgttctctcgcgagctctgcggtggcacgcacgctgctaacaccgccgagatcggcctgttcaagattatttccgagtcctctacgggctcgaacgtccgccgtatcgaggccgtgacctctaagggtgctctcgactatatggccgaccgcctggcactcgttgacgccgccgctgctgcgctcaagtgccgcgtcgacgaggttcccgcccgtgtggagaacctgcaggtcgagctgcgcgagacgtccaacaagctcaaaaaggctctgaccggtggttcctccgacgccatttccagctccatcgagggtgctgtcgagctcggtggctacaagctcgtcgttgctgagctccagggccttgaggctgccgacctgcgcaacgtatgggataccgtgcaccagaaggtcgccggccctgtcgcttgtgtcgtcgccagcgtgactgagaagggcactccggccctgctcgctgccggctccgatgacgccgtgaaggccgggttccacgccggtaatgtgatcaagcagatcgcgggtctggtcgacggtcgcggtggtggccgtcccaacatggcccaggccggtggcaagaatgctgccggcatcgccgatgccctcgcggccgccaagaccgcgctcggcgcctaagaatctaagaagtcactgtggtcgcgcttgcgctggacataggggagaccaggattggcatcgccgtctcgagccgtgatggcaagatggcgatgcccgtcaaggtgctcccggccgccgaggtcaccggtatggccaagacgttccgctacctggtcgaagactatgagcccgacatcctggtaagcggacgtcccctgaccatgggcggtgagcccggcccccaagccgagcgcgttgccgccgtggcgcaaaagattgccgacgagctcgatcttccgctggagtttgaggacgagcgtctgtcctcgcaagaggccaagcgtatcctgcgcgagcagggcctcaacgaaaagcagatgaggggcaagatcgacatgattgccgccagcctttttttgcagacgtggctcgatcgtaaaaacgaggaggtttcgcatgcctagtgcttccgatccgcgccagccgaatcgtacacgtcagccggcgtcgcgccctgcccagcctggccagcgtccggcacagccgacgcagcgcgcagctcagcctgccgcgcgcccggtgcagtccttctctcgttcggcccaacctgttcaacggacgggtcagcagccttctgctcgttcggttcagcatccggcttctcacgcggctcagcagcccactgctcgtacggcccagcctgcaggcggtacccgctttaagcagcaggcacctacccagcgaacgcaggccccccaatcgcattctcatcacgcccgcggttcgcatggcgttgctccggcgacccgctcgagctacaacacgcatactcgtcgcggtgctcaaaagaagagctctccggttcccatgatcatcggcgttgtggtggcggtgcttgcgcttgtcgcgatcgttttctttgtcgtgccggccgtcaagggcttctttgccggtgaggatacgaaggtcacggctggtcagcaggttacggtaaccattcccgacggtgcttcgggcgatacgatcgcctcgattctctccgagaaccatatcgtcgagaatcccaaggattactatgcggcggtgaaaaagctcaacgccgatatgtcgctcaagcctggtacctatttgttcaccacactcatggacgcgaccaaggttgttcagcagctcatggaaggtcccaacgcgggctccaatgcgctaacaatccctgagggcctgacggtcgatcaagtcgccgatcgtgtggcccaggcctacgatggcatctctaaggaagacttcctcaaccaggctaaggcctccaactacgtggacgactatagcttccttaagggcgccgccaacgactcgcttgagggtttcttgttccccaagacttattcgttgggcgattcgccgacggtcgatgacgtgattcgcgctatgctcgatcagtttaagaccgagtacaagtcgcttgactttgcgagctgcgaagccaagatcaaggaacgctacggtgtggagatgtccgactacgacatcgtcaacttggcctctatcgttgagcgcgagggcctcaacgccgaccagcgcgcgcacgtggcctcggtcttctacaaccgtcttgccggcaagctcgatggtctgcgctatctcaacagcgatgcgaccatgatgtatgtcaccggtggcgaggttaccgccgacgacctgcagagcgatagtccgtataacacctataagcatgagggtctgccatccacgcccatctgctctccgtcgctcgaggcactcaaggccacgcttgagccgaccgactccgatgacctgtatttctacattacgcaggacgaggagtacttctcgcaaacctacgaagagcatcaacagtcttggaattagcatgaggatttttagccccaaacgttacgttgcctcggtcgatcgcatcgaccttgataccctttgggccgacggcaaacgcgccattctgctcgatcgcgataacaccctggtgccgcgtgacaccgagcaggttcccgctgcggtttccgcttggctcgataccgcccgcgccaaaggctttaagctgtgcatggtgtccaacaactggcatcgcgaccaggtcatggcatcagcacgcgagctgggactcgaggccatcagccatgccatgaagccggcgccgtttgccctcaaggcgggtcttaagcgcctcggcgccacggccgacgaggcggtgctgatcggtgatcagctctacacggacgtgtggagcggcaacttcgccggcgtcgataccatcctggtaaagccgcaggccacgcaggacctgtggtatacgcagatcttccgtatctttgagcgccgggccctgcgcgaccttccctgcgaggaataggtctcgtcatgtcccagcacaccaaacacggctgcgaccatatcttctttatcggctttttgggcgcgggcaaatcgacgctcgcgcgcaacgtcggcactatgttcaagcggcgttttatcgataccgaccgcctagtcgtccgccgttgcggcaagtcggtaaccgagatttttgagaccgagggtgaggatcgttttcgcgagctcgagacctcggcgctccgttcgctccaaagcgagcgcagtctgttggtttcgtgcgggggcggtatcgtcgagacgccggtgaatattgagctgatgcacgaaatgggtacgtgcgtgtacctcgagggcgactttgaggattcgattcgccagattcgtcggtccgacacgcgccccgatttccgctcgcccgagcatgccgcgcgcttgtttgagcatcgccgtccgctgtatcgccaggccgccgatattacccttgatattcgcaacaagtccttcgaggacgtttcctacctttgtgccgagatgcttttggagcgtggactgctatgattcgccgccaactgatcaatttccaaaaccgcagcgtcgatgtccgtgtcggattgggcgcgttcgatgagctgtcgcgtatgtttgcctcggctgtgggcaagcctaagcgcgcgatggtggtttggaactccgcctcgtcagaacgttttgatgaggtcgtcgagcatgcgctggtcgacgccggttttgccgtgtcgcagttctcccttgaggtttcgcctgctggtgccacgctggccgatgccgatgctatctttggcgccttgtctgccaacggcattacctgcgacgatctggttgtcgccgttggcgatgccgcaacctgctcggttgttagctggtgcgccaaccagtggtgtggccgaaccgagtgcgcgctgctgccgacgacctttgacgccatgctcacggtcgcgacgaccatgaagccgctcattgcctcgtcgtcgaatgcgcttcccgctatcgcgttccgtcccgaaccgggcttggtcgtgtgtgacctcgaccttgttcgcgaggcggaccccgaggacctcaagctcggctatgtggtacttgttggcaccatgctttcgagcagtaagtcccgttggaatcagtttactgagaccgtccccgagattctcgcgggcgaggaggtcgcgctcgtcaatgccgttcaatggtctcagactgcccgcaaggacgtactgatggccacgaacccgagcgctcgccatgcgctcgattttggcaagacgggggagcgtaccctgcgcgcctgcttgggcgatgccgcttcgcaggcccctgcctaccagctgttgtccgagggcattcgctttgaggcacgccttgcacatgatgcctgcgatttcgatatcgattacgtctttgaggtcgatgactgcttggaggactttggtatcgaggaacttgccttcgatctggagtctgccgcatatatcgaggagttccgcaagcagcagtttgcacgctcgaaccgcagcatgttgccgctgcccgcggcactcggcgccattcgcctaacgaacgttgaggacgaggttcttaagcgccatgctcacgcctacttggcttctcgtaaagaacttctctaagatttattgacttccatcctctttcgtatcatgttgaggggcgggtttccaatcggttgcggatcgcatgcgattccgtcgttcggttgagacccgtcccgtctatatagagacaacaagaaaggaatctgcatgtctgagtttgctgccggtcctgccggtcgtatcgagcgtgtccgtgccctgatggccgagcgtggctacgacgccatcgtggtgcgcgacgaggccaatcttcgttggcttacgggcgtgaagggcgttttcgattacacctttgaattcccgcacgcggcgtttattacggccgaccagtgcctgttccataccgactcgcgctacctcaacagctttgaggagaacacgcccgccggcagcccctgggtttacgacatggacgagggtaccatccccggctgggtcgccggcaagattgcggctaacaagtgccgtgtctgtgctgtcgaggacgatatgcagattaacttctaccagggtattcagcgcggcctggaggaccgttccgtcgcctgcatcctaccgctgatgcacgacgacatccgcaagatgcgcgccatcaaggatgccgaggagattgagcttatgcgccatgcgcagtcgatcaccgatgccgctttccagcatatgctcggctttattaagcccggtatgaccgagaagcaggttcgcaacgagctcgagaactttatgttcgccaacggcgccgacagccttgccttcggctccatcgtggcgagcggtcccaacaccgccaacccgcatgccgtgccgagcgatcgcgtgatcgagaagggcgatttcgttctcatggattacggcgcgggctactgcgattaccgctccgacatgacgcgcaccgtcgtgatgggcgagcccacgcaggagcagctcgacctgtacgcgctcgtgcgccgcacgcacgaggagtgcgtcgccgccatccatccgggcgttgagggtaacgacatcttcaagctttccaagaagatcatcggcgatgccggctatggcgattactacaatcatggcctgggccacggcgtcggtatcgacatccacgagctgcccaacttcaaccgcagcaagaacaccatcgcgatcggctcggttgtcaccatggagcccggcgtttacctgcccggcgtgggcggcgtgcgcctggaggattacggcgtggtcaccgagaacggctacgagcctttcaccaagaccccgcacgacctgcacgtcatcgattgctagcccatttcgatagatttttggggcggggcgtccgaatcgattcggacgccccgcgttctctttttatgcgctcgccgcaggcgccgtctgcaagtgtataatttctgtcgtatgtaatttggacgcttgtgcgttctgcccataacaagaaaggtcgctatgcctaccatttctaccgccgacttcaagaacggcctcggtctccgtatcaaggacaaggtctacaccatcgtcgagttccagcatgtcaagccgggcaagggcggcgcgtttgtgcgctacaagacccgcgacatcaagagcggccgcgtcgtcgagaacacctgcaacgccggcaccaagttcgagagcgtcatgctcaccacccgtgagttccagtacctctacaacgatggcaccgactacatcttcatggacaacgagtcctatgagcaggttcccgttcccgaggacatggtgggcgagaactccaagtggctgcgcgagaacgacatctgccagctgctcttcgccgacgatgagctcatgggcgtgaccccgccgatgttcatcgagaccaccatcgtccagaccgacccgggctttaagggcgataccgtccagggttccaccaagccggccacgatcgacaccggcgctgtcatccaggtccccatgtacctcaacgagggcgaggtcatcaaggttgacacccgcgacggcaagttcgtctcccgcgtctagcaaccaactcttctaggaggactcatgccccaggaaatcaagattgacggcatcggcatttcgcccgatgttttgaccgccatcgtctcgcgcgccgtgtcggatgtcgagggcatcgcctccgttggcgtcaaggaccttgccaccaaccttgtctccatgatgctctcgtccaaggccccggcttccgagccggctgtcgaggccgaggtcgttggcgacaagctcgcactcaccgtgcgtgtcgtggtgttctttggctatccgttcaagaaactcgccgaggccgttcgcgctgccgtggtcgctgccatcgatgcccaggttggcgttgaggttgagcgtgttgacgtttgcatcgacggcctcgttttccccaaggagtaacctttgagccttaaggtttatcgcgggcgtacgcttgcccgcagtcaggcgctgcagctgctgttccaggccgaggccacggacagcccgctcgagcgcgtcctcgagggtgatttcctgatctcgaagggtcccctcgacccctatgcgctggagctgtgccgcggtgcctacgagcatatcgaccgcatcgactgcgctctgcgctccgttgccaagaactgggatcttatgcgcatgcccggtgccgaccgcaatctgctgcgtatcgccgtttacgagatgcgtttcctcaccgacgaggaggtctcggacgccatcgtgatcaacgaggccgtcgagcttgccaaggcctatggcaccgaccggtccgcgtcgttcgtcaacggcgtgctgggcaagatcgctcgcagcgaggagctgccgggcgaggacctataccaggagctgctggccgaggatcgcgctcgcgaggaggcacaggctgccgaggctgccgctaaggttgcggttgcccaggctgaggctggtgtgttggccgaggatgcggacgctgctgaggccgtcgaggccgactccgtcgaggagtagccatgccagagggttctgtccgtaactttgatgagatttcggaccgtctggatcagatcatcgctaccgttcgctccaaggatacctccttggagcgttcgctcgatttgtttgacgaagcgattgagctgggctcccgcgcggtcgatatggtcgacaagtttgagttgacgccgcgtgaggccgacaagctcgagcaggaatacgatgaggatgcggcaaacgaatcccaggatagctaggccgcatctccggatacgaatggttgatggcattcatgaaacgcgtgcgtcttgatgacgaactgatttcacagggcatctgcgccgatcgcgcggatgcccttcgcactcttatggccggcttggtctcgagtggcggtgagcgcttgacttcgccgggccttaaggtgatcccggggctgccgctgcatgtgaagaggcgcattccctatgttggccgcggcggtcttaagctcgaaggcgcgcttgatgcgtttggcatcaatccgacgggccttgcctgtctggatgtgggctgctctaccggcggctttaccgattgtctgctcaagcgcggagctgcgaccgttgtctcggtggacgtgggtcgcgcccagttcgattggtcgttgcgccaggacgatcgcgtgacgctgcatgagcgcacaaacgtgacgcagctgcctgagcttggctatgccggcactatcgacctggctgtgtgtgatgtctcgtttaccagcatcgcgaacattatcgatgcggtactggcgtgcctggcgcctacgggtgcattctgcacgctcgtaaagccgcagtttgaggctccggcggcgctggtgggcgagggcggcattgtgaccgatcccgccgtgcgccgcgatacactcgtggcggcggttgaactctttgctgccaagggcctgttcccggtcgatgtgtgcgtgtcgcccattcatggtgccaagggcaacgttgagtttttcctgtacggcacgagatttgaccccggcgatcgctcgcaagacgagctgcaatcccaggtatcggttatgagcgagaaagctgcaacgctatgaaggtctttctggttcccaattactacaagcaagaggcggtcgagagcggcctgatgctcgagctttggctgactcgccagggctatgaggtcgcatgggctgccgaccagcgatccaagattcagagcacgcctgatattgacggctccgatctggtcattacgctcggcggcgacggtacgttgctgcgcgctgcccgcatcctcaaccatcgtgagattcctatcctcggtctttcctatggtcacctgggctttctaactgctgcgagccccgaggagcgcgacatcctgcaggtcgtgagcgacgccctgtccggtgagctgcacgtgagccgtcgcgccaccatcgccgcggatatcgtgtccgtgcgcgaagacggtacgaaggatgtcgtgcgcaccttcgccctcaacgacatggcgcttacccgcggtccgctgtccgatatggtcgagttcgacatcacggtgtccggccatcatatcgaccgtctgcgtggcgacggcgtggtcgtgtccacggcgactggttctacgggttacgcgctcagtgccggtggccccatcgtgagccccgactatacgggcatggtctgcgtacccattgcgccgcacaccattcaggctcgtgcctttttgacctcgccgagtgatgtcgtcgaaatctttatgtccgatgatcgcccgagcgttccggcgatcgctatcgatggacagtttattacctgcgatggcaccgttgagagcgtggcggtgcgccgcgggcccggagatgtgttgctgctggattacggccccgagagcttctataactcggtgagccgcgtattctacggagtccgtcatgatcgatgagctgcaggtttataacattgcactcattcgcgaggcgacgctggtgccgagtgccggcctgactgtcctgactggcgagactggcgccggcaagaccgcgctgctctcggccctcaagctaattttgggcgagcgtgcggattcgtcgacggtgcgcgagggcgaggcactggcgagcgtcgaggcgcgactcttcgacggaccgcacgacacggaggggttcaccgtacagcgcagcctttctgccgagggccgcagccgcgtgaagattgacggtcgcattgccagtgtgcgcgagctttcggagcgcgtcggcgtgatgatggatctgtgcggccagcacgagcaccagcgcttgctcgatccggcgcatcacgttgcgatggtcgatgcctgggcgggacgctctgcgctcgaggcgctcgagcactaccgtgcttgctttaaagcctcgcgcgcggctgccaaggaggtccgtcgcgtcgaggaggcctcacgtgcgcgggggagtcgcgtcgaggaagcgcgctttgcgctcgagcgcatcggcgaggtcgaccccaaaccgggcgagtatgaggaactcgaggaactgctgccgcgctccgaacatgccgaggtactggttgccacagctaacgatgcccatgcatcgcttgcctccgaagggggagcgctcgacgccgtgaacagcgccgtggcagaactttcccgaatggctaccgtcgatcgcaaactgggcgacattgccgatgcgctttcggatgcctgtatctcccttgaggattgcgcgaacgagcttcgtacctatcgcgatggcgtcgccttcgacccgcgcgagctcgcacgcatgcgtgagcgatattccgacctcaagggcctgttgcgtcagtggggtcccaccatggacgatgtttttgccatgcgcgatcgctcgcaagagctgctgtccctggtcgatgatggcgatgagcagatcaaaaaggcgcgtgaggcactcgggagcgccgagcgcgagttgtttgccgctgccaaggcacttaagcgcgcacgcaatacggcggccccgcgcttctgccacgaggttggccgccagatggcgcgcttggagatgggtagtgccgagctcgtctgggagtcgcgcgatcttccccgtgctgagtggacgcccgttggtccttcgagctacgagctgctataccgcagcggtgccggcttgacgccacgtcccctgcgccgcattgcgtcgggcggcgagctcagccgcgtcatgcttgcaagcaaggttgtcctcggtaacgcggacggtgtcgatacgctggtgtttgacgaggtcgatgccggtgtcggtggctccacggcgcgtgcactcgcgggcgtgctggcagatctcgcctctacgcatcaggtgattgtcgtaacccacttggcgcaggtcgccgtcatggccgacaagcattatgttgtcagcaaggaaccaggcgatgttccccagacgcatttggacgaggtaaccggcgaagcgcgtaccgccgagatcgcccgcatgttgagcggcgatcagtccgaggctagcctggcgcacgcaaagcagatgctcgaagaagctcgaggttaggtcgtatcagcggtgttggtgggacaaaatagactgaaatttttgtcccactacgcattttactccacaaccttatccggctggatgagctcttcgtagtagctgatatgctcgcgggcgtcttcgatttcgggcagcaggaagttgtagatgacctcgatgatcatcgtggcgctcatcttggagaacgcgaagtcgcccgttgtcagtagtgcttcgtggttgacggtattaaaggtgtagtctgccaggcgcgcgagcggggatttgctgtcgctgctgatgacgactacggttgcgccgcagtcgcgagccgcttttgccatgcgattcagacggcgcgacttgccggagtttgagatcagcacgataacgtcaccggggcgcagcgtgagcgcaaaaccaatcgaggtctcgctgatggtgcttgccatgcaacgaaggcccagctgcgagaacttgaacgtcgcgtcgagcgcgacggcgttggtgttgcctacggccgcaaactcaataacgccggcattcttaagcgcgtgtacaactgcggccaacgtgtcgtgatcaatgccgtcgatggtcgcattaagctcactcaccttggcggcgaggatatttttaaggctctgctccatgttgtcgagcgagacctcgtcggtcaggccctcgttgcgctgactctctaagtcgcgcgccaacgaaaactgaaagctgcggaagctgccaaagcccagcttgcggcagaaacgcgaaacggtcgcctcggacgtggcggcagcgcgcgagagctgagccgccgtgaggcgtggcgcctcggactggtgctccaatatatagtcgacaatgcgctgctcggactcgctgtatccctggtgggtactaatgagggaaagtgcgcttttgctactatcggtcatggatggctcctggttggcatgaaaatctaacttgatttgcaatgccatagtatacgggcattttcaattacaagatacaccttgccgtttcaagtgttgatggtaaactttcacttgccgtttacggttatgaaagaacctttcaccggagaattgcgccttgtctcttctcacgcggacggtaggttggtatctttcagttgtggaaaaacgcgcatcgaagcgcgtgtaggggagcgcccgcgggcgctgtactcaagaaggagggacacatggctaagtttgacatcatcgccgcgaccggttgcccgaccggcattgcgcacaccttcatggcgaaggaggcgctggagaaggcagctgccgagcgcggtctgaccattaaggtcgagactcatggccaggtcggtgtcgagaacgagctcaccaagagcgagatcgccggtgccaaggccgtcgtcgtcgcagccgataaggatgtccaggctgagcgtttcgccggtaagcccatggtttccgttggtgtttccaaggccttgtctgtcgagactgctggtaagctgatcgaccgcgcgctcgccgccaagggcgacgacacggttgccgctgccgccgatgtcgaggacgaggtcgaggagaaggagtccatcggccacgtcatctacaagcacctcatgaacggcgtcagccacatgctggtcttcgtcgttgccggtggtgttctgaccgccatttcgttcctgtggggcatcacgtcctttgattcgacggctgccgactacaacagctttgctgcgatgctcaagatcatcggcggcatcgccatgaaccttatggttccggtgctttccgcctacatcgccgaatccatcggcaagcgcccggcgctcgtccccggtttcgttgccggtatgattgccatccagggcctgcctgttaacgccgagaccggcatgatcgacgccggtggcgccggcgtgggcttcggcttcctgggcggcatcgtcggcggcttccttgctggctatgtcatcctgctgctcgagaaggttttctctaaaattcccgcgagccttaatggcctgaaggcaatctttctgtatccgctgtgctctaccgccatcgtcggcctggtcatgctcggtatttccggccccatggctgccattaaccagggtatgatggatttcctgcagagcctcggtaactccggtccggtgatccttggcctggccatcggctgcatgtgcgcctttgatatgggcggcccggtcaacaaggctgcttacgctactggcaccttcctgctcggtaccgctctcgaagctggcgtcggcaccgagacctacaacttcggcaccaacttcatggctgccgtctccgccgcttgcatcgttccgccgctgatcaccaccttcgccgtcgttgtcggcaagaagtacttcagccaggaggatcatgacgccggtatcgtcaacctcatccttggttgcacccacatcaccgagggcgccattccgttcatgaccaagaacatctggcccgtcatgcccatcatgatgctcggttcttccatcgcttccatcttgaccatcttcttcaacgttcacgatccggcgcctcacggcggcttcctggtcctgcccgttgtcgagaacggtccgctgtgggtcctcgcgatcctcatcggcgctgtggtcggtggcatcctgttcgtggccttcaagaagtacgatttcgagaagaatcagaaggccgctcctgtagccaggtccgttgaggcccccaaggccgctgccgtcgaggcccccaaggccgaggctgccgacttcgtgaaggtcgagaatgtctttgtcgccgaggacttcgcttctcgtgacgaggctctgagcttcgtttccaaccaggctgtcaaggccggtatcgccagcgacgccgacgccgtgatgaacgccttcctggcccgcgaggccgagggcaccacgggcatgatggagggcttcgccatcccgcatgccaagtccgacgccattaccgaggctgccgtcatcgtcgtcaaggacgagtccggtgtgaccggttgggacaccatggacggcgctcccgtcaacgtggccatcgcgctgctcatcccgggtgcccaggccggcaccacgcaccttaagatcctgtccaaggtcgccgaggcgctcatggacgaggacttccgtgccaccgtcaagggttccaccgacgccgccgagatcgccaagacgatcaacgcccgcctggtctaatcccccagcccgcgaataacatcgccccctgtatataaggcggagtccctccccagggcctccgccttttttctatccctcccataagttgcggtgaaatagggactgtttaaacgattcaaccccaaattcagtccctatttcaccgcaacttacaaaagggcatagagggggctacctatcgagtctttgtcgcgaacagatcattagccagaattccgttcgcacgatattgctctggaccgaccgagtttctgcagcttgctcgcccacagggggccgggcgcggcctgtgagatttatcgcgagttccgcacgagccgaagagcacttaatgtgctcttcgtgcgagcaggactgtagagcaggaaatctcacaggccgcgcacgggcccctgtgggcgagcaagcggacgacaaacacatctgtccaacaattcgtccgaaacataatgaaaaaccgtttgatgtgagttaatataaacaacgtcgtgaatctgactcctgccacatacatgacaggggttaaacacaaaaaaggagtcaactatggtttctgagaaggctaccctcgttaatcctcagggtctgcacatgcgtccggctggtctgttcgcctccaccatgggcaagtacgcctgtgacgtgacggtcgtcacccccgagaaggaggtcaacggcaagtccccgatggccctcatggctgctggtatcccctgcggcaccgaggtcgaggtcaagtgtgacggcgctgacgaggccgaggctctggctgctgccatcgagctcatcaagagcggtcttggcgagtagaactcaaacgggtcgcatgttgaacaactaagttatatttgggggcgcagtgacctgttgtaaggtaactgcgctcttttgtcatggatatggcaaaacgctttatcacatgacacggagagaggaatgggaatgtatcagggagtcaacgcttccgagggcatcggtatcggcaccgtcatggtcgccgtcgatcccgacttgacgtttgagccgcatgaggttgctgattcggcagcagagaaggagcgctatcagtccgctctttcggtcttctgcgagaagacccaggctcaggccgaccacatgaaggagacggtgggcgaggccgaggccgagatcatgagcggacacattgtcctggctcaggacccgggtatgaccgacgccatcaacgccgccattgacggcggtacctgcgccgagcaggcgctcatggacacctcgaccatgttcgagaacatgttcctgtccatggacgacgagatgttccgtctgcgcgcggccgacatcgccgacatccgcaccggtattctggccgagctgctgggcaaggaggtcgtcgacctctccgtcctgcccgagaacactgtcgttgtcgtgcacgacctcacgccgtccatgaccgccacgatcgataaggcccacgttgccggtatcgtcaccgagaccggtggccgcacgtcgcactccgcgatcattgcgcgagccctcgagatcccggctgtcctttcggtctccaacagctgcaccgcactgcgcaacggcatgaccgttgtcgtcgacggcggcaagggtatcgtcgaggccgatcccgacgaggagacgctcgctgcctacaccgccaaggccgaggccttcgctgccgagaaggcagccctcgaggccttccgtggcaagccgtccgtgactgctgatggcatcaagaagatcatcgcctgcaacatcggtaaccccgatgacgtgcccaacgcgctcgatcacgacgccgaggctatcggtctgttccgctccgagttcctgttcatggactctgctgagcttccttccgaggaggagcagttcaacgcctaccgtaaggtcgccagcgcgctcaagggtgctccggtcatcatccgcacgctcgatgtgggtggcgacaaggagattccgtatctgcatatggtcaaggaagacaaccccttcatgggcttccgcgccgtgcgttactgcttggccaatcccgaccagtacaaggtccagctccgcgctctgctgcgcgctagcgccttcggtgacgtcaagatcatgatcccgctcgtcacctgcgtcgaggaggtcttggctgtcaaggagctcgtcgagcagtgcaaggccgagctgaccgaagaggggcgcaagttcaacgagaacatcgaggtcggcatcatggtcgagacgcccgccgcttcgctgctcgcagaccgtcttgccgaggtcgccgacttcttctccatcggcaccaacgacctgatcggctacaccatgtgcgccgaccgtggcaacgacaccatctccaacctgtaccaggtttactatcccgccgtgctccgctcgctcaagaacatcatcgagagcggcgtgaaggccggcatcatggtcggtatgtgcggcgaggccgctgccgatccgctgctcgagccgctgctgatcagctggggcctggaggagttctcgatgagtgctccgtcgatcctgcgcgcccgtaagaccatcagtcagtggaccaaggccgagtgcgacgagctcgccgagaaggcgctcgcctgcaacaccgccgccgaggtcaaggcactgctcgagtccgcagctcgctaatttggtatcagaggtaaccgcgtggttggaatgggccggccacgcggccctcacatatacagggggtactgtaaatgttctacacgctaaccgctaacccggctgtcgacatgacggtttcgagctctccgctcgagcccgacgagaacgtccgcaccggttcggccagctacacggctaacggcaagggcctcgacgtgtccttcgcctttaagaagatgggcgtcgacaccgtcgcgctcggcttcttcgctggcttcacgggcaagttcatcgtcgaggaggtcatgaacctgggttgcctctgccgcccggtctggaccgacggtatcacgcgcattaacacctacgtcaacgatggccagcacgagtacggcatcctgaaccccggcgccccgatcacgccgcagcaccaggaggagctctacaacatcctggacaccgcgggcgatctcgagtgcctgatcgtctccggctccgtgcctcccaaagctacgcccgacttcctggctcaggtcatggagcacgctcaggctcgtggcgctgacgtcgtcctggacctgtcctccgacaagctcaaggagctcgctcacaagaagccgctgctcatcaagccgaaccatcacgagatgaaggccatcttcggcgtgccggtcgacaccgacgacgaggttcgtgtcgccatgaagatggctcacgacgctggcgttcagaacgtgctgctcacccgtggtagccgcggcgacgcttacttctccaacggcgaggacatctggtacgccaagcgtgagttcaacatcaagctggtctcttccgtctgcgccggcgactgcaccctcgctgcgttcctgcacaagtggtacagggatcgcgacaacgtcgaggaggccatgaagctcgctatggccaccggcgccaacgttgccgagtccgtcggcattggcgactttggtcacgttgacgagtacagcaagcgcgttgctgtccgcaagctcgatcgtcagtaatcgaaacgcgacatattcgtgcgcatgcggcgccccggtttcggccagggcgcctttttgttccgtcataggggagagatgtcctgccgtacttcatcgcttccacaccgttcaccgagttgtcctagccttttaccgatgcgtggaatatactttcattaacacgttgcttcgtgaaaggaacattcatgatatacacgctcactgcaaatcccgccattgactacaacatcgcctgcgacggtcttgctgccaacaccgtcacgcgtacccgcaatgccgtctacacgcccaacggcaagggcctcaacgtctcgtttacgcttgaccactatggtgtcgacaccacgatcctgggtttcttcgccggcttctcgggtgagtttatcgttaagggcgccgaggccctgggcgtgcccgtcaagcccgtgtggaccgacggtattacgcgcgtcaatgtgttcctcaacgccggtcccgacaccgagtacaacatggtcaatgccggtgccgccatcaatgaggccaacgagcaggagatgtttgaacttatcgattcgctcgatgacatgacctgcctggtcatcagcggctcgctgcctcccaacacttccgagggcttcttggccgaggtcctgcgtcgcgtgaaggcaaagggcgccgagttcgtgctcgatatctcgagccatcagctggcagacctcattgctctggagccactgctgatcaagcccaatgacgacgagctgcttgacatctttggcatcaaggtgagcggtggtggcgacgagtccgtcaagggcgctatggccgagctgcacgccaagggcgccaagaacgtgctgctgacccttggtggcgccggtgcgtacttctccaacggcgagcatatctggtttgccaaccgcaccttcgacgtcaagctgctgtcgactgtgtgcgccggcgattcctcgctcgctgccttcctgtccgtgtggcacgacgcccccgagcgcgtcgaggacgccctgcgcctttcgatggccactggcgccaacgtggtcgagtgccccggtctgggtgattttgccaaggtggacgaatataagaagcacatcgaggttcgccaggtctgctagttccggcaccttgtctgaatagtttgattatttcgcatccgtcttagactaggacggatgcgtttttgtttatcggacttgcgtgtgcagtggaggctgtttcttgctagactttttgcagacgcaatcgatagccaatttgatagtcgcaggaggccataggcatgtgcaatgtttcgctcaacggtactcaaccgtccgatgcgtccctgcgcgtcctgcgcgcgcttgaggcggctggtcttgaggcttggtacgtgggcggttgggtgcgcgacgccctgatggggtaccccagccacgatgttgatatgtgctgtagcggcctgtggcaggagtccaaagcggcgctcgaggccgccggcatcgcggttgtggagtcgggcattaaatttggcggaatcacggctatttccgatggcgagcgtatcgaggtcaccacgtaccgtctggatggcttttacaccgatggtcgtcatccccagagtgtggagcgtgccgcctcgctcgaggacgatctggtgcgccgcgactttaccgtcaatgccatggcctggcatcccgagcgcgggcttgtcgaccgctacgacggccagggtgacttggagcgcaagctgattcgcgctgtcggcgatcccaagcgtcgctttaacgaggacgccctgcgcatgctgcgtgcggtgcgctttgcctgccgtctggactttatgattgagcccgagaccaagcgtgcgcttgccgagtgcgcgccgctgctcgatgccgtggcgcgtgagcgtgtgggtattgagctcgagggcattctttcgaccggtcatgggggagacgcgatgctccgctatcccgagctcatctgcgccgccgtgcccgagttggcagcgggtcgcgggtttgatcagcgcagtgtctatcatgcgtttaacgtctacgtgcatattgcccgtgtgctgacggtggcgggggagctcgcgctgtgtgacggcgtcgcgccctcgtcgagccttatgtgggcggcgtttttgcacgatgtgtccaagcccgagtgcttcacggtcgaccatgccggtagcggacacttctacggtcaccccgagctcggcgccaagaaggcgcgcgtcattatggatcgcctggcgctctcgcacgacttggtgcgcgacgtgtgcctgctcatcaaataccatgacaagccgctgcgccccgagcgctcctgtctgctcaatatgatgcgcgcgctttcgggtgagggcgtcgacacggcccgcctgattgacgagctcatggaccttaagcgtgccgacacacttggcaaggccccgtcgtgcttctattacgttgagacgattgaggagatgcgcgcgatggcgcacgagctgctgaaggcaggggagccctatacgctcaagatgctctccatcaacggcggcgacctgatccgtgccggagtcaagcccgggccggaactgggtcagcttctcaactccgccctcgacgccgtgatcgaagacaacattcccaacgatcgcgaagctcttttggtccatctcaacttgaattagctacccagtttacctgcgtgttccataacctgccgacaattttttggcaatttggaatttcttcttgcgctgacgttttttgtcccgtaatatatttcttcgcagcacggcagtgcagatgtcatgtggcccgttcgtctagcggtttaggacgccgccctctcaaggcggagatcaccaggatggtgtcgacgtcaatggtatacgggtgcatcatcgacgtcttcaatacagaaaatatcagtgcggagtgttctgaaaactaagcccggcccccgcctgcggtgacgctgctgcaagcgatctgcgatggggccgttgttggttggggccgctgggctgatgtgagggcacgtggccgctgcgggccctggtcccggcggtggcctcggcgctttgcgcctgctgcctgcggggactttggggtcgattggggttgtctgcacaattcgcggtattatgttgcggagttttgaaaggagccgctggtggtcacgacgacgtttgcttcgcctttgggcgaaatcttgcttgccgctgatggccgcggtctgacggggctttggtttgagggacaggagcattttggctccacgcttctcaaagaagatcctgaacatgttgaaggcgccgatgcagtttctggtgctggcggcatgtcgtcggtgagtcctgcaaatggtgcggcgtcttcggtgcttgagcgttcctgggcttggctgaatgcttattttgcagggcaggaacctcggtttacgccgccgttgcatatgatcggtacggcgtttcagcgtgaagtttggtacgagctgctttccattccgcgcggcgaggttgccacgtatggcgagatcgcccagcgtgttgcggctcgacatcgtgtaccgggaaacgaggcgcccgttgtgtccccccgtgccgtgggggctgcggtcgcgcgtaaccctgtttcgattattgtgccgtgccatcgcgtggttgccgccgacgggtcgctcaacggatatgccggcggcctcgaccgtaaggagtggctgctccggcttgagggcgcgtacgaggagtagcgttcgagtgctttgcctgtagtagccgacttcgaccaaagctcgctcgagttcgctttgatcagagcacttaagacccttgttttctgtcaatagtgctatttgttcgttgatggatatccgcgacttctggtatttcattaagcctcttgatagaaaaagagctggagttgcgcatcgttgagaggctttccagctttagcaaaacaaacttataagatgcgacgggccgcgtcaagataattgcttgacagcctaggaggcggctggttggctggcttaaaacccagcgcgtgaaatgacgctccacgctattcagcgcgcttgataggatgacgaaccacagtcttaagtttctccggcgcacacttgcgtggatcggaaagatagatttcgtgatgtaaacgggtgtctgagaagtcggggacatagccctgctcggtcgcatattcatgcatggcgtctacggttgccggctcgctgtcgtagggtccggtatgcatgcattgaacgcagagaccctcgtcaactttaagcagctcgacggcagaaaagtccagtttctttttggccgtggcttccgcgaccgcccagtcaaagtcatcctgagtgacgaaatcgggcaggcggatgcacgagataaagttgaaatcgtccttgcgtacataatcgatgtcgccgctcggggagtcttgccaccagaagccctcgagcggcggtaccacaaagtcgaaatagccctcgatactccttgagcctttcttcgacatcttgacggtataggcgatgccgtaaagcagcggcagggcgttttgatactcgccaccttcggtatttgggtcgccctttccgcgaacggcaacgtagctcataggcgggacagttacgatgctcggcttgcttgcaggtttgtagagctccttgcattccttcttaaagtcgaacgccatgttggccgcctttctgcgtattggcctgcttagataacggaatcatatcatagaaacgaacagctgttcgaatgattttgctgacagatagagatgcgtgcgttgtgtttggcggtcggcctgacccaatcgatgatttctctgcctccccggcgcctcatctatagctgccgtttctccatataaaacctgccaaaatgaacctgtccctttttggtcggtgcgaaatgggtaatactaaagagttatccgaccagatgggaaccgatcgatggcttatatcgaattcaaagacgtcatcaaggcatacggcgagggcgacgcccgcattcacgcactcgacggcgcgagttttacggtcgagcgcggcgagctcgccatcattttgggtgcttcgggtgccggcaagaccacggcgctcaacattctgggcggcatggatacggcgacttccggtaccgtgacggtggacgggcgcgatgtgagctccgctaacgaggcgcagctcgtggaataccgccgcgccgacgttggctttgtcttccagttctacaatctggtccccaacctgacggcgctcgaaaatgttgagcttgcggcgcaaatctgccccgattcgctcgatgccgagcaaacgcttcgtcaggttggcctgggcgagcgcctgggcaactttcccgcgcaactttcgggcggcgagcagcagcgcgtgtccatcgcccgcgcactggcaaagaaccccaagctgcttctgtgcgacgagcccacgggcgcgctcgactataaaaccggtaagcagatcttgcagctgctgcaggatacctgccgcaagcagggcattacggtcatcatcatcacgcacaattccgcgctcgcgcccatggccgatcgcctgattcgctttaagagtggtcgcgtggagagcgagacggtccagcaaaatcccgtgcctatcgagacgatcgagtggtagcgcccatggaccaggaccgccaaaacagcctacgccgcgacgcacagaacacggagcgcgagcaggattttacgacctaccgcactgcccaaagctcaaacgatatggtgccgacggtttttcgccgtggcatctaccgcacaatccgaggcagtcttaagcgcttcttgtcaatcgtggtcatcaccgcgcttggcgtgagcgtgatgtgcggccttaaggcgggttgcgaggacctgtgcgattcggttgacgcctacttcgaccagcaaaatgtctatgacattaacgtgcagtcgacctatggcctgaccgacgatgatctcgccgccatccaagaggtcgatggtgtcgagacggccgagggcatctacaccgagaccgcctacaccgccgtgggtacaacgcgcgagcgtgtcgtcgtacagagcctctccaaggagaacatcgatcagccagtgctcgtgaacggcgatttgcccgagagcgccgatgaggtcgcggtgacttcgaagttcctgaaggcttcgggtaaaaagctcggcgatacggtgagctttgctgccaacgatgcgagctcgtcgaaccaaagcgccaaggatcagtttgccgcaggcgagtacaccatcacggccgaggttctcgatcccactgatgtgagctccgactcgacagtcaacgcctttcgcgctgcttcggccgcggactacaagttctatgtgagcgaggacgccgcgacatcttcttcctactctgcggtccacgtgatcgtcgagggagccaagagcctcaactcctattcggatgcctacgcggcaaagatcaacaaggccaagggcaatatcgagaagatccgcgaggagcgtgagaaggcgcgcgctcaggagctgacagtcgacacgccggcaagcttagatgcggctgagcgccagacgaatatgctctttgggattgaacagggcaacatcaaccgcatggcagagggcagcgacgagcgtgcgcaggcgcaagccgacctggaccagcgccgtgccgccgccgaccagcagtttgccgatgcccgcgccgagctctctgacctgggcgaatgcacctggtacatccaggaccgcggcaatatcgcaagctactcgagcgtggagagcgatagctcgtcaattgaggccatcgccacggtgtttccgttcatcttctttatcgtcgccgtgctcatcagcctcaccaccgccacgcgtatggtcgaggaggagcgcacgcttattggcctgtacaaagcgctcggctattcgcgcgggcgtattctgtccaaatacgtggactatgcgctgtgggcttgtctgatcggcggcgtgctcggcaacatcatcggatttgtgggcctgccgctgttcctgtttacggtgttcgacgacatgtactcactgccccagatgctgctttcgtacgacatcgtgtcgtcgctcgtgtcggtggcgctgtttgccgtgggcgtggtgggcgccacgattatcgcctgccgccacgagatggccgagaccccggcctcgcttatgcgtcccaaggccccgcgcgctggctcgcgcatcttgctcgagcgcatcggctttatctggcgccgcatgggctttttgaacaaggtcgctgcacgcaaccttttccgctataaaaagcgcgcctttatgaccatctttggcatcgcgggttgcaccgcgcttgtgatctgcggtatgggtattcgcgacacgtcggtcgcgctttcgcccaagcagtatgggcatatcacgcgctatgacttgctggcggtcgccaaccccgatgactttacgcagacgtgcgcggcgttggatgagcgcagcgcggccaatgattccaacgtgaccgtaacttcgacgctgccgatcatgactgacaacgttacctttacgtttggcggcaagagcgagaccgtgcagctgatcgtggtgcccgatgaccgcatgaacgatctggacgactacgtgtgcctcgaggacgagtccaaagagccgctatccttgcgtgacggagatgtgtacctgagcaagagttcacagctggtgctggggattcaaccgggcgatacggcgcacgtccaggattcgtcgctcaacgtagccaaggtcaaagtcagcgacatttcgctcaactatctgggcaacacgctttacatgacgcagggcacctatgagcgcgcgttcggccgaagcgcgcgtcttaacggcatctttgtgctgcttaagggttcatcttctgaccagattgcgtttagcaagaagcttaaaagcgacggttggctcaccatctcgagcacggccgaacattgggaaaactatgaggcgaactttactatcatcaattccgtcgtggtgctcgtgacctttatggcggcgtgcctgtcgtttgtggtggtgtttacgctgtccaacacgaatatctccgagcgcgagcgcgagctggcgaccatcaaggtgctgggcttccgccgtggcgaggtgcaccactacgtcaacaaggagacgttgatcctcacggcgattggcaccgcactgggcgtgccgctgggtggcctgcttgccgagagctttacgtacatcctgcagatgccgtcgctgtactttgacgttgaggtcgagccgctgagctatgtgcttgccgtggtgctgtccttcggctttacgattatcgtcaacctcgccaccaaccgaacgctcaacaagatcgacatggtcggcgccctcaagagcgccgagtaacctgtcctgggattcaagttctagcgagctgccgacgcgcccgcagcagcatttttgcataaactgccccgccaaatgcatactttgacagggcggttgctttttgcccacaggtacccccgggggcgccgtgcaaatttcggagtattcagcgtcccggggtccgcgggcgcgggggcggggggtgcaaaactgcgctgaaagccccgattctgagtcccaacgcctctagagccgctcgttttttacaggatgcggcccatggtgcctgcctttcgcccaaaatccagtatgcaggcaccctcggctgctgaatactcccaaaaatgcacgccgcatcctaccccaggcacccgtagcaagaagacgaatagcctcggcctccctagttaccgcaggaggccccagggcttacctcccaaatctttccgcaggacggaaggaccccgccgcgcgaagcgcacggcggggtcctgacatgtccgaggacgatttgggaggtaagccctggggcctccgatggggcggttccagccgagactattcgtcgccgaagctgatgcccagcgccttggcctcgcgtaccaggtcgctctgggggtcgacaaacttgagcttgccggcgacatcctcgagcggcatgtggcacatcttgccgtcgcgcagggcaatcatgtagccaaactcgccgcgtaggcagccgagagccgcctcgacgccgcactgggtcgcaaagatgcggtcctgggcgtcgggctgaccgccgcgctgcgtgtgaccggggatggcgacgcgggtctcgcgaccggtcttggcctcgatctccttggcgatgtcgtacacgattgacgggctcgtgcgctcggcgagtttcttcttgtactccttcttggacagcgccgcgtcctccttggagatagcgccctcggcgacggccacgatggtaaagcggctgccggtctccatgcgatgctcgatggtcttgatgacctggtccatgtcgtaggggatctcgggaatcaagatgacatccgcaccgcccgcgacgccggcatacagcgggatccagccgaccttatggcccatgatctcgatgacgaacacgcggccgtggctcgaggcggtagtgtggatgtcgtcgatgcacttggtggcgacgtcgatggcgctcgtaaagccaaacgtcatctcggtgccccaggtgtcgttatcgatggtcttgggcagggcgataacgttgaggccctcttcgcgcaggcggttggcggtcttggtggagccgttgccgcccagcataaacaggcagtcgagctgcaacttgtgataggtgtggaccatcgcgggcaccttctcgacgccgtcggcctcgggaatgttcaggcgcttaaacggcgtgcggctcgtgcccagaatagtgccgccgcgggtgaggatgccgctaaaatcggcgggtgtcatgacacggaacctgctgtagataaggccctgatatccgtcctcaaagccataaatctcgataggctctttgctattggtcataagcgttttgacaatgccgcgcatggtggcgttgagcgcctggcagtcgccgccactagtaagaagaccgatcctaagcatggtgaatccttccgggcaagttataacatgcgcataagtttacccccgcacactgttgatgcgggggtaaaacgtgttagctcaagcgtatggaaatgtaagcaacgtcaggcgagcgtaaggtcgacgggcctggctccttacagtgcgaaggcatcgacgttgccccagtgacggcgcagcgtgatggcggcagcgggctcggtattgtcaaagacgaccgaccactgcgtgttgctggtgatgtcttccggattgggctcttgcgccgcagcgcgcagggccttccaaacgactgtctcgtcctgggcaccgacatgggcgtcaaggacatcggcgattgcgacggcgcgctctttaccatggcccagctcgccattcttttggttgggcagcacttcgtcgccatagcaggcgtagaagttcgtaacctggcgtacaggagtcgctttgaaagcgcggtccggatcgcgcggatcccactctactacgcgcgcgtcaccggcggcgtcgttgataaagaagtggtaatcgcgtcctgccatggcgtgcatgtcgtaggcggaaagcagatcgacagcttcttgcgtggtggcggcacggtcgagcaccaggcggatggcgagcgaggtattgatgacggggcgttgcgtgtcctggtcacagggctgggaatccagggtgagtacggcaatggacacgccgcattcgttaacaccgtcgagctgggcaaatgggcccatgagtgcggcggcccgtccggcgacggagtcaagcggagtgttatcgcccaggttgttaagggcggcaaacccgatggaggcatagccgccgcgtgggtgattgcgcaccagcagcgctgaggtgtcgtccttaaagtcgtaattgcgaccggtgcgcacgcggccttcggcatctacggcgacaaaagcgctgcaggcaaactggggcgcctggacatgtaccggcacaccgggcagcacctgcgccaccacggcatcgatgtaggcctggtcgtcgcgcacgccagcggcgatgatgcgatcaagatcgtagtcgtaggcgatgtcgattgcgtacaggtcatagccatccgcgtagccggtcaagcgtttgagcgacgcggcggacttgatttgcttgtgataaacgataccggtggcagcggcaaggccgacggcgactcccgcgacaccgcaggcgatggcaatgttacgtggcttcatggcggctcctctcgtcctgttagcgtaattgtcgcaaaaggtgcacgggcatgatggctcaacttggtgaacggtgcgggattaaacacggaatgaagagtgcagcgctggcgcggcggggtatgctggaagggaccatcaacccagcgaaaggggagagcatgacggatcaggaaacgcccgagcgcgcgcatgtgacggccgatgatatcgaggccgccaacgaccttatcgactttatcgaggcatgccccagcatgttccatacggcggcgaccattatggccgagctcgacgaggcgggctttacctacctgtccgagaacgcggcgtgggacatcgagccgggcgggcgttattacacgcagcgcaacacctcgagcgttatcgcctttaaggtgggcgaggacctggctgctacgtggggcgaggacggcgttgccggcgactaccattttcagctgacggcgtcgcacagcgactcgccgacgtttaaggttaaggccgtgcccgagctcgacggcgcgggcgagacgctgcgcctgaacaccgaggcctacggcggcatgatcgactacacctggttcgaccgtccgctggcactcgcgggccgcgtgctggtacgcgagggcgaccgtattgagagccgcctgcttgccaccgagcgcgaggtcgctattatcccgagccttgccatccacatgaaccgcggcgttaacgagggctttgctcccaaccgagccgtcgacctgtgcccgcttatcagcgccggcgaactcaagcagggagattttgatgccctgattgccgaagagctggacgttgagcccgagcaaattctgggccgcgatttgttcctggtcaaccgccaggatgcgcgcatttggggctgggccgacgagtttatctcgacgcccaagctcgacgacctggcctgcgcctatacctcgctgcaggcatttttgggtgccgagaacgcgcacgacgtttcggtcttttgctgctttgataatgaggaggttggctccgagaccaagcagggcgccatgtcgacgttcttggccgacgcgctgcgccgcattaacggatcgctgggctttgacgacgagtcgtatcatcgcgcccttgccgcatcgatgctcgtgagctgcgacaacgcgcatgccgtgcaccccaaccacgccgagaagtgcgacgcccgcagccaggtggtgctcaacggcggtatcgtcatcaaggaggcagccaaccagcactattgtaccgatgcctttagccgcgcggtgttccaagctatttgcgatgacgccgacgtgcccacgcaggccttcgccaacaagagcgatatggccggcggatccacgctcggcaatctgtccaatatgcaggcgagcatgcatgccgtggacgtgggcctgccgcagctggccatgcactcgagctacgagaccggcggcgtgcgcgacgtcatgtacgccatccgcgccctcacagccttctacgagcgaaacctaaccatcaacggtgccgaaagcgtggagctctaaaacctgctaaaagggacaggtttattatgcaggttttatctgggcaaatgccgcaaagccaacagctggacagaattgttatgacaccgcaggttgagcaagcgtcagcgagcgatgtccagagcgaacaagttggcatgaaaaaggcaaggcatagaccttctggtcatgccttgccttttgaatgacaaattgtcgctctgggcggcgcgcagcgtcgaccggtccgccgttcgttagaacggcggaaccctaatgttcgatccaacaacgtaaagtttcgccggcttgcaggtgacgcaggttctccgcggcgatgtcgaccacattgttgagcgtggctgccaggtggaaccagccggagacgtgtggcgtgatgagcatgttgggcgcattccacagtgggcttgtctcaggcagcggttcggggtcggtgacgtcgaccgcggcgccggcgagatgtcccgactccagagcggcaaccaaatcgtcggcaaccacaagatcgccgcggccgccgttggcaaagaaggcgcccggtttcatcgcggcgaagaactcggcgttcgccagaccgcgcgtctcgggcgtgctgggcataaaggacgtgacgatgtcagcctcggccaggcgctcggggagggcgtccatgccgtccatgtcctcaaacacaatggggtagacgagtggatggcgcttgatgccgcggacgtgcgcgcccatgttgcggcagagtgtggcgaagtggccgccgatatcgcccgcgcctagcaccagcacattggcgttcttgagcgaggtgaccggccccaaatcctcccagcgatgctcgcgctgcaagtcgtgatagccgggcaggcgcttcatcatagaaaggaccatggcaaacatatgctcgcttacggcctggccgtaggcgcccaccgagcaggaaagcttagcgtcggctggcacggtgccggcggccaagtagtcgtcatagccggcggtctgcaattgtaacagctggagatgctcgcatgccgtgagcatgccagggtcgatgttgcccaagatcacgtcggcatcggcgatctgctcgcgcgtggcggcgtcggagctcgtgtagataaagtcctcgcccggagcgctcgactcaagaattgcgcgatggcggtcattgacgggcagcaaaaccaggatgttcacaagcagtcctctccgctcgacctgccaaaaagggacaggtttattttggcaggttttatcaggcaaaacgtttaaataaaacgccggatgcaagacgagcgtgcccgtcagcatccggcgcatccacggctaccagctcagcagctcgtagccgtcctcggtcaccacgagctgtacctcgcactgggccgaatcgctgccgtccttggtgcgcacgcaccagccgtcacccttgctgatcttgatgtcgggcgctccggcgttgaccatgggctcgatggtaaagaccatgcccggagccatgatggtgtccacatcgggtgcctcggtggtaaagcccacaaacgggtcctcgtggaactccttaccgatgccgtgtccgccgtactcgcgtaccacactaaagccggcgtcctcgaccgtcttttgcacggcctcggccatcacggacagcggcagccacggcttgacggcagccagacccgcctccacgctggcgcgggtgacgtcgaccaggcgctggcgctcggcagagacctcgccgatgcagaacatgcggctcgaatcactaaagtagccgtcaagaatcgtggagcagtcgacgttgatgatgtcgccctcgtgcagcacgtccgtatcgcaggggatgccgtgacagaccacgtcgttgatcgaggtgcaaacgctcttggggtagccctcatagttgaggtcggccggcgtgccgccgtgctcgacggtgtagtcgtagatcatctggtcgatctggttggtggtcatgcccgcggcgatgtgttcgcctgcgtaatcgagcacgcccacgttgatggcggccgagcgcttgatgccctcgatatcggcgggcgccttgtagagcgtgcggggcaaaacctcccagccctcttcccacaggcgctcaaggcgctcatcaaaggcgctatggcatttcttatattttttgccgctgccgcaccagcaagcgtcgttgcggccgggcacgggtccattgtcaaacatggctaacttcctttcattcgcagctagtatagcccactcacagggcagctgcgcgctagtagctcacctggcagggaatgccgagggcgcgcacgcgcgcggcgatggcgtcgagggcctcgggcgctgctttggcaaggccggcgaccggcgtctcgcgagccaccgtgtagatggtcgcttcttgtgggcgaatgcgctcaagtgccgcgagccagggggcaacgtactcctcgccggtgttatcgagagacttgccccggtactcaccgctcaaaaacatcgtctggataataacgtgaccgtcaaagcttgcgaacgtctcgatctggtgctcgacgtcgtaggggccaacaggctggtcgagcagctggataaacgccgggtcgaccgtatcgagcttgaggatgttgtcgtcgaccatcatgagcgcattgtgtacctcggggcggtcggcgcgcgtgccgttggagagcacggcaatcttggagtttggggccagctggtcgcgaagcgcgacggcaccggcgatggcctgcggaaactccggtgcgacggtgggctcgccgttgcctgcgaaggtgatcacatcggggagctcgccctcggctgccatatcgcgcagctttgcctcgagcgcgtcgagtaccacggcagctgtgttgtacggctcgtgacaggggcgctcggcgttgaggccgttttcgcagtaaatgcagtcgaacgtgcagattttgccgctggccggcatcatgttgacgccgagcgagagaccaaggcgacggctgcgaacgggcccaaagatggggctggcattcaaaaacgtagacataggcatatgctcctcaagacaattgtgcctaagcatagcatcggctccaaagcagggtgcgggctcttgctttacaagtttcgttttttcacgtcgctcattatgccgtgtcatgaaaagcctcgggtcgggtaaagttaatctgttaacaaggcgtaaagaaatgcgggtctatccagccgtactgacgcgcaactggatgggcgttgatgatgggggcacaacatggattttacggtcgagaatgcgggcaccacgattgcctgtcgcgaatatgccggcccggatgtgtcgcctgatactcctgccttggtgtgcgtgcacggcgcttgtgtcgacggcacatttttcgacggcattgcatgtgagctcagtcacaactaccgcgtaattgcctacgaccgccgcggctgtggcggcagcagcgaagcggcagacggcagctatgatcttgccgctcaggccgccgacctgcaggccgtgatcgaacacgttggcgctccgacaaatgtgcttgcgcacagcgccggtacgttggtggcgctggagcttcttcgcatcgaaccccatctcgtcgcccgtgcgattctgcatgagccggctgtgtcggccgaaggcgtcggcatgggcgcggctccgattttgctcgatatgattgcggctggaaaggtttcaagggcgcttcggcttttcttgggagctctcggcgacttggaccccgaggctcctgggacgaccgaagcggaagccaagcatgccctgcgcaatggtcgttgctttatggccaatgaatacggaacaaatatgacatatgctcccgactgggagcgcgcccgagaatcaaaggcggtgtcggctgtgtttttgggcgagctttcggtcggtacaccccgcgaggctggcacgcgagcggctgccgaatatctcgattgcccccttgtgacgatcccgggcgcgcataacggtctgcgcgatcgccccgttacggcggcaaacgccgttcgcgatgtcttggagcgttagcacgctcgatgacctgcggggagaggggctgttagcgtttcgtcattgttaacgaatgcgcccataaccgcgcgcccgcggctccattaccgccgtttgccaggtcataaaaatgtaacgataatcgcgcgtttgccttcagctgttagatgctacccttgtaccaattgatatgcaccgttgccgtgcgtaacgataggaagggccccatatgctcaataatcacgaggtcaatctaaccgacgaggaggctgccgccgaggtcgcccgcgtcgcgaagacctaccccgtggtgcgtttgttgtcggccgatcagattaagagcgagcctaactgcttgctcgccggcgatcgctgcccttgtctgcgtcagtcgagtcttgaggccttggcaggttccgatgatgtatcggagcagctgctcaatgatggtaccgagtaccgcgctcgcctgcgccctctgaaggtcgagggcgagcctcacgtcctgctgatggtgcgtccgatcgatgagcaagaggctgcagaagaggacctcgtctacaccgacgtgctgacgagtgtgcgcaatcgccgatattacgaggaaaagctccgtagcgcccgcatgaatgccggcgttgcggtgatcgaccttgatgattttagggtcttcaacgatacgtgtggccgtcatgccggcgaccttgcgctcggtgctgtggcgacagccatacgcagcggaattcgttcgactgacgagcttgtacgctatggctgcgacaagtttgtggtcgtcatgcccaatattccctccgatgacttcacccgtcgcctgcatcaggtgtccgatgccgttcatgccacgattgttccgggccatgagcacgtgagcttgacggcatgtgttggtggcgttcgcattcatggcgagacggttgatgagggcgttggccgcgctgtccagttactgagccgtgctaaggcaaaagccggtacggtcgtgaccgatggcgatttcatcgaggccttccaaagcgaaaagcctttggtgcttatcgtcgatgactccgagatgaaccgagccattctcaacgagatgctcaaggacgagtattgcatcctcgaggccgaaaacggtcgtacggcgctcgatatggtcgaccgctatggcgatgagttgtcgctcgtgctgctggacattgtcatgccgggcgtgagcggctttgaggtgctggccgatctgtcgcgccgatcggttgttgacaatctgcctgtcatcatgatttcgagcgaagaatccgacgatgtggttctgcgtgcgtacgagctgggcgcctcggactatatcagccgcccgtttgacgcccgtgtcgtgcgccgtcgtgtaagcaacactatccgtctgtacgccaaacagcgccgcctgacgagcctgctgtcccagcagtacaacgagcgcgtcaagaacagtcgcatgctcatcgacatcatggccggtgtcatggaacttcgcaatggcgagagcggcaggcacgttacgaatatcgaaaagctgaccgagctgctgcttggctgtctggtccagcgtagcgacaccatttccctcgacaacgaggaacgctccacgattgccctggcttcggcgctgcacgatatcggcaagatggcgattgacgatgcgattctcaacaaacccggacgtcttacgtccgaggagttcgagattatgaagacgcatactacgattggcgccgacatgttgcttgagctgggccgacatcacgtcggcaatgcgcttatggaatatgcgtaccagattgcgcgttggcaccacgagcgctgggacggcaagggttatcccgatggccttaagggcgacgatattcccattgccgcacaggtggtttcggtggccgacgtgtacgatgctctgacgagcgtgcgcgtgtacaaggacgctatcccgcacaaggaggcgatccagatgatcctgaacggtaagtgcggcacctttaacccgctgttgctcgactgcctgctcgaggtgcaagaccgtattgccgagacgttggcacgccccgccgacgtcgtcgcgtttcccacgatctagtttgaccaaaggagttttaatccatgatttccatgcgtgaggcgtatgagaagatcggcgccaattatgatgacgcgtgcgctcggctgatgggcggggaaatgcttgcccgctttgccctcaagtttttggatgacgagagcatggacaagctggaggccgccatggcggcgggagacgccaaaggtgcgtttatggcagcgcacacgctcaagggcgtgagccagaatctgggattcgataatctgtacgagccggcggttgtggtgaccgaggcactgcgcggcgccgatgccgttgacggcgctcgcgagggaatgcatgcgctgcagcaacaatatgcggcaacgatgtcggctctgcgcgaggcggctgaataagagcttgcgagccttgggctgcttgccggccacatataggtgaaagggcgccccgccggaccatgtggccggcggggcgcccttatctgttttgtggttcgcgtgctagcgggcctgcttgaccttggctgccgcctcgacaaacgacttccagaggttaaagtcggtctcgagcgtctgccaggtgtactcgggatgccattgcacgcccaggcagaagggttggccttcgacttcgatgcactcgggcacgccatcggttgccttggcgaccaagcgcgtgcttttacccagacgatcgacgcagcagtggtgtgcggagttggtctggataagcctgtgcccgccaagcgcgcgctccagcaacgagcccggcacgacctcgacgggatgcacggggtcgttgagcacgtgggtgtggcgccactgcgtgcggccctcgcgcgcacccaggcttggcacgtccatgcacagggtgccgccggtggcgacattgagcaactgcgtgccgcggcaggtggtaaagagcggctttttggcgcggagcacctcgccgaccagcttaaactcaaagctatcgcggatctcgcagcagagggtggggtcgtagggtcgatcatcgccccaacgtttgggattgacatcggggccgccgggaatggcgatgccgtcggcgatatcgacgtaatgacggatgacctcaatgtcctcggtgatggacatctgcagcggcaggccgccggcggcaaggatggcatcgacaaagacgctcgcaatctcctcgttgggggagagcgtctcgctcaaaaacggcttcgcttcttcccaacgcggcgctaccaggatgagtggacggtcagcgggggcaacgtcgacgtgctgggtgtaggacgaggaagtacgggttccgatcatgggtgcggctttcgaatctgaaggtgacagggcgcatgagagacgtgggacaacactttcaatggatttgtcccacggggtggctggttagtggcccttgatggagttgaggaagtcctgggcgcgcttggtctgggggtggtcgaagaactcgtcgggcgtgccggtttccacgatctggccgtcggccataaacacgacgcgatcggcaacgcggcgggcaaagttcatctcgtgcgtgatgacgatcatcgtcatgccctgctgggccagacggaccatgacctcgagcacctcgttgatcatttcgggatcgagggcgcttgtgggctcgtcaaaaagcatggccttgggctgcatggcgagtgaacgggcgatggccacgcgctgctgctggccgcccgaaagctgtgcgggtaccttgtcggcctgctcggccacgcccacgcggctcagcaggtccatggcacgcccacgagcctcctccttggagacgcccagtacgtcgaccggccccagcatgacgttctgcagcaccgtcatatgtgcgaacaggttgaactgctgaaacaccatgcccagctcggcgcgcatgcgggcaagatccttgccttcttgcggcaggggctcgccctcgatgaggatctcgcccgagtcgatggtctccaagcggttgatggttcggcacatggtcgacttgcccgagcccgaggggccaatcaccacgacgacttcgccgcggtcgaccgacagattgatgtcgttgaggacgtgtagatcgccgtagtgcttatcgacgtgtctgagctcgatcagcggctgattgccggtggaagaggtgctctgtgccatggtgctcggctccttatgactcgaaatggtaaagcgttagcggatgatggtcgcgccggtcttgtgcgaaacgtagacagcggccttgttgatcgcgacgttgatgaggatatagatgaccgcgataaccaggtagaccgacacgagggcgtcgtagttggtaatgagcacgcgggcattttgcatgaggtcggggtagctcaccacataggcgacggtggtgtctttgactacgaccacaagctgcgaaatcaacgacggaatgataaaccgaatagcctgcggcaacacgattttaaaggtgattttggccttggagagaccgagtgcctgggcggcctcaacctggccgcgcggcacggcgttgacgccggcgcggaagatctcggcgagtacgccagctgcagcgagcgcgacgggaagcgtgagcatccaaaacgacggcagcgcaatcttgtactgaggcagcaccaaaaagaagaagtaaatgaacagcaggctcggcacgccgcggaagaaatcggtgagcacacggcagaccagctgcagcggcttaatgtcgctggtgcggccgagcataaggcctagacccagcacgagtgcgatggcgccggcggtgagtgcgactttaacggtgccctcaaagccggcaagtaagaacttccaggtggtgaggtgcgtaaagaaataccaatagtggaccgaaagctgaccggtcacataaaagcgctgcagcaccaggacggcgagtgcggcgacggcaacaagcgagatggcggtgccgatgcgaatcttagcgcgcatcttggggccgggagcctcgtagagcgcatcgcgcatggtgagcgtaggggaggaatgcttgctcatcggagaatcctcaccttcttatcgatgtagttgccaatgtggctcaccacaaaggccgtgcccagatagccgagcgccgagataaagaacgcggcgacgccgccaagtgagcgcgtgttgatatagctcaccacgccggtgagctcttgcggcttaagcggcacctggctgcccaaggcggtagtgagcatgacggcgataaagaggttcgtcatgggcaatacgcttgagcgcagtgcctgcggaatcacgattttagcgaggatacggttaaagctcatgccgagcgagcgggcggcttccacctggccgacgccgacggtgttgatgccgctcataaagttctcggaaccaaaggccgagcccaaaaggaccgtggcgacgataacgcaggtgcggtagggtaggacgaccttgagcggcggcagcgcatagacgacgatgatgagcagtgcgatgccggggatgttacggaagacctgaacatacaggtcgccaaagacgcgcagcggcttgagcggcgacacgcgcatcacggtgacggcgacggccagcaccatggcgatgacaaacgactcaagcgtcatgccccaggttgctaacagcgcgtcgatatagttctggccatagagcgaccagagttcggagagactcatgcggacctcctgccgataaggaaaggggctcccgtgtgtacggaagccccgacaactcagtgaggaaacagtttagcgcaataaagcgcatcgtgcgtttccgtatggtttcgcaacggccgttactaggctcgctgtctaggcgccgacctcgggcagctcgggaacattggtgtcgcccgtacggtcgccaatgcagatctgccacagctcggtccaggtgccatcgtcctcaatcttcttaaggaagtcgttgacaaaggcgacgccgtcggaatcgagcggcaggccgatgccatagggctccttgttgccgaagggcttgccggcgatcttgcacttaccgggctcgcggaccagggcgctctgctgcatgttgttgtcgatgacgtaggcgtcaacgcggccctgctggagtgcctggcgggcctcctcgtcggtcttgaactcctgctggctggccttgggagcgaactcctccaggatggcggggccgttggagccggactggacggcgacgttcttatcggccaggtcgtcgacgcccttgatgtcgtcgttatcggcgagtaccaggatggcctgctgggtgtagtagtaggggccggcaaaggagacgagtttcttgcgctcgtcagtgatggtgtaggtggcaaagacggcgtcgacctggccgttctgcaggacggactcgcgcgtgtccgaggtcacctgggtgatctcgacattgttctcgcccagaatgtagttggacaggagctgcgcgataccggcatcgaagccgcgggtctgaccgtctttctcgttgaggagggagaaaagcgtagaggtctgaacgccaccgatcttaaagacgccggcgtccttgacggccgtggcccaggtgctggcggcgatgacgtcgtcatcggccttggggccgttgtcgacgagcttgtcgaatgccttagcgtcgagcgtggcggaaacttcggtatcctcggagctcttggaggagccggcggcggaacccttgtcggcctcggcgctggtgtcggagcagccggcaagaccaaggccggcgacggttgcgaaggtggcggcaacgaagccgcggcggtcgagaacgacctgctgggagaggttcttgctcatggtagaacacctttctcaataaaatccctagcggttgagtagagttataccctatagcgctcagacgggtcaacacgaaataactcagaaacatacttaccttatgggtaattttacctaccaaaaagggacaggcacctttgtggtggttctgaccgatgcagcggcatgtctcgctgctttatctcaatctgtaacatctggacggacaaaaggtctctatctgttacagattgagacaaaggtcaggaactaagacgtcttgtctagatctgtaacagttagacgggaagtcgagccctagatgttacgaatcgagataatcgcgccgcgaaaataaaaacctccgcgggggtgcttcccttgcggaggttttcttactcgttcagtagccttgcggcttcggcggccatatcctcgaccgtcatgccgttctgtgcgagcagttcgttggggtcgtagcggtcggggaagcccttggcgatgccgaaggtgcgcgtgcgcaacggcgtgcatgccagataacatgccacgcgctcgccccagccgccgtccaagatgccgtcctcgagggtgacgacaacacgatgctcggcggcaaggctgtcgaggaactcacggtcgagctcggttgcaaagcgtgggttgacgagcgtggcctcgataccgtactcggcggccaaacggtttgccacgcgctcgcccggctcaaagaaatcgccaagcgcgagcacggcaacgtcgcgaccctggcgcaccacgttgtagcgaacggcgctgtagtcggtgccttcggcgggcgcaaggtcgggacggctcaccaggccaataccaggtacacgaatcgccacgggatgctcgcggtggtcgagcgaccagctcagcatggacagatattcctccatgcaggcaggtgcaaggtagcgcatgttgggaagtccgcccagcatggaaatatcaaagaacgaaaggtgcgtctcggacgtggtgccaaagattgacgcaccaaacaccaaaatggttgcgggggcgtcgttgaggcacaggtcgtgccacagctcgtcgtaggcgcgctgcaaaaacgtgccgtacacaccaaagactggcttggcgcccgagcgcgcaagcgcggtggcaaaggtcacggcgtgctcctcggcaatgcccacatcgacgaactgtttgccggcggcagcgcgaagctcgggtgtaaagcccataatgtagggcgtggcggccgtgatgccaacgacctgtggatcgcgctcgatggcggcgctgagcgcctcgcccgtaatgtcagcataggtgcgcggcgcgggctcgctcggatggcccgggcaaagcttgcgcccggtcgccatgtcaaacggacccacgtggtgccagcgttcggggtcgctctgggccggctcaaagcccttgcccttggcggtggagacgtgcagcacgatgggatgatcgatattgcgcagttcctgcagcgcgtcgaccagggccaacacgtcgttgccggcgtccagatagcgatagtcgaggcccagcgcgcggaaaacgttgcgctcacaggtgccgttgctggcgcgcagctcggccagattgcgatagaggccaccgtggttttcggcgatggactggtcgttatcgttgacgatgatgatcaagttgctgtcgagctcggcggcattgttaaagccctcaaacgccaggccgcccgaaagcgagccgtcgccaatgatggtgatgacgttgtacgcatcgcccgtcaggtcacgagcgtgcgccaggccgcagcccaggctcactgacgtggaggtatggcccatggcgaacaggtcgtgctcggactcgtcgggattggcaaagccagaagcctcaccataacgctccggatcgatataagtgtacgcgcgcccagtcagcgccttgtgggcgtaggtctggtgcgaaacgtcaaagacaatcttgtcgataggggagttaaacacgcgatggagcgcaaccgtaagctcaacgacgcccaggttgggggcaacgtgcccgccgacggcggcggagctttcgaggattgcctggcggatctcgccgcagagcagcggaagctcggcgcggtcgagagccttgacgtcttcgggcgttgtcgtttgcgtaagcagcatcgttgtgggttactccatgcgaatcgagcgtcggcgctccctcggccgacacaattgcacaagacagtctcgcacattttggcgtttgatatgtgacggcggcgcggtaattcgccaactggtggggcaaaacgttttgtccgatgccatactgatgtgttccatgatgtttttatcgattgtgcacaggccgtggcttgccgccgtgagccgctggaaggaggcagcatgtccgatgccgttcgtgccgagaaaatcgcgtgcgaagtagaccatgctgcccgtcaactggcgcaggcgggccgtctggacctgacgcgcgagtttatccagcatggcgatgtgacggtgtatgcacatgtgacttcggtagcgcgcgcgagtctgtcctttgccgagcacttgggccgtgctggcatttcggtcgaccgtgcctcgctgctgcgcggggccctgttgcacgattactttctctacgattggcacgattccgacccaagccatcggctgcatggctttcgccacccgttttttgccctggcgcgtgcggaagaagattttgagctgacgccgcgcgagcggaatattatcgtgcggcatatgtttccgctggtgctggtgccgccgacgtgtcgtgaggcatggattgtgtgcctagcggataaatggtgtgctctgcgtgagacggtcgccggccgcctgccgcgcaaggacgagacggacgatagcgcgagtaaagcatcgagcgaaaagaggagagggtagacggtggggaccgcgattgatactgcgttttgcggcgcgacgcttgccgcctgcccactctcggcactggtgctctcgtttgccttttacgggttttgcggttgggcatgggagtcgacagtatgcgccatgctcaatcacggacgatttgccaacagtggctttttgctggggccgtgttgtcctatctatggtgtgggcggcattgcctgctggctgctgttgcgcgggattccggatgcctcgagccagtttgtcgctgcagcgctcgtatgcagcgtgattgagtacagcgtaggcgtgctgttggaaaaaacaacgggcgctcgcttttgggattactcgcacctgccgtttaacttgcacggacgcatctgtctgtactgggcttgcgcgtttggcttgggtgcgttgtgtatttgccgtttagtggagccggcattgctggggctgcttggccgtctgccggtgctgattgtgcggttgtccgcctttatcgtcgcggtcgcgatgatggtcgacgcgttgtgctcgctggcgagctggcggcgtctgtccgatcagctggagcgcgtgcgcgccgatcttgccgaccgcatcaacgagtcgcttgccgatgcctcggactcaatgctcgagcgcattcccgaatcgacgattgactcggtggcacaaacgcacatccgtagccgtgccgttaacgcgtggctggccgagctgggtgacgccgcgctcgatgccctgcgcgagaaggcttcaatgccgacgtttatcgcggatggtgctcgcggcctggcacttgctgcccgccgtgtggccgatgccgcgccgagcatgccgcgtccgtcgctcagtcgtcgccttgccggcaagcgcatgagccgtccggtgccaagcgtgtcgctcagccgccgcgacctacgcttctttaacgccttcccgcgtctgcgcatcaatcgctacgaaggcgtcattcgagcaactaatctccgcgaccgagcccgcgagctgttccgccactagccgagacgggcgcgctcacggcttccttgctcgcgtatttcccgttcgtttcgcgtccgttgccgcgccgtttccaagattgcggcgccgtttccattcgacaacgccgcgtttaacaatgccgtatctggtctacaccagttgcccctcggccgcattatgggcgccgacaacgttcatgcgaccaagggagagcgaatgtacgatacgggatcgacaacgtttatgctcatctgcaccatgctcgtgtttttaatgacaccgggtctggcgtttttctatggcggcctgtccaggcgcaaaaatgtcatcaacaccatgctcatgtgctttggcgccattggtctggttggtgtgctgtggattgttgccggctggtctctggcctatggcggcgacggttcgagtccgtttattggaggccttgaccagctgctgtgcctgccggtgctcaaccaggtgctgcaggcggctgagggcaatgctgcggacggtgtcgtctaccctcagatcatcaacatcgccttccagatggcatttgccatgatcacggctgctatcgtcacgggcagcctggccggccgcgttaagttcggtgccacgacggccttcctgggtatttggctgctcgtggtctatgcgccgctcgctcacatggcttggggcggcgagggctcctttattggcgatatcatcggcgcgctcgactttgccggcggcgacgtggtgcacatctcgtctggtcttacgggcctgattctctgcttaatgctcggccgtcgtcgcggctttggcatggtgagctaccgtccgcataacgtgccgtttgtggcgctgggagccggcctgctttggtttggctggtttggctttaacggcggcagcgagttcaaggccgacgccgtggcggcacttgccatcctcaataccgtgacggccagcgcgacgggcatggtctcgtggcttgccgtcgagcgcgtgcacacaggtcgccccacgctggtgggcgccagcaccggtctggttgcgggccttgtggtggtcacgccgggcgcgggctttgtcgagccgtgggcggcgctggtcatgggcctgatcgtatctcccgtctgctacctggccatcagccatcttaagaccaaatttggctacgacgatgcgctcgacgcgtttggctgccacggcatcggcggcatcctgggcggcgtgctcacggggctgttctgcgtgccggagctctcgtggaccggtaagggcggcctgttctacacgggcgatgtctcgctgctcatctcgcagattttgggcattgtggtgacggtcgctattgtactggtgctcgacttggtgatcgccgcggtggtcaaggcgctgttccacggcagcctgcgcgtggacgaggccgacgaggcgctgggcctggatgcgagtcagcacggcgagagcgcctacccttcgttctccggactcgattagcagcttccccaagctccgcaccttgccgttcaatcgtcgcgcggcttccccaggcacccgaccttgcccctcaaaccgtcgcttgcgtaccgaagtacgcggcgctcctctttcggggcaatctcgggcacctggaaaacccgcgtcattgaatgacaattcatttctttattaaagagaggaattcactatgaagaagattacggcgatcgttcgtgccgagaagcttgaggttcttaaggacgcgctgtttgctgctgatgttcgcggtatgactatcaaccaggtgcagggctgcggtgcgcaacatggctggaaggaatacgtgcgcggcaacgagttgcttgtcaacacgatccctaaggtacagttcaccctcatctgcgccgatgaacatgtcgacggaattgtcgacatcatctgcaacgctgctcgcaccggagccgtcggcgacggcaagatctgggtcgagccggtcgaagaagttatccgcattcgtaccggcgaacacggccccgccgcggtgtaggacaatctttcgcctgacgggcgtgcctctcttggggcgcgcccgttctcgtctacaatatcgtgcagacgaaggagaggcatgcccatgatcaagatgtttgcgagtgacttagacggaacgctgctgaatgccctacacgaggccgacggaaccatccgccgcgccattcgcgagctgaccgaagccgggctgcatgtggttcccgcgaccggacgctcgacgctgccgatcggcgagcatggcttcacaggtctggcactcgacgcctgctgctccaacggatccatcgtgcgcgacagccatggtgaggtgctcaagacctggaccatcgacccgcaggttaccgaggagctgctcaaagcgttcccggacatttgcttcgactgctccacgcccgacggcatgttctcgagcggttcgttcgagatgcaccaggcgggctttaaaaaggacagtcctatcaagcgcatcgtgatgcgcggcatgcgtgcacgtggcgggtatcacgaggaacagtatttcgaccagtcgatcggtgacatcctgcgtcatgacgtgtgcaaaatcaactgccgcgtgacctcgcccgagctggagcgcgaccttaaggcatatttggctgagcgatcggaccgcgtggtcaacgcgccgttcgatccggtgatgttcgagatcacggacgtggcgtgcaacaagggcgagagcgtggcgtggctggcgggctactacggtattgccgaggacgaggtcgcggtctacggcgacggcggcaacgatatcgccatgctcaagcgtttccgtcacagctacgcgaccaaaaacggcagtgacgcggccaaggccgccgcgagcgtgaccatcggcagttgcatggtccacgccgttcccaagcatatgctcgccaccatgcgcaagcaaaactcccgcaccgtcatcgaataatgtgacaaagggactgcccttcgtcacatcctaaatattgcctttacgtgttgatgcacacggtgtgcaataatactcgcactgtgcaatagcgcacaggctgagtaacaaggaggacgcttgtcccagctcgagaaatgcgatcgccggtcccttcgctcgcagcgtgcccttcgccaggcgcttgccagcgagcttgccgaaagcggcgacttttcgcgcattaacgtcgcgtcgctcaccgagcgcgccggtcttacacgccgcacgttctattcgcactaccgcgatattcccgactttatcaatcaaatcgaggacggcttgctggccgagatccgtgagcgcattgagctcatcactgcagctcagctgcctgatctctatcacaatatcgatgagctcgagccggcgcccggttcggttgagctgctgcgttatcttgcggccaaccgcgacttaatcggtgcgctgctgggtccgggcggcgaccaggccttcattaaaaggatcatcgacaccgctcgtgaggctgtggtgccgcgtgcgcagacgggcattttgggcctggcgctgggtacgttctttgactactacgtcacctacgtcgtgagtgccgaggtcggcatgattcagcgctggtttgagcgtgggctcaccgaatcgcccgaggccatggcgcgcattatgacggtgctcgcttttgtgcgccctggtgacctgtatggccaacccatcgatatcaacgtgccggaatatggcatgaagctattgaacttgcagctcgaggacgcggccgacaccgtcgcaaccgtcgagtccaacaactaagaggagagacagatgagcaaactcgtcgagggcattaaggaccgtatggttgctgccgcacgcgaggccgcgcccgccgtggtggacgccgcgcagaaggccgcgaccgcggctgccgagaaagttgccgaggcagttgccgatgccaagaacgcagcaggggagacgtccgtcgctagcgagctcgccaccgccgctgagtccgtggccgccgcccacgcccccgaaggcgcgatcttcaaccccgagaacgctcgtggcaacctgcacctgggcatcgacgtgggctccactaccgtcaagctcgctgtgctcaacgacgacaaccagatcgtctacgccaagtaccagcgccaccacaccgacgtccgcgcctgcgcccgcgacctgttcgagggtgccgcgaccgtgctgccgacggcccagatgacctgcgccattaccggctcgggcggcctgctgctgtcccagtggctcgacctggagtttgtccaggaggtcatcgccagcaagcgtgccgtcgagaccctcatcccggccaccgatgtcgccatcgagctgggcggcgaggacgccaagatcatctactttgacaacggcatcgagcagcgcatgaacggtacctgcgccggcggtacaggcgcgttcatcgaccagatggcaaccctgctgcacaccgatgccagcggccttaacgaactcgcggccaacgccaccaccatctatcccatcgctagccgctgcggcgtctttgccaagaccgacgtccagccgctgctcaacgaaggcgcccgtcccgaggacgtcgccgcttccatcttccaggccgtcgtgacccagaccatctcgggtctggcgtgcggccgtcccatccgcggtaacgtcgccttcttgggcggcccgctgcagtatctctccgagctgcgccatcgcttctacctcacgctcaacctggacgaggagcaccgcattgtgccccaaaacgcccacctgtttgtggcgagcggcgccgccatggcgcatgagtccaacaagctcagcacgttcccgcagctcatcgaggctatcgatgccctgggtgacacacagggtgccgaggtcgagcgtctggacccgctctttgccaccgacgaggactttgccgagttcaagacccgccacgaccaggaagtcgttcccaagggcaagctcgacggctacaccggccgcgtgttcattggcatcgacgccggttccaccaccatgaaggccgcgctcgtgggcgaggacggccagctgctgcacacctggtacggtaacaacaacggcgacatccttggcacggccaaggtcatcatggccgatttctacaaccacatccccgccggctgcaccatcggccacgtgaccaccacgggctacggcgaggcgctgctcatcgaggccctcaaggccgactccggcgagattgagaccgtcgcgcacctgcgcggcgccaaggcattcctgcccggcgtcgagttcatcctggacatcggcggtcaggacatgaagtgcctgcgcgtcaaggacggtgttatcgagcacatcatgctcaacgaggcctgctcgtcgggctgcggcagctttatcgagagttttgccgtctctatgaacatggacgtgcgcgcgttcgccgatgccgctatccatgccaaggcccccgtcgacctgggtagccgctgcacggtctttatgaactcgcgcgtcaagcaggcgcaaaaggaaggcgccacggtgggcgacatcgcggccggcctgtcctattccgtcatcaagaatgccctgttcaaggtcattaagctgcgcgaccccaaggagatcggcagccaggtgatcgtccagggcggcacctttatgtccgacgccacgcttcgcgcatttgagcagctcaccggcgttcatgccgtgcgtcccgacatcgccggctgcatgggagcctatggtgcggccctgctcgctcgcgatcgcgccggcgccgatggcacctcgaccatcctttcagccgaggacatcgcgcacctcaccgtgacgcaaaagcatgtccgctgcggccgttgctccaacaactgccagctcaccgtcaacgactttggcggcggcagacgcttcattaccggcaaccgctgcgagaagggcgccggccacaaaaagcagaagaccgaggcccccaacctcttcaaaaagaaaaacgagctgctctttaaccgcgaggtcctgagtcccgacgaggccccgcgcggcaccgtgggtatcccgcgcgcactcaacatgtacgagaactaccccttctggcacgcgttctttacacgcctgggctttagcgtgcagctgtccgaccagtcgagcaagaagacctaccaggcgggcatcgagtccatgccgtccgagagcgtgtgctatccggccaagatgagccacggccacgtgatgaacctcatcgaccgtgacgtcgacttcatttggatgccgtgcgtgcgctgggagcgcaaggaggatccgacggctggcaactgctataactgccccatcgtcatgagctaccccacggcgctggcgctcaatatcgacgagattcgcgagcagaacatcgagttcctgtacccgtttgtgccgtatcacgataagaccgagcttaagcgccgtctgtaccaggtgctcgccgtcgaccgtgtggccgatgctgaggccggtcgcggtcgcgtgcgtggacccaagatcacgcgctccgaggtcgatgccgccgtcaacgctgcctttgaggccgatgcgcgcttccacgaggatatccagaccatgggcgaggaggctcttaagtgggtcgaggaccacggcggccacggcatcgtactcgccggccgcccctaccataacgaccccgagatcaaccacgccctgcccgagcttatctcgagctttggctttgcggtctttaccgaggattcgcttgcgcacctggtgaagcccgagcgtcccatccgcgtcgtcgaccagtggatgtaccacagccgcctgtacgccgtcgcccgttttgtgacgatgcgcaacgacctggacctgattcagctcaactccttcggctgcggcttggacgccctgaccaccgaccaggtgcaggagattctggaagccagcggcaagatctataccgtgctcaagattgacgaggtgtccaacctgggtgccgcgcgcatccgcatccgctcgctcatggctgcgcttaaggaccaggaggctgagcgcttggctgaggcaacggccgcgggcgaggcctacgagcagggcgatgccgcgccggtggcgccctccacggatgcccccgcgttcgcgagccgcaagtacacgttcgaggcgcagcgcgagagtgcttcgaccgcgtggcccaaggtgccctttaccgagcagatgcgcgaggagggctacaccatcctgtgcccgcagatggcgccgatccactttgatctggtcaaagaggtgttccgtggtgccggctacaacttggagctgctgccctcgactgaccacgatgccgtcgaggccggcctgcgctacgtgaacaatgacatttgctacccgtcgatcctggtgacgggccagattatggaggccatcgagagcggtcggtacgacctgtccaagacggccgtggttatcagccagaccggcggcggctgccgtgccaccaactacatcgcactcatccgcaaggctctgcgtgagagcggccaccccgagattccggtgatctcgctttcggtcgtggcgctcggcgaggacaaccctggctttaagattacgccggctctgctcaagcaggcggtctacgcggtgctctttggcgacgtgatgatgcagatgctctaccgctgtcgcccgtacgaggcaacgtccggtgccgccaatgcgctctacgaggagtacatggcgcgcgcccgcaagctggcgcccaagttcaaccgtcacaactacaccaagctgtgccgcgaggccatccgcgcgttcgacaccatgccgctcgtgggcgagggtaccaagccgcgcgtgggcgtggttggcgagatcctggtcaagttccaccctacggccaacaaccacgtggtcgatgtcatcgagcgcgagggctgcgaggccgtagtgccgggcctgctcgacttcttcctgtactccatgagcaacgccgagctgcagaaggacgagctgggaagctctgccactacacgcgcgggcatgcaagcgcttattaagctcgtggactggatgcgcacgccggtggaggagatgctcgaaaagtctcgccgctttgaggcgcccgagcgcatcggcaccatggccgacaaggcccgcacggtgctttcggtgtgcaacaacatgggcgagggctggctgctcacggccgagatgctcgacctgatcgatcacggtgcgcccaacatcatctgcacgcagcccttcgcgtgcctgcccaaccacgtggtgggcaaggccgtgattaaggagctacgccgccagcaccccgagagcaacatcgtcgcggtggactatgatcccggtgcgtccgaggtcaaccagctcaaccgcattaagctcatgattagcgtggccaaggaaaacatgcgcgccggtaaaggctttaagctcgagaaggtggcgccgctcgcgatggacgaggtcaccggtcagatgcgtgcccacgacggctgtgcgagctgcggatctgccagtgaggaggccgttgcatcggtcgccaagcgcctggggcgcggcattaagaagtagctggtctgctatgggctagatatgagacaaacgggtggtagccgtaccggctaccacccgtttttgctggacatatgttgcgtaaatgaccttgctacagccttccgtggacttgcccgatttttgggccggctcgggcttagaggacaagttgctgcaggcccaaggcgatttttcgctcaacgcaggccagcacagtgtgacctatctgccaaacgacgagacgaccgctacggtctggccatcaccacctacgagatggaagccgaaaagtacatctaccgcgtgtacaagtacgagctgtagggccgcgcttaggtttgaccaatggagtatgaaaacacgccgttcgccgatgccccctccgcgagtggcagccatatgttttgatatcagaaacatatagttgtcgccagcctgctggcgacgttccccctgatatcagaggctccaggtatgtttcgcgctccgttaaacaactatcgattgggctaacatggaccgccgtgctatttcggtaacccttgcagtggtctgtctgactgtgctcctgggcgctacagggctgtttgctataagccgagaaacgtcctatatgcaggaatgcgcttccgaagggtttgccattgatggttactaccgggatgacaaaacgagtcgggaaatcctggcctttcttgaggaggatggctgtcgatggcaactggtcgacaaagacggcagctgcgttgacgggcagtttaagcgtacggatgaccccaacatcctgatattaaagaaggaaaacggcgaagaattcggcacggttcacgttgcgtatatatcgcgccgacgcaatcaggggcagatttacctaattagaaatactaaggtgacccgattttatcttgtgagcaccgatccagcgtttacggtggggtctggcgatgtcgatgcggacgtctgattcacggcaataaaacagcgagcggggcgcggacgtgaactacgtcccgctttttgcttgtgcctgcgtcgcgtctgagcctcgccgcgacttgcgcctgtgcgcgggagccatcccatgctccgcattactccacatcaaactccacgcgatcgagttcgggcacgttgaggtcaatgagcttgcgggcgacgtgacggtcgtgtgccccaagtgcctcgcttgtcgtcacatgggcgacaatctcgcgctcgacgatgccctcctcgtcgccttcggtggccgaggtctcgacggcgacggtgtaatccttaaagcccggcagcaccgcggcaagctcgcgcgtggtttcggtgacaccgtagccgtcctgcacgccggcctgcgccgagccaatggaacccgccgtcatgacgatgcaggggatggcaaagaccaccgtgcccacaataatgcggcggcgcaccttgcgtgacagctcatcgacctcggcattttcctcggctgtcacaatgccgtcgccgttgaggtcgcgcttgagcggtacacgtaaaagaagcaatacggcttcggccgccagcgcgataaagaccacgttgatgccaaactcataaagcgccgagagaaacagtgacccgcttgcgatggcgatgccgtagcccgccgcgcacaggggcggcatgagcgcggtcgccacggccacgccggcgatgagcgtggcgggttcctggtcgcgcgagttgcccagcccgcctgcaaagccgcctgcgagtgcgacggtaaggtcccagacggtgggtgtcgagttgtcgatgatggcggccgtggtggtgccaaggggcgagagcttaaagtacagcgtggacgtgaccaggcaaaaggccatctgcagcgcaaggctggcgacggcttcgacggtaatctcgcggtcgagcgtggcaataccgtatgccatggcaaggaccgagcccatgagcgggcagatgagcatggcgcccacgatggcgatgtccgaatcgatatcgaggccgatgcttgcgatcagcatggcgatgatgaggatgcataggtgggagccagtcagacgcgccccgtttacaaaacgcttgcggatcacgtggtagggcgcgcgaccctcgcgaatgttgaatgcgcgcttgaggaagcgggtgatgttttccatggcttcgctatgggcagggcggatgccgtggcgccggtggtggcgttcgcgtagtcgcttgatctgttgtttgtcgagttccatgtccacctcgttccagcgcggtccgcgcaacgcgcccgttgtcataactctacaccgtggcgggcggggtgtctgttggatgcggaatccgatagggcggatgacgcgggagcaaatgcaaatcacaggctcaattccatcccgcgagaatatgatgcaccagctccttcaaatgtgacgaaactgtgaagcacgagagcgtgaatttcaaaaaatacgctggtcgccaatgttgcgcaacagaattcaaaaatcgacagctaccgtttgatacgtatggatacatccgtgtcaaagggagaaagccatggcaaactacagtccacaacactttgagcctcgggccaaggccgtcaacgtcaagggcgttgccaaccgcgccgtcgcaaccgttttgacggcgggcctcatcgctcagccgctcatgtcgccgctggcggcaatcgctgcaccgtcaaccgataacggcgattctgttcaggggggggggtagttctgtagagaacaccgttgccgccggtaaccaagcggtcgtaaagacggctgcccagctggccgaggagtcggcaaagcagctcaaggacgctcaggccgcctacgatgccgcccagaagaaggccgacgcggcgggccagtctcaaaagcaggcacagcagcaaaagaatcaggcctcgcaggccgtgaccgataacgccgccgagcagaacgaggccgaggcagccgcgcttcaggagaagatcgacgagcttaaggcggctgttgacaaggccgagcagcagcagaagaagctgggcgacctgaacgatcagctcgatcaggccaacaagagtgtcgaggataagacccaggcgctcaaggacgccaaggcaaagcaggatgaggccaagaaggccctcgacgatgcgcaggccaagctcgaggccatgggtatggacgagtacgaggccgccaagaaggccgtcgaggacgcgcaggccaagctcaatgcggcgaatgccgatgtgaagacggccgagggtgagctcgatgccgctaagaccgccgccgacaatgctgagcaggcaaagagtgatgccgagtctgctctgacgactgcccaggccaagaagcaggagaccgccaatgcccttgccgctgcgaccaccgcgtgcggcaacgcccaggataagctgaacgacgcccagaaagcgctcgatgccgccatctcgggcacgggcatcgatctaaaagcgcttgaggccgccaaggaagctgctgccggtgagctcaaggacgcgcagaccgagcttgatgccgcgaaggctgccgacgccaccgcacaaacgaacctccaggccgcacagactgatgccagcgccgcgcaggaaaaggtcaacgccgccaacgctgccgtttcgtcagcgcagactgcatacgacgaagccaacggcaaactcggtgatttgaccagcaaatacaacaccgccaaggctgcttacgagcaagctcagcagaccgaggccgacaagaagacagagtacgaccgtctagcagaggtcgcaaagcagaagaaaagcgctcttgagaatgctaccagcgactacaacaaagcgaatgatgaatacaacacggccagcgcaaacgtcaaagctcttgagcagcagatttctgagctaaaagcaaacatgacggtggatacggatgctgtcaaggctggcctgcttggctttatgaatcacatcgcaagtagtacgtcgtttactgctgctcagcgtgccaacgcgagcgatgcggcgaagttacttgatgggtctgctagcaaggcggcatggtatgacgactatgtcaacttggatgcatctgacgctgacaatgctttttcgctcgtgaatctgcagaataccttgacctacatgaatgccgtcaatggaattcgtcgcgcaaatggcttgagtgacatgaaggtcagcattgtctctatggcgcagtcggcgctcgatgtttgctattcgtcgaatgtttgggaccacgcggggaacagcggcgagggcttttatatgtcctataacgaaaaccttgccggacgtgctggcgcctacaaggggtcagataatcctaaagattgggaaatatccttcgataacggcgacaagtacggcgatgattggccgtttatcggttggtatactgcggaaaagcgtgactatgacaggggtgactatagcaacaccggccactatgagaactttattgattcaggtgctaattcctttgggttcgccgtcggctacggtaaggatggcaaccgctcaacgcccgaggatgacggtgcacccagtcctgtttcaatttatcagggaaactgggccgaaggcgattttacggttgacgagttcaagaacctggtaaacacgtacgtagactccgtttatcatgccggtggtaccgccgcgcagaaggcgcagctggcgcagctgcaagatcaacttgcggcagcacggaaggcgctcgatgtgaaaaacgatgcgcttggctctgcggagtcatccctcgatgctgccaagagtgccgcgaatgaagcgaacggtaacgttgctgctgccaagagcgactatgaagctgcgcaagaggccaccgctatcgcgaaggcggcatatggcgctgccgatgtcaatttgaagaatgttgacatcgaaactcctagggcaaatctcaacgccgccaaggacgaggcgaccgtcgcgcaggccgcacttgacgacgctaactccaagctcaccgaatgccagacgaacgcctccaaggcttccgcccgcaaggcgaaggcacagggcgattacgataccgccaagacaaagtccgataaggccaacgaggcgtatgacaatgccacggcttcggtcaaggaccttactgccaagcgcgatgccgctaatgcgaaccttgcgagcaagcagggcgcgcttgacggggccaagaaggccgacgacgccgctcaggctggcgtagataaggctcaagccgcaggcgcacacgccgcgaccgctctttcggatgccaagcaggcagttgccgccaagacgcaggccgtgtccgacgcacaggcgaaggtcaaggccgccgagggcgagctggcccgcgcaaacaaggccttcgagcgcttcgccggcgcccagaaggcggtcgatgacgccacggccgcctatgatgccgccgttgccggtgtcgccgatgcccaaaagcagctcgaggccgccaacaaggccgttgtcgatgcgaacttcgatatcatcaaggccaaggccgagcttgccggcgacgaggcgctcaaggccgatcttgaggccgtcgaccacaaggcctcccttgccacgggcacgacgggcaacgataagctgaccaagctgaatgccgcctacgctcgatacaagtccgccgtcgatgccgctgcgggcctcaagactgccctgagcgatgccgatgccaagctgtccgatgccaacgacgcttatgccgccgcattggcagaactcggcgatgccaaggacgccctggctgctgcacaggccgagtacgacaagtatcatcccaaggccgagccgcaggctaagcctcaggttacgcaggctgctgcaaaggcccctgccgctaagaagaaggctgcgtcgggcgcgcttgcccagaccggcgacaactccgcgcttgcgggcgaggtgttcgtcatcggcggcattacgctcgttgccgcgggcgtgacgctgagcgatcgtcgtcgcaagcagatgtagcgtattgagcgctggcctcgcgacataccgcaattcgtcgcgaggccgactcgataactcaaccgataaggccggcgcgctgtcatacgcggcgcgccggcctttctttgcggtggtatcaaaaagctcggtcggtagccgcgaaagctgccgaccgagcaaatcgtagacaatatggttgctgtcgagcagctgctcagcttagcccagcaggctcagacccacggagacaaacgccaggataacgccgacgatagactcgccaccgagcaggccgctggcgacaaccagaccctgctcctggaaggcggcatccttggcggccttctcctcgtccgaaagaccggcggcggcgtcgcggtgtgcagcccacttgtcgtaggcgagcttgacgcaggagcccaagaaggccgtgagcgacatgtagaacggcaggtacacgcccagaccgatcatcatggccggaatgccgagccagtacatgacgatgccggcgataaaaccgcccgcaaaccacggcacgctcgggatgcccgagaccatggtggcgaccacgcttgcctgcgcggccacaaagctcttgtcggggccgaaggcgtccggaccataggcggtgacgagcgcgaccatgacggcggcagcgaccagggcgcccacgatgccgccgatggcctggccgacccactgtgcacgcgggttggtgcccagcacggcgccggccttgaagtcgttcatgacgtcgcccgcaaggccgcacgctacggccacgatgccggcgataaagaacagcttgacctgagcgagctgcgcgaaggcggcaacgatgagcatgacgatgaggccgaagatctccatggggtcgatgcccgtctggccgcagctctgcgcgctcatgatggtggtgacaaaggtgaacagcgtgacgatgacggccgggacggggccaaggtcgagcacgatggcgatgatcacggcgatggcggcagcgcccaggccgatgataccggcgtcgagtttaagggagcccgagatgagcgactgctcgtcggtgtcggtggagctgtcggcggcgaggccgcggacgataccggcgacctgcggcaggatgtccttgaggacgacggcgacgccaaagcccatcatgaggcccatacccagggacttaacaatgccctgtgcggtcacaacatcgaacagaccggcagcggtgccgcccacgatgatgccaaagttgcccagcagcgcgccggcaaaccagaacgcgacgggggcgaagcccaccaaaaagccgatggacagcaacatgggcgagttgtagatggcaaaggtcacgccggggatattgagcgtgcacagcatgctgggcaccacgcccagagcgtcgcgcagcacgctgtagatgccggcgatggccatggagccaaagagctgcttgccggttttgccgccggcctcggttgcgcgcagggtctgagctgcggcgttgccggtggggaactcaagcgcggcgtccacgataaagtgacggtggatgagcgcggtggccagcaggcccaggatggtgccggcgagtgccacgataaacatgtcgagccagctgatctggtcggcatatcccagcatccaggcgcccgggatggtaaacgccaggccgccggcgaccatggcgcccgcggacatgatggtgtgggtgacgttggcctcgttgaggctggcattgcccatgagcttaaggaagaacagcgaaatgacggcagcgaagacgatcggccaggggagagcgcccatcttgagggcggtgtaggccgagcttgccgtgataatcacgcagccaaggacgccgatgacgacgccgcgcagcgtgagttgcccgcgcatcgaagcgcggttcgagggattgctcatatagaactcctttgcgtatatccgcttcccccgggagcgccgctacggatacggcgcgggaagtcgggttaccaagggccgccgcgtgagctcgcgcgcgaccgcgcaccagtataaccgcaagctagtcatttcgggatgactggtttaggtaggcgatatactgctgggcagacgaaaggagcgccgacgatgcttaatgggtgcgcatatatattgacggtcgacgtgggcaacacgttcattcgctttggcctgtttgccgaggattcggccgcggcgcaggaatgcccgcttgcgacgtgcgagatcaccacgccgtcgagcatcacagcagacgaggcgcgcatgcgtctcgctcaagtcatggccgcgctagcggccgatgcgggcatgccgggtgcactcgttcccgcggccgcagtgctgagctgcgtggtgccggcgctcgagcgcccgtggaagacggcgctttcccgcatctgcacggggcgcgtgctcacggtggggccgggacttaagaccggcatgcccgtccactacgacgacccggccgagatcggccccgaccgcatcgccgacgccgtggcggcccgggccgtttacggctctccgtgcatcgtgatcgacctgggcactacgaccaatatcgaggtcatcgacgcgtgcggtacctttgtgggcggcgtcatcgcgccgggtctggcgctcggcgcccgctcgctctcggccgctgcggcgcgtctgccgcaggtcgagccttcggcgcccacgcatgtgatcggccgcaacacgcgcgaggccatgcgctcgggcgtggtcttgggcgaggtggcacgcatcgacggcatgctcgacatggtgctcgccgagatgcgcgcgaccaaggctgcgggggagggcgatgtgcccatcgtcattaccggcgacgacgccgaggcgctcgcggcccttgtcggccatagcctgacggtcgacgacgcgctgacgttgcgaggactcgccgagctctaccacatcaaccaaaagccccgccgcgtgtaaaagtgagggcgccggcgggacaaacgccctcacctttcacctgctacaatgggtcaaactattgcgattacggaggtgtctgccatgtcggacgatcttcatcaaacttcgtcaggcaagcgcctggacgtcattagctgggacgagttctttatgagcgtggccatcgccgcgcagcgccgcagcaaggaccccaacacgcaggtgggtgcgtgcatcgccaacaccaaccaccgcatcctttcggtgggctacaacggtacaccctcggcgctcaacgacgacttttttccgtggggtacgagcgacgacccgctgcaggacaagcacaactacgtggtccatgccgaggccaacgccgtgctcaactaccgtggctcgctcaaggacctcgagggttccacggtctacgtcacgctgttcccgtgccacgactgcgccaagattttggctcaggtgggcgtgggcgaggttgtctacctggacaacaagtacgccgacaccgatgacggacgcatcagccgccgcatcctcgactcctgtggcatcagctaccgccaggtcatcgtcgatgttcagattggtaccgggggacaggctcgacagtaatcatgcgttgtcgctatctgacgacgaacgcagctcaaagagccccgtcccaaattgactactcgtgaaagtcgcgtctgcgcgcatggacggctcgtgagcgggtacatggctgtagtaacatagcttctgtccgcgggcgtgcccgcgttattgtgagaaaggagcccctgtggctgttaacgaagagctgcttaagaaggttcttgaagagattcgtcccaacctgcaggccgatggcggcgatatggagtatgtgggcgtcgacgacgagggcgtcgtcaagctggagctgcagggcgcctgcgccggctgccccatgagctcgctgaccttgtctatgggcatcgagcgtatcctgaaggagcacgtgcccggcgttacccgtgtcgagcaggtcaatgcctccggcgagaccgacgacctgtacgacgagtacgcgccgttctaagatgcgaaagctgcggacggtacgctccgcatagacgttacgcccaaatatgcggctgcgagcgtaaggcccgcggccgcatttgtatgtagggagtaggagggtcgacatgctcaacgacttctaccatatgcttgatcccgtcgcgatttcggcggggcctatcacgatttactggtatggtctggcctatgtggtcggcgccctgctcacggcggttgtcatgtaccgcacacagcgtcgctggggctttaacatcacgattgatgacctgacgagtgtcgtggtcggcgtggtctttggcctcattatcggtgcgcgcctgttctacgtcatcttttacggcgacggctactactgggcgcatccgctcgagatctttgccaccaatgaaggcggcatgagcttccatggcggcctggtgggcggcatcatcggcggcgtgctcgtgtgccgcatgtataagctcgacgcatggactttggcagaccttgccgtcataggcgcgccgctggccttgtgcctgggccgttgtgccaactttgtcaacggagagctgtggggcaagccgaccgatctgccctggggcgtggtttttggcgggactgcgggcgatatgccgcgtcacccctcccagctctacgaggcatttcttgagggcatcgtgctcttttgcattctgcaggtgctcagccgcaaaaagccgctgctgccccagggtacgtttatgggcgtgttcgtgatggggtacggcatcgtccgctttctcgttgagttcgtgcgcgtgcccgatgcccagctgggttatctgctgggcggcgtcatcaccatgggtcagctgctgagtttgccgctcgtgatcgccggtctggcgctcatcatcttcgcccgacaccgcaatcgcccccagcgcatctacctcgacgcctaaccaccaaaaccaccacaaaggggacaggcacctttgtggtggttttgccgagtttgataggtttctagaaaggctttcggactgtgaaggattccgacctctccacaacggctgcgcgcgacgctgcccgcatcgtctggtttaagcgctaccccgccaagcagacgctcatcgcatttttgctcgcgctgttggcgaccacggcgttttccatcgatccctccccggtgtcgagcaacgcagtcttggcgattgaccccaaagcctcgggcatgctgtacgtgtgctacgaggtgctcctttcgtttgccggccataccgacgcggtcatgctgcttgcacttgcctgcctgctcaccttgccgtttcgctacgtgttctttggccgtggcgacacctggcgtccatcgatcattctgccgtcgctgttcttcgccatctgcatggtgttcggccgcagctacgacctcaccgattcggctgagattgtgctgggcgacaaggcacgcgttatctgcgcctggattggtggcgcgggctggatgcttctggcgattgtggccttctatctggcttttgagtttttggattggttgggctcccgccgcattccgttttcggaggcgcattttggccgcgtgtggcgtgttgtccacgtcgtgctctcggttcatccctttgtcgggccgtttcttgtgctcatgattgtctgggcgcccacgcttatcgcctcgctgcccggcctctttatgggagacacgggcgcgcaggtccgccaatggttcaactaccccaacggcacgagcgattacctacgcctgcttaaccccaacgtgctactcaacggacatcatccggtggtgcacacggccatcatcggctcgtgtgtgcagctggggctttcgctatttaacagcgccaatgcgggccttgccatctacacttgtgcccaattcgtcatcaccgccgcctgcatgtcctattccatatcgtcgctgcgcaagctgggcgtgagcctgccggtccgcggcgtcatcttgctgttctttgcgtttatgccgatgttctccaactacgcggtgctgctgaccaaagatgtactttttgccgatgcgtttttggtactgctcgttcagaccgtcaagctcgtggcatgtggcctaccccgtcgcgatgccaatgccgagcgtgcgggcgaacagaagcccgtgctctttgcgcgccatgactggctgttgctcgtgctgggtgccatgggttccacgtttttgcgcaacggcggcctggtctttccgttggcggcctgcgtgattgcggcggcgttttgcgcctgggatgtacatgtcgctcgtcgtgcggctaagcagatgggcaccacggtctcatgcgccacgtcgcgcttccgctgggtcggcgtgctcgcagtgcttgcgctctgccttgtctccaacatgtatttcaccaaggtatttatgccggcgcacgatatcacgccgggctccaagcgcgagatcctctcgattccgtttcaacagacggcacgcttcgtccaaaagcacgatggcctcaactcgggcgtcaaccccacggttaaggaggacggcaccatcgtggaagctccctgcgacggcttggtgaccgatgaggagcgcgctgtgatcgatcgcgtgcttaagtacgagaacctgggccgtcgctacaaccccgacaagtcggatgccgtcaaaaactgcttcaatgagtacgcctcgcaggaggacatcaaggcctattttgaggtgtgggcccagatgttcaaaaaggaccccgagtgctatatctcggcgctcgtcaataactactatgggtacttctatccgagcgctcgcgatgcgtgggtctacagcacggcgcgcagtgccgagatcatggcgaagcccgataacctcaagtactttgacttccatccggtcgatagcaaggttgtgcgctggtgcgaccacctgattaacctgtaccgcgtggcggtgcagcgcatcccgtttatctcgctcaccatgagctcggccacctatgtgtggatcatggtcgtcgtggtggtttacctgttgcgccgccattcgtggcgcgcgctggccatctggataccgctgctgggcgtgctcgccgtgtgcctgatcggtccatgtaacggctcgacctacatgcgctacctgtacccggtcatcgcctgcatgccttttgccatcggtgccacgatcacccgcagcgacttcctctggtcctaacttggcgcattggggtcaggttactttgcaccaaaggcttgcatcatcacgacgccttcattttggggtttatcttgcaggccggtaggtatatcataacgacgtttgtttatattgcccgagcatctgcgctgggctttaggtcgaaaccgataggagacacgtatgtccggacactctaagtgggccacaaccaagcatcgtaagggcgcgcaggacgccaagcgttccgccctcttctccaagctcagccgcaacatcaccgttgctgcccgtctcggcggtgacccgctgcccgagaacaacgccagcctcgccgctgccgttgccaaggccaaggctcagtccatgcctaaggacaagatcaagtccgctatcgacaaggcttttggttcgggtgccgatgccgccgtctacgagaacatcgtgtacgagggctacggtcccgccggtgtcgccgtctacgtcgactgcctgaccgacaaccgcaaccgtaccgccgctgatgtccgttccgccttctcccacgctggtggcaacctgggcacctccggctccgtcgccttccagtttgagcgtaagggccagatcgtcgtcgccaaggagatcctggacgagaacgccaagaaggagaccatgatcgccaacggtgctgccggtgacgaggatgagttcatgatggccatcgccgaggccggtggcgaggactacgaggatgccggcgaggagtggatcgtctggactactgccaacgaggtcatggctgtctccaaggcgctcgaggagcagggcgtccaggtcaagggctccgagaccaccatggtcccgaccaccccgaccgaggtctccggcgccgacgccaagaaggttcagcgcctcatcgaccgtcttgaggagctcgacgacgtccaggatgtttacagcaccatggacatgaccgacgaggtcatcgctgccctcgaggaggagtagcgcccgcacgggttaagccgtgcatatctgggcataatgaagcgagcatgcaagcctcgtggaatagatgagccggatccgcgtgcgtagagcaccggacccggctcttttataatgatgcgaaccgttttgcatttcgagagccgagatttgaagggagcgccacgtgcgcgtactcaaacgagccctagcgatcgtgtatcttgccgccgccatcgtggcgctgggtacgcttgtctgccagttttgggggccgtatacgtatcgctttatgctgctgatgcgcgaccccatgccgcgcgtcgtcgttgcggtgtgcgccgccatcgtggcacttggcgtgctcatcggttttttccgcctgatgtttgcacgtcgcgagccgtcctgcgtgcatccggcgggggagcgcaatatcgaggtcacgctcgcagcgctttcctcgtgcgcccgtgccgcggcggagtgcgatgatcgcgtgatagttgagcatatcgaggcacgcgttcaaggctccgacgagtcgcgcgttcgttttaaggtcgaggccatcgcgctcgacgaccgggacgtggcctctcaagctatcgcgatgcagcaacgtatcgaggaggcctgcgacaccatgctcggcacgccgggcacgaccgcacgcgtccgttttttgccgtccaagactaccgtccagaccgtggaggtttccggtgagtgataccaaccaagacaagaccgcccgcacgccgcgcctgacgatcgaccagaacgctacgccggcgagcgaacctgttgattccaaagcagaggcaaccgagttacaagacgcggcagccgcggattttgacgaggctatgggtctcatcaagggtacgggcgctgccatctggagctatgccgtgcgtcatcccaacaccacgctcggtgccgtcgctggctttattcttgccgtgttggtgctcacgctcggcctgtgggacacgctcgtcattgcattcttcgtgctgatcggcgccgtgatcggccaaattcgcgacggcgaaaacgggatcgtcaacttcttcggccgtctgtttagcggccgctaatatgtattcgactgtcgcatccgcggcaggcataaggaggaaccatggcttttaatacgaaggtcgatgtggccgataccgagctcgaggagaacgaggcggccgtcgccgaagccgaggatgtgacgctcgaggatgaggcgctcgtcgaggccgagtccgccgatgacgcggacgaggatgatgaggaaacagacgagtccgaggactcgctgacctattccaacggtgtgatcgagaagatcgttgccatggccacccgcgaggttccgcacgttttgggcatgaagggtaacctcatgcactttgtgcaggagcagtttggtgccgagaatctgaccaagggcgtgacggtcgaggtcaccgatgacaatcgcgtggtcgtcaacatctccgtcattatcgagtacggagcctatgcgcccgcgatcttcgacgatgtcaaggcacgtgtcactgagcgccttgccgcgatgaccggccttgaggtggcgggtgtcaacctgcgcatcgaggacgtcatcacccccgaggagtacgagcaccgtaccagccagcacgaataaccttccaaaaagggacaggtttgttttggcaggctttatctgcgaaaacgttaaacggccgaccgcgcaagcaaaagcgtggccggccgttatttgtatgccccccgatgtaggcataccgctcgtctaactaggggttgcaatcgtcgcgttccgcgttaccctaatgggcgcattgtttccaaattgttaacgaggagttgccgtaatggccgacgagcacgaaacagaaagcaaggcatgggcaatcgaggccgctgcggcagaggcggcgtcgcgtgctgccgaggaggtgcatcgtcctcccgtggtgccgatggagcgcgtggttgatcgcaccgatatcgagcgcggcgagcgtgccggccaaaagcgcagccaggagccgggcttcccgcgcttttttgccgagctcaatctgggcctgattcttacggccttcgccatcgttgcgtttaaaacccctaatcactttgcttttggcggcacctcgggcgtgtcggtcattctgtctacgctgttcccgaccctgcccgtcggcgtctttatgtggattatcaacgcggttctcgtcgtcttgggctttatctttttggagcgcaaggcaatcctgtggagcgtcttcgcctcgtttgcgttgtccgcctatgtttcgctgtttgagttctttattccgaccgatgtctctctgacgggcgatatgtggctcgacctgtgctttgccgtcatcttgccggcgctcggcagcgctattgtctttgatatcggcgcctcgacgggtggcacggacattcttgccatgatcctcaagcgccgcacgacgctcgagattggccgtgccctgctgttggtcgatatcggcatcgtggccatcgcggcctttttgtatggcccgcgtgtcggtctgtattgcgtgcttggcctgtttgccaagacactcgtggtcgacaaagccatcgagagcatccatcttcgtaaggtctgcacggtcatttgctccgaaccccttaaggtcgaggagtttatcgtcaagcatctcaaccgcacagcgaccatcagtcgcggctacggtgccttctcgggcaagtgcgtgacggtgatcatgagcgtgctaagccgtcgcgaggccgtgcagctgcgccgctatgcgcgcgaagtcgatccgggtgcctttatcacgattgtcgacagctccgagatcgtcggcaagggtttccgcggcacgaactagcgcggacacactcatcaaacaatcgaaaagcgcctcgcgcgttgcaaatacgtcatctaagagtatttgtcctcacattgggtgataatgatgccaaagacatcgtttgcgatccaggtgattcgctctagatacgaagggatgatttcgatgttctgctcgcagtgtggcgcccccatgggcgataacgacaagttctgcggcgtgtgtggtgctcctaatgccggtgccgctggccccgctccccagggacagcctcagccccagcagtttgttccgcagccgcccgtggcgaatgtgccaaagggctgtgtggctcaggcgttccaagatatgaccaagactccgggcgtgcttcagcgtgtatgccaaatcgcgtttttgccggcgctgatttgcgttgtgtcggtgctcgtgttgtttattcccgttattggcggcattgcggctgccatcggctttttggcagcttgcattgcgagcgtgtgcggttccggctttggtattgagtggggccgtgatctttcgctcaaggtcgatgacggcatggatcgtccgttgatgcgttccacatcgtttggccttggagtcttttcgagcgttatttcggtcgtgctcgaggttatcgctgccattcccgttatcggtgtagtgctttcgctggtggagggcgtggtaattggcgccgcgggctcgtattcttattacggctcttatgcgctcgaggctgcgctgtttggctcgcttggcttgctcgttctggctatgattgccacggcggtcctgggggtcttctttaagatgttcgccgacattgccgtgatgcactttgcggtgaccggtcgcgtcgagagcgcgttttcgctcgataaggtctgggcggcgtttaagcacaacaagaccaagctgttctgtgcttcgttccttcccgagtttttgacgggcctggtcgccaacgttgtcacatggatcttgacggtcgtctttggcgccattgcctctgtcggtatgtatagctactactatcgtcctacgggtattgaggcaattgttaccggcggtggcgtcacgctcgcgctgttcttggtgctggtcgcttttgtcaccgtatttcttacggtctttggcaagatactcaagcaccgtgccgttggctattgggccgcacgctatgcaagcgagtgggccgatgaggataaggacgacgtcctgacttttgtgttgcccttcgagaagaagtccgctccttcgggttacggtgctccggatgcttcgccggcacctgcacccgctcccgcgaccgagcctgagccggcgcccgagtctgaaccggcgcccgagcctgagacggcatctgagcccgagcccgagcctgcgcctgagcctgagcctgagcctgagccggcacctgcacctgagtcggcgttcgagccaagctccgacgaggaacctcaggacgagtagccacgccgcctgctatttggggacggggtagaaatggtagaaatagcgcttgaagaatgagcgggggcggacgtgtcgaaacgtccgcccccgctttgacatcgcgatgtggctatgactgcgagatgccagcgaatcgattacccgtcgtgcttctcctcacggcgtgcagcagcgcgtgcgtcgtggatgcccttgatcgcggcatggcgagccgttcgggcatcatggatggcgtcgcgagcctcggcggtcgtcgccttggcagagcgcaacttggcggccagatcggggttggtttcggcgaccgcggtaatcgcagggccgtcgagctcctcttgcgtgggctcggccaaaaagtcgatagcatactgggcggccaccatggagccctttgccagcacggtctcgtcgatcttgtagaagcaggaatgttgggcgtacgtggcgccaatcttggggttgcgcgtacctacaaaggcgagcacgcccggtacgcgacgcaggtactccgaaaaatcctcgcccgaaagcgtgccgcgataatggccttggccggcggggcccagacacttaattacagcctgacggcagcgctcgctcgaggccgcgtcgttttcgaccttgtagttggcgatggtgtagtcggtgagctctgcctcggcgcccaaggcggccgcggtatgctccacgatgcggcgcatgagctccggcatttcctcgtgggtcgaatcgccgtaggtgcgcaccgtgccggcgaggtaggccgtgccggcgataacgttgcgtgcggtgccgccgtgcagctcgccgacggtgatgacagccggctcgtaggggctgatctcgcgcgagacgatggtctgcagggcgttgacgatctctgcggccaccataacggcgtcgtgaccgcgctggggcatggcgccgtggcacgaggtgccgcgtacgtcgatacggaaccagtcggtattggccatgcgcggtccgggctcgcagctcacggtgccggcgtcgacctcgctccagatgtgcgcggcgtaggcgccatcgacgccgtcgagcacacccgtgccgatcatgagcttggcgccctggccgttttcctcgctgggctggaagacgatgcggacctcgccgtggatgtcgtcggtcatatggcgcaggatttgcagcgtgccgagcatcatggcgatatggcagtcgtggccgcaggcgtgcatacagccctcgttgacgctggcgaactcctcgccggtctgctcggtaacgggcagggcgtcgatatcggcgcgcagcaggatgcggcggcgtggcgtgccgtcctcgcgataggcgtcgggcgcggtgccgcgaagcgttgccaccaggcccgtcttaaggggacgctcgtaggggatattcatggcgtcgagctggttggcgatgtcggaggtcgtgcgctcctcggcgaggctcagctccgggtgcttatggaagtgccggcgctgcttgatgatatatggttcaaactcggtagcgatatcttggatggccgcggtgacgtcgtcagccgcgcgagcctcggtcgccgccataatctgctgtgccttggtcttcgtcatggtcgatttgctccttgctgggttgatcgcaaaatcgtacaggctctctccagtatgccacctgccgctagggctggtaaagttgccgtttgccgcttggggttttgttacaagggcgggggagtacactcgggggtgttgaatttcctgccagagatggggatgcccatgcaacatatcgatcggattatccgctccaagaacgtctttaccgcgcaagacggcatcgataccacccgcgagctggcgattgccatcgcaggcgaccgtatcgtcgcagtcggtgcgcccgatgacgtgatcgccgccgctcctgccgctacgtcggttatcgactacggcgagcagtttgtctgccccggtttccatgacgctcatctgcacttcttccatacctcggtcggttcctcgccgtacatgctcatggatatgggcacgtccgaggcggcgctggtgcaacatgcgctcgagttttcccaggacctgcccgacgacgcttgggttgtgacgcagggctggcgcgactaccgttgggacccgcccgagcatcctaccaaggcgtcgctcgatgcggcattccccgatcgtccctgcgttatgtactcgggcgacgggcacacgctgtggctcaacagccgcgcactcgaggcgctcggcgtcacgcgcgacagcgagccgccggcgggcggcagctacgacaaggacgcaaacggcgagctcacgggcattgctcacgaagcggctgccatgcagctgttgccgcgctgtcttgagtggctgggcgaagatcgcatcgcaagcgcttacgccgatcaaatgaggcgcatggccgagcagggcatcacctcgatctgcgatatgtcgctcatgcccatgccgggctgtgattttatccgcgacgatgtctacgacaagctgcagacgaccggcaagctgggcatccgagcccatttgtttcccacgctgctggatgaccaatcgcgcttggaagagctgcaggtacgttacgcgaacaacgcgctgctttcggcgccaggctttaagcagttcttcgacggcgtgtcgagcgaacacacggcctatctcaccgagccctataccaacccgcgcttcccgggcgatcaaggtcgcctgacggttcctgccgagcgcatgcgcaagctggttctggcggccgcggagcgcggccataccgtgcgcatccacgtcatcggcgacggtgcgattcatgccgcgctggatatcttcgaggaggccgccgacctgtacggcctgccccagcacggccataacacgctcgagcacctggagaacctcttgcccgaggacatcgatcgtctacgcaagcttaacgtcgttgcctcgagccagccctgtcacattacactcgacccgggcggccccgagcgcgatctgggcctggaacgcagccgcatcatgtggccgtttgcgacctataagcagcgcggcatccgccaagccttcggcactgatagccccatcacagctgttacaagcatgaacgtgctctacacggctatcacgcgccaggatcccaaaagccactggcccgagggcggctggttaccgagcgagcgcatcgatgcagcaacagccctgcgcaactacaccctgggcagcgcctatgcagcgggcgacgagcaaaacctcggcagcttggagcccggcaagtatgccgacctggtagtcctggaccaaaacccgctcaccatcgacccccaagagctccaagacaccaaagttcaggcaacctacctggcaggtaacttaatctacgagcgttaacccggtggcgcgcgcagacgtggtgtaagagtgtcctgaggtccgtcgctgcaagcccgcgattggcgaaaatgcgttggtggaaatggtgaaaattatattgacgctaacacgaggtccctgagcccctcgatctcgggggacggcacccataccggggagatatcgtgcgacagtatcgccttggccatcctggccgcgtcgttgcggtcgttcttggacgagaggtctgccgccgacctcgggaccctggagacggccgcgacgacgcagtcgacgccgagcccggagagctccctctgcggggcgaagccgaggtagccgctctcgtaggcggcgagcgacgggccggggaagcccgacatccactccgcgacctcgccccaggggttgccgcggaacctcctcgtcacggcctcgcccgtctccgcgtcgagcgcgcagacggtggtggacctgaggtgtacgtccattccgaaggcggtagaatatctaggcacgggagcctcccaacctcgttgcggcgcggctgcgcctctggcacttcaacaacattgtcgcagccccgacccgcggtcacgagcgggggctcctgtcgtttccgtgcccctggattgggtcatagtgtctgactctgccataacatcggcatttctttggttgtcgatgtggtcgttggggacgttcttgttcgactggtcgtttaagaacgtcctcaatgactaccttgcatcaatctaataagttgcggtgagatagttcttgaattggccttttttgaggctaaacaggaactatctcaccgcaactgcgttgagtgttttttggcagctggtttacttgctcgcgaacagccagatcaggacgatcacgaggattacggcgacaatgcaggcgatggctccggtgaatttgacgcgtgagtcgcgggttcgcttgcgtacgtcgtcttcggcggcctcgagttgggcaacttcgcgctcggtctcggtatactcggccttgtcgcgtgccaaggacccggcgagcgattcggtgatctcgggatggtcgtgcacctcggtcgcctgctcgataatcgactgcgcatgcgcggcatctgcccgggcgtttgcgatggcctgctcttgctcgcggcgtgccttgtcctgtgtggcgatcttttcgcgcagctcgcgctggcgcgtcgcggcggcagtttttgcggactgcaactcgtcgcgcgcggcatctgcctcagccgttacggcctggtgcgctcgtttagcgtcagcgatgggggcctgtgcctgctcgacggcctgctcggcggcggcgagtgaatgctcaagatcggcggtcacgcgcggaatatcttcctcggccttgcggagggtgtcggcagcgtcggagatttgcatagacaactcgctggtgcgcacggtgtaattggcgggatttgccgaagggttgcgctgcagctcggcatactcgcgacgcaaggtctcgagctgcgcgcgcgtagcatcggcagtttgtcgtgcggcggcgacaccggcatcgcgctcagccttcactttgtcgcggatgcgcttggaatcctcaaggcgacgaacgaggcggttgccggtctcgcgcgagctcgcctcgcgggcttccacggcgtcgagtgcagccttcaggcggagctcggtcgcatcatcttctgccttcatttgctcgagctggcccttgagctcagtcgctttggcggcacgggcatcacggttaatttcagctgccgcagcggtcttttgtgccgcggcaatcgcctggcgttgatcggcgatgatctgatcgtagcggtctgcgatgtcctggcgcgtctcgagctcctctgcctggtcggcgatgcgctgctcaagctcggctaaatgggcgcgggcatcggcgagtgccttcttggcggcgttcatctcgcgcatggccgacgcgccctgggcgataaaagtgcccacggcgttagcggtgtttgagacggcgctccccaggtcgcggctcgtggcgggagcatgcgaggtggttgggtgtgcggccttggcggcattcgcatcggcagtctgcggcgcggcgatattgccggtgccgccttcgatcacggaaaagcccgctgcgtgcgggtcgaccgcgtcggcgccgatcgtggggtgctcgagttgcaggaacgagggcatggtgctgccctggtcggcaaccggggtctcgccgggcacaaacgtcgaggcggcctcggctgcttcctcttcctcggcgtcgatatcggcatcggcgacagcgtccttcatcgctttgacggcatccatcatggagtccatgacggcgtcgagctcttcttccgaagacacctcgatggggcctgctacttgcggagcgttctcggccttgggctcagtatcgctcgggttcggctgctctagctgctcttctttgtcttgctctgcggcgacatttgcgtctgcggcctcgcctgcggcggcaggagcctcctcgacggcggcatcaatgctgccatcgctgctggtagaagtatcgcagtcgtcaatggtgtctgcggaatcatcaatatgctgttgagtctgggggtccagctcgtctgtcataggcatgtgctcctcatcgttgtttgtcaccctatgataaagtctcgcgccgacatcccgcgccccgcagcaaagtttcaaaacgtgttcgatgactcgtcgcgttaacaaaaactcggccgctctatccaatttttacttgacattcccttcgccgaaagacgttgcgccgttcgcccgccatgggctttatttttcacttgaagaagctaaagttgcatttcagcttttggcgcgtttattttggatgcgcgcagtcggcgggcgtgcccgtcgcgattttgaaaggacttcgtatgggacttttcactggtaagaccgtgatcgtcaccggcggcggcaaggccacgctcaaggacggctccgctggctccatcggctacggcatcgatatcgcttttgccaaggagggcgcgaacctcgtcatcaccggccgcaacgtcgccaagctcgaggccgccaaggagtctctcgaggctgagtacggcgtcaaggttctgcctgttcaggccgatgtttctgccggtcaggacaacgaggccgtcgtacagaacgttatcgacaaggcgattgaggagttcggccgcatcgacgccgtcgtcaacaacgcccaggccagcgcctcgggcgtgaccatcgccgaccacactatggaccagtttaacctggccatttactctggcctgtatgccacctacctgtacatgcagaaggcctatccgcacctgaaggagaccaagggctccgtggtcaactttgcttcgggcgccggcctgtttggcaactacggccagtgcagctacgccgccgccaaggaaggcatccgcggcttgacccgcgtcgccgccaacgagtggggcaaggacggcatcaacgtcaacatcgtgtgcccgcttgcctggactgctgcgctcgagaacttccaggatgcctatcccgaggcgttcaaggccaacgttcacatgccgccggcgggccactacggcgacgtcgagaaggagatcggccgcgtggtcgttcagctttgcggccccgactttaagtatatgaacggcgagaccgtcaccctcgagggtggcatgggccagcgtccgtaggggttacgcggttttaccaaaccgcgtaacggctcgacgctgcgcggtcaccagagcgacaacttgtcattcaaagagggcggcatgaccagaaggtctatgccgccctcttttcatgccaatttgttcgctctggcgaccgctcgctgacgttgccagggcatcggcgtttgcgttgctgacgaaaagtagtcgttggggacgttcttaaatgactagtcgaaggggacagtcttgtcggcacttggggacggtccctaagtgccggcagattgggacactcctttgcaagatggcgctgaaggctgtccccaacaactagtcgtttaagaacgtccccaacggctagttgtttaatgcgccagtttctgtcgagtcggtgctccttgcgggttgcccgtataatggtttgcgtatgagccgcaaccaaggagttccagtttatggaccagaacctttttaaattcgacctgatcgccgaggacccgacgacgcacgcgcgtgccggcgtgctgcacaccccgcatggcgacatcgagacgccgatctttatgcccgtgggcaccaaggcaaacgtcaagggcatccccaccgagaccgtcaagcagctcggtgcgcagatcgtgctcgccaacacctaccacctgtccatgcgtcccggcgaggacaccatcgctgagctgggcggactgcacaaatttatgaactggcatggccccattcttaccgactcgggcggcttccaggtgttcagccacaacgacgccgtcaagctcaccgacgagggcgtacgctttatcgtcaacgactacgacggtcgccacgtgttctggacgcccgaggacaacatggaaatcgccatgaagctcggctccgacatctgcatgcagctggaccagtgcccgggctatcccgccacgcgcgcctacgttgagcgcgccgttgagctgtcgagtatgtgggccgagcgctgctacaaggctcacacccgcgatgaccaggcacttttcggcatcgttcagggtggcatgcatctggacttgcgcctgcgctcgctgcgccatctggaggagtgcggtgacttccccggctacggcatcggcggctactcggtgggcgaggaccacgagaccatgttcgagaccctggcgccgctggcttccgagtacatgcccaagcacaagccgcgctacctgatgggcgtcggcaaccccaccaccctcgtgcgcggtgtgggcgtgggcatcgacatgttcgactgcgtgctgccgacgcgcaccggccgcatgggcacggcgttctccagcgagggtcgccttaacttccgcaacgcgcgttttgcgcacgacgacggtcccatcgatcccacctgcacctgcccggtgtgcacgggcggctacagccgcgcgctcatccgtcacatggtcacgcagaaggagatgctcggcggtattctgctgtcgatgcacaacatctactacctgctcaaccttatgcagcgtgcccgtcaggccattatcgagggccgctacggtgcgttcgtgagcgactggatgaacagccccgcggcggtggattactaaggacggcgcggacgcttgcggagcgcgggcaacggcaaaggccaagcggcgatcggtcgtcgcgttcgctaacatggtctgcaagaccgctgaccgatgtcttgcaagcgcttgatgcatcgtgggtaccataccgaatggttgatgttcgggcgggtgtttgacgcatggcgtcgaccccgcccgtttctgttttcgataggagtacccatgattaagaatgggaacgtcgagggcgagcccgcctacgacgagacgtaccgccgcggccccgtggtcatgcgcggccccatgattcctaaggacaacacctacgccaatctgctggcgcccgaggactcgaccgactggctgcatgccgatccctggcgcgtgctgcgcattcaggccgagtttgtcgatggcttcggcgcgcttgccgagctcgggcccgcggtgaccatcttcggtagtgcccgcacgcccaagaccgatccgctctacaaggcggcgcgcacggtcggccgcaaaatcgcccagcgcggcgtcgcggttatcaccggcggcggccctggcatcatggaggcggccaacaggggagcggcgagcgccaacggcaagtcggtcggtttgggtatcgaactaccgcacgagcaggggctcaacaaatacgtgaacctgggtatggacttccgctacttctttgtgcgcaagaccatgttcgtcaaatacagctcgggcgccatcgtgtttcccggaggttttggtacgctcgacgagatgttcgaggtgctcacgctggtgcagacgcacaaggtcaagcgcatgccgctcgtgctggtaggcagcgagtactggcagggcctgttcgactggctcaacggcccggtgatggatgccggtatgatcagcccgctcgatcccgagctcgtacacatcaccgacgacctcaacgaagccgtcgacattgccctgagtgggctgatgtagggcaatcgtgcccaccgcgatatgaatatatatagcaatctgatgctatctaacgtcagtttgccatttatattgggtatactgatgcaaaagacgagggcgaggaggtcgcgtatgtctactgcaacggttaagcctacgacggttcgcatcgaagaggggctcaaggagcaggcgactgagttcttggattcggtcggcctcagcctcaattcctatctgaatcttgccgttcggcagcttgtaaatcagcgaaagattccttttgagatcgtaggaagggcggaagtgcccaacgaagcgacgaggcgtgccatggtaatcgccgaggctcatgagttggggattttgccggacgatagcccgtcattcaacgacgctgatgagcttatgtcgttcctcgatgaggactagcgatgtttgagattaaagtcgaggctcagtttaaggcggattacaaacggacgatgcgcatccatccgcagctaaagagtgagtttaaagcggcggttgcagagcttgtggcccatgggtcgcttccagcggagtacggcgcccacgagctctcaaacccgggcggaaactacaacggccacatcgatttccacctatccgatggcttggtcgatgtggtcgttctttatcttccccataagactaacccagtgattaggctggtgagaatgggcactcatcaggagctgtttcagggcccgctgggctgatcgccgatttctaggttgcggtggaatagggattgatttgcggctgataagccaaaaatagtccctattccaccgcaagcggtaaaggtgcccctagtggatgggctggtagcgggggcagtagctgatggcgatggcgtcgacgcctacatgggtggcgatggtgcagccgatggggccggtgccggcgtctacatagtcttggcctgcgagcgcttggctgacgagctcctgctcctcggcggcgccggtcgtgagcacgcgcacgctggagcccggatgctcagccaaaaatgcgaggcaatcggccatggtgttggtaacgatgcgcttggcaccgcggcccttttttatggccttgatctcgcccgatttccactccggcgaaacggccaggcgaatgttgagcatttgcgtgagctggccggcgagcttgggcgcacggccgttcttgaccaggttctcgagtgtgcgcggaatcagcagcaggtgggcgtcgggcagcgtcgcgcggatctgagcctcggcctcgtccaggctgcggccgtcctcgcgcatggcgagcgcgtactccaccagcaggccctcggcgcccgagccggtgcgcgaatcgatgcagcgcacgtcgagctcgtgggtatcggccacctggcacgcgttggcgtagcaggcggaccactcgctgcacagcgagataaagatggcgctgtcgtggccgtcggcgcgcacgcggtcaaagagtgccttgaactcgccggcgctcggctgcgaggtgtgcggcagctgctcggagccagccatgcgcgcgacgtactcctgggcggtaatctgcacctggtcgagcaggtcctcgccctcgataatcacatgcagcggaatcacgtaaatgccgagctcttgagcacgggcgggggagatgtccgacgtggagtcggttatgatggcaaaagacataattgcacctttcgttggggcgcgacggcgccgccttctgagagcaaagtgcgacaagtatagtggagtcgttccacatttctaggttcaattgttgaatagtcaacagtttgaagtgtcggtgtggaaatcgtcaactggggaagagggatgccgatggaggcactggagatatgcaggcggccggtcgtgctgtttgatttcgatggcacggtggccgatacgggtcgggcggtgatgacctcgacgcgcaagacgctggctacgcgcgggttttcggaggcgcagatgggtgatctgcgccgcatgatcgggccgcccctgtggaagagctttcacgacttttacggcttttcccgcgaggagtcgcttgtggtggccgatgagtatcgcgtcttttttgatgagctgggaccggaggagtatcccgtgtttgacgggatccccgagctgctggatgggttagccgcccggggcaagcgtatggccgtggcgacgtcgcgcatggaggcaaagtgcatcgacatggtgcgtgagctcgggctttctcagtttgaggcggtggttggcatgaatccgccgcagggtcgcgagaccaaggccgattcggtccgcgatgctctggcggcgctcggcgcgacggccgacgttgccgtgatgatcggcgatcgctttaacgatgtggagggcgcgcacgcgatgggcgtgccgtgcattggcatctattcgggcgcggcggcgccgggcgagcacgaggcggcgggtgccgatgcagtggtgcactcggtggccgagcttgctaaacttttcgctatataagtacttgatgtgaggggcgggcgtacccgtcgctcattggtaaggaggcagtccatgaatcaggtggagcagagcgtcgctgagtatgtcgacgaggtctgggaagatgtcgtcgccgatatcgaacaactggtgagctatccgtccgtggccgttgctgccgatgcggagcctagcgcgccgtttggccgcccggttcgtgatgcgctcgattgcgcgctcggcattgcgcaaaagctcggctaccagacgagcgacgacgagggctatgtgggcattgccgatatcccgggtcgcggcgacaagcagctcgcgaccatctgccacgtggacgtggtgcccgccggccccggctggaacaccgacccgtttgcgatggagcgtcgcgagggatggctgctcggccgtggcgtgattgatgacaagggtccggcggtgttgtcgctctacgccggtgcctacctgctcaagcacggcattgtgccgcgctataccttccgcgcgctgctgggctgcgatgaggaagtgggcatgtccgacgttcaccattatctggagaaccacgcagaccccgactttttgtttacgcccgatgccgagttcccggtctgcaatgccgagaagggccagtttggggcgacgtttgtgagccccaagatcgatggagggcgcatcgtatcgtggagcggtgccgaggcgagcaacgccattccgtcgcagtctatctgcgagcttgcgattgccgccgatgaactgccggcgcccattgagaacgccgaccgcctggagatcacggcgctcgagaacggccatgcccagattttcgcgcacggtatcggtggccatgcttcgatgcccgaggggacgatcaacgccgtcggcctgatcgtgacgtacctgcgcgaggccgaggacgcgtttggtgcccgtgacgagcgcctgctgacgcctgccgagcacgagttcgtcaagttcctggcctttgtacatgcagacgcctatggccgcggcttgggtatcgatgcgacgagctcggcgtttggcccgcttacctgcaacgctggcgtcatccgcgtggcggatggccatattgagcaggtcatcgacgtgcgcttccccgacagcacgagtgccgataccatccgcgagcagctcgacccgctcgtgggccgttttggcgtgacgtgccagctgggtcgcgcgaaggtgccgttctcggtctctgccgacgatccggccgtgaaagcgctgattgatacctataacgagtttacgggtaagcatgccgagccctttgccatgggcggcggcacgtacgcgcgcaactttgcccgcgccgtgtcatttggccccgaggagaccggcctggagttgcccgcatggggcggccagatgcatggccccaacgagtgcgccaacgaggaacagctcaagcaagcgctcaagatctatattgttgcgatcttaaggctcaacgagctcgagctttaaggttgcggcgttttgccaatctaagttgcggtggaatagttcctagaatcggctgcctaacagccaaacaggaactatttcaccgcaactttgcttttattggtgtaaaaggtgcgccatatttggcgctggattgttattcgtttgtaaagccctgccgcgcttgcggtaagggtttatcaaatgcccgtaagaaaccgcagttggcgcgggtgctgcccggtcggggtcgtatctttccaaacagcaaagcgggcagggtgcccgcgattcgcatgtacgaaaggaagatcatgctcgatcaggcttattctcgtcgtcagttcctcggcctcgctggtggtcttgccagcatcgtcggtctcggtctcgttggctgcggcggcgcaggcgcatccgacgccgccgacaagggtagcgccgctgctgccgagtccgtctccggcgaggtgacctacgacggtgcctcctcgttccaggctctcgtcgaggccgctgccgagaagttcatggatgccaaccccgacgtctccgtctccggctcgggcaacggttcgggcaaaggtctgaccgctgttgccgccggcaccgtcaccatcggtaactccgacgtcttcgccgagaccaagctcgaggccgaccaggtcaagaacctcgtcgaccacgaggtcgccgtcgtgggcatgggtcccgtcgtctctaagaacgtgaaggtcgacgacctgtccctcgagcagctcaagggcatcttctccggccagatcaccaactggaaggaggtcggcggcgacgacgccaagatcgtcgttctcaaccgcaaggccggttccggtacccgcgccaccttcgaggctgccgtctttggcgacgaggcagtcgactttaagggcgacgccgagctcgacaagtccggcgacgtccagactcagatgggcagtaccgacaacgccatctcctacctcgacttctcgcacttcgatgactccaagttcaacgccatcaaggtcgagggcgtcgagcccaagagcgcaaacgtcaccgacgactccttcaagatctgggctaccgagcacatgtactgctccaaggacgccgacgaggccaccacggccttcctggagttcatgctttccgacgacgtccagggcaagctcgtcgaggagcagggctttatccccgtctctgccatgaaggtcgtcaaggacgccagcggcaaggtctctgctaaataagtaatcgcccccggaaaggtttgcaatggcaaaacagctgccaaagcgcgaccttgagaacgtgggcctgagcgtcacgggcgcgtgcgtagcgctcgtgacgcttgtcgttgccgcgctcatctttatggtcgcccaaaagggcctctcggcttttatcaaggacggcgtctcggtcgtcgagttctttaccggcaccaagtgggacctggccaacacggccgaaaacggcctgccttataccggcgccctgcccctgatcgtcacctcgtttgcagtcatggtgctctccacgctcatcgcgctgcccatcgccatcggctctgccatctttgcggtcgagatccagcctaagtttggttccaagatctttcagccgcttattgagcttttgaccggcattccctcggtcgtctttggcttgatcggctttcacgtggttgtcggccttatgaagagtgttttccatgtgagcacgggcctgggcatcttgcccggcgccatcgtgctggcggtcatgattctgccgacgatgaccacgctttcggtcgatggcctgcgcgccgtgcccgacggctaccgacagggctcgctcgcgctgggctacacccgctggcagaccatctggcacgtggtgctcaagtccgccatgccgtcgctcatgaccgcggttatcttgggcatgacccgcgcctttggcgagacgctcgccgtgcgcatggtcatcggcggcatcgaggccatgccgacgtcgctgctgtcgccggcttcgaccatcaccaccacgctcaccacgtccatggcggtctacgccgagggctcggcccaggacgacgtcctgtgggcactcggtctgctgctgatgggcatgagcctcatcttcatcctgatcatccatctcattggccgcaagggggcgaaggctcgtggctagcacgcgcatccacatcgacgaggcgaggctcgggcgtgtccaaaagcaggatcgcatcgccacgggcgtgctgacggcgatcgtcgccatcgtcatgctcatcgtcatctccatggtggcctatatcctgtttgagggcatctcgacgctgttccagccgggctttctcacagagccgtcgcgcgccaacggaacgcagggcggcgtgctctaccagctgttcgactcgttctacctgctgctgatcactctgatcatctcggtgcccatcagcctaggcggagcggtcttcctggttgagtacgcgccgaacggccctatccgcgacatcgcctctaccgccatcgagacgctgtcctcgctgccttccatcgtcgtcggcatgtttggcttcctggtgttctcggtgcagctgggctggaagtactccatcatctccggcgccgtcgcgctcaccatgttcaatatccccattctggtgcgcgtgattcagcaggcgctcgaggacgtgccacaggcccagcgcgatgcatgcctggccatgggccttacccgctgggaggccacgctgcacatcctgattcccgaggccatgcccgccatcgtgaccggcatcgtgctttcggccggccgcgtctttggcgaggccgcggcgctgctctttacctcgggcatgagctcgccggtgcgtctgaacttcttgagctttaacctgtcgagccccacctgcgcctggaacgtgttccgccccggtgagtcgctcgccgtgcacatctacaagatctatggcgagggcagccccgaggcccagcagatcgtttggggcaccgcggcgctgctgatgatttgcgtgctgctgtttaacgtagtcgcccgtatcgtgggcaaacaactggcaaggaagatgacggccgaatgagcgagataaatgcaacgcccgcaactgaggcggcatcgtccgagacccaggactttttgtcgagcgtgggggagagcgagaagcgcgtgcgcgcgagcggcaaggccgtgagcgacgaggtcgtgctctccaccaaggacgtcaacgtgtactatggcgaccaccatgcactgcacaatacgtcgctcgactttcacaagggcgagatcacggcgctcatcgggccttcgggctgcggtaagtcgaccttcttgcgtagcctcaacctcatgaatcgcgagattcgcggctgccgcgtggagggcgagatcaactatcgcgggcgcaacgtgaacaccaagaccgaaaacacctacgagctgcgccgttccattggcatggtgttccagcagcccaacccgttccgcaagtccattcgcgacaacatcacgtttgcgcctaagcgccacggcatcaccgaccgcgacgagctcgaccgcatggtcgaggaaagcctgcgcggcgcggcgctttgggacgaggtcaaagacaagctcgacaagagcgcctacgcgctttcgggcggccagcagcagcgtctgtgcatcgcgcgcacgctggcgctcaaccccgacgtgattctgttcgacgagccctgctcggcgctcgaccccatctcgacgctggcgatcgaggacctcatgtcatcgatcgtggccgaccgcgccatcgttatcgtgacgcacaacatggagcaggcgtcgcgcgtgtccaaccgcacggcgttcttctacatgggcgatatggtcgagtacgacgagactgacgagattttccaacggcccaaggataagcggctgaatgattacctcaccggcatgttctcctagtccgggacatgcttgaggcccgcggcggccacggttgccacgggactgattggagaggcgggtcatctcttttgggagatggcccgcctttttgtgtcgtgtgcggcccgccttttcgctgctattatggacaacgttgaatttctacgaaggagcagggcatatggcgattcttttgggatgcgattccgtcagcctagagtttcccaccaagcatattttcgatagcgtgacgctcggcgtgggcgagggcgaccgtattggtattgtcggtaaaaacggcgacggcaagtcgacgctgctgagcgtgctcgccggcacgctggagcccgacgacggccgcgtgacgcatcgtcgcggcaccacgatcggcctgctcggccaaaaggaccagcttgtcgacaccgacaccgtgcaccatgccgtcgtgggcgacacgcccgagtatgagtgggcgtcgagcccccgcacgcgccagatcctcgccggtctcattagcgatgtgccctgggagggcacggtgggcgagctttcgggtggccagcgccgccgcgtggacctcgcgcgcctgttgatcggcgactacgacgtgctcatgctcgacgagcccactaaccatctggacatgcgcaccatcaactggcttgcacgccatcttaaggctcgctggcagcgcggtcagggcgccatgctcgtggtcacgcacgatcgctggttcttggacgaggtctgcaccagcatgtgggaggtccacgacggccaggtcgatcccttcgagggcggctactccgcatatatcctgcagcgcgtggagcgcgaccgcatggccgcggttaccgaggaacgccgtcgcaacatggcgcgcaaggagctcgcgtggctgagccgcggcgcccaggcgcgttccaccaagcccaagtttcgcgttgatgccgctcgcgagctgatcgccgacgtgccgcccgtgcgtgacgagctggagctcaagcgcctcgccgtgagccgcctgggcaagcaggttatcgatgtggtcgacgtggacgccggctatgcggataccgatggcgcgcccaagcaggtgctctctgacgtgacctggctcattggtgcgggcgaccgctatggccttttgggcgagaacggtgccggcaagtcgacgctgctcgacgtgatccagggcaagattgaacccacgcgcggccgcgtgaagattggccagacagtgcgctttggcgtgctgtcgcagcagctcgaggagctcgaaccctacatgggcgacacgatccgcgaggtgctcggcaactataagaagtactacgtcatcgacggcaaggagacttcgcccgagaagctctgcgagcgtctgggctttacgacgcagcagctctggagccgcatcggcgatctttcgggcggccagcgccgtcgcctgtcgctgttgctgacgattctggacgagcccaacgtgctcatcctggacgagccgggcaacgacctggataccgacatgctcgcgattgtcgaggacctgctggacggctggcccggcacgctgatcctggtgacacacgatcgctttttgatggagcgcgtgaccgaccaacagtgggcactgctcgatggccatctgacgcatatgcccggcggcgtggaccagtacctgcgcctgtgcaacgctaccgccgagggcgagcccgtgggcgcgccgagcgctaagaccggcacgttcgacaccggtgcggcggctgctgccgacaagcccaagtcgagcggtcagcccaacggcctttccaacgccgagcgtcagaagctccgccgcgaggtgagctcgctcgagcgcaagatggagacgcagcgcgcccgcgtggaggaggccgaggccgccatggcccaggtcgatcccaccaactacacggcgctcggcgagcagcaggcaaagatcgacgaggctcacgccgccatggacgagctggagatggcgtggctcgaggcgagcgaaaagctcgagggcgaggagtaggcgagaatgatcaaagccgcgtttttcgatatcgacggcacgctgctgagctttaagacccaccggattccggcgtcggcgcagcaggtgctcgacagctttcgcgagcaggggattgcgtgcgtgatcgccacgggccgtccgacctaccagatgccggactggctgttcgacctgggctgggatgcgtacattacgctttcgggccagcactgttttgatgccaagggcgtctaccgcagctgcccgatcgatccggacgacgttgcggtgattgtggaccaggtggcgcaggggcgctacgactcactgtgcatgcagggcgagaactcgtttgtgaaccgcctgtccgagcgcgtggtgacggctggcagcaacgcgggaatcgtctaccacgaggagccgtttgagcatgcctttgacgcgccggtctatcagttctgtgcctttgttgacccagttgacgagcatatcgtgaccgatgccgtgtcgcattcgctcaccacgcgctggtgcgacctgttctgcgacattattccggccaacggcggcaaggacctgggtgtggcggcgacgctggagcgcctgggcatcgacgcgagtgaagcgattgcctttggcgacggcgagaacgacctgtcgatgttctcggccgtgggcacaagtgtggccatgggcaacgcgcaggacacggtgaaagctgcggcgacctacgtgacgaccgccgtggacgacgatgggatctacaacgccgcgaagtactttggactgctatagctgcggctcggcacttggggacactccttgcggggcgtgttcccattttgttttcgtcccgctcgttttgtgaaacacggctaacttttaggcaaagtagtaagacatgggcaacttttgcggtaaagtaagccgtggaaagtatccaaaggctaactagcaatcatcgcgaaaggcggcccatggccctacgtgaatccggagaagactatctcgaatcgatctacgttctgtcggaacgccagggcatcgtgcgctcgatcgacgttgcggagtacctcggcgtaaccaaggcgagcgtttccaaggccatggcgacgctggaaagcaacggctatgtcgaaatgggcaagcgcgacgttcatctgacggagcgtggtctggaggtcgctcgccaaatgtgggagcgtcactgctttttcgtggggctgctggaggatgcgggtgtttcggctgaggtcgcgtcgcaagagggctgccacatggagcactgcctgagcgaggaaagcttcgagaaactgagggcgatgctgaaccggggcgaggcgacgggccaagcggcggaatcctaacgaacccccagtagcgcggagttcgcgcaaagcgcgaaccagcgaccgggaccagcggtcctttcggccaagtccatttcagcaaaggaaccccgccagcaagcgatgcccaagaactgccacctacgtcaccgcaggccggggccgggtttggttttgaaaacactccacagcgcgaggcccgcctttccgttgctccgcaggagcaggaaagacgggcctcatgcgcgaggacgttttcaaaaccaagcccggtcccggccggacagcccacgaacgctacaggttcttgacacccatcgcgcgcatggcattcaggatggcgataatcgccacgcccacgtcgccgaacacagcaagccacatgttggcgatgcccagtgccgcaagcaccagaatcagcaacttaatgcccagcgcaaagatgatgttctgccaaacaatcgacatggtcttgcgcgccacgcggatcgcgcgggagatgttggacggcttgtcatccatgagcacgacgtccgccgcctcaattgcggcgtccgagcccatagcgcccatggcgatgccaacgtctgcgcgggtaagcacgggtgcgtcgttgataccgtcgcctacaaaggcgagcttgcccttgcccgattctgctgcaagcagcgcctcgacacgctcgaccttatcacccggtaacagctgcgcgtggaactcgtcgagccccagccgcttggccaccgcagcagccacttcctcgcggtcgcccgtgagcatgacggtgcgcttgacgccggcggcgtgcaggtcgcggatcgtctgctcggcatcggcctttatggtgtcggcaattacaatgtggccggcatagatgccatcgactagcacgtggaggatggtgccgacgacctcgcaatcgggcgcttcgactccggccgcggcgagcatctttgcgttgccaacgacgacgtgcttgccgtcgatggttgccgtcacgccatggcccgcgtcgttggtggagtcgcttacgcgcttggggtcgacctcgccctggtaggcgacacgtacggactgcgcgatggggtgatcggagaacgactcagcaagggctgcgacttcgagcaacgactgctcggtatagccggcctcggggtgtaccgcgaccaccgagaacgtgccgttggtgagggtgcccgtcttgtcaaagacgacggtgtccacgtcggcgagcgtctcgaggtagttagaacccttgatgagaacgcccagcttggacgcgccgccgatgccgccaaagaagctcagcggcacgctgatcacgagcgcgcacgggcagctgacgaccaggaaggtcaggccgcgcaggatccagtcggaccaggcgccggtgaccaagccgccgccgagcgcgagtaccgcggcagcgccggtgacggcgggcgtgtagatgcgggcaaagcgcgtgatgaagttctcggtgcgcgccttcttttcgctggcgttttctacgagctccaggacgcgcgcgacggtggactcgccaaagggcttggtggtgcgcacgtggatgagccccgtcatgttgatgcagccgctgatgatatcgtcgccggacttggcggggcgggggactgactcgcccgtgagcgcggcggtatcgagctgtgtctcgccctcgacgatgacgccgtcgataggcacgcgctcgccgggcttgacgacgatgacggtgcccacggcgatgtcatcggggaagacctgctcgagtgtgccgtcgggttgctcgacgttggcgtagtcgggtgcgatgtccatcatggcgctgatcgatttacggctcttgcccacggcgtatgcctggaacagctcgccgacctggtagaacagcatgacggcggcgccttcggccatgtgcggatcggtgtcggggaagagcaccatggcaaacgcgccgatggtcgcgacggccatgaggaagctctcgtcgaacgccttgccgcggcggatgttgttgtatgccttttggagcacgtcgtagccggcaatcaaaaaaggcacgaggaacagtgcgaagctggcgtagatgtcgcccggggtgccgaatgcggcagtgagggtgccgagctcatcgagggcgtacaccacggcaaaaatgcccagcgctaccaggatgcggttgtgcttatgctcgagtgactcttttttcttgcgcttcttctttttcttcttggggtcggcggtggccatgactcgtatcctcccatttgaatgtatgaacactcgctcatataatttcgcgagcaaaggccgcggcaagcgcggccttgcgggttggcgtaaaccttggctagagaatgatctcgcagtccggctcggcgtcggcggtgaactccacaacgcggtcgaggacctcgtcgaactcggcttcatcggcctcgagcgtcagcttctgggtcataaagttgaccgaaacggacttgacgccatcgagcttggccagctcgtcctgaagcttacgcgcgcagttggcgcagtcgatctcgtcgagcttgaactgctttttcatggtggattcctttccccgtatttgcggcttgggtgcaggccgcgctggtaccgtggttggtcgctattcgcagatgtggctcatgccctggttgagcatggtgtagacgtggtcgtcggcgagcgagtataggatattgcgcccgtcgcgccggaatttaaccaggtgcgactgcttgagtgtgcgcagctggtgcgacaccgcggactgcgaggtttcggtcgcttcggcgatgtctgctacgcagagctcgcggcccatgagggcatagaggatcttgatgcgcgtggtgtcgctgaagaccttgaacaggtcggcgaggtcgtagagaagctcctcgtcgggaaggtcctcgggcgagcaggtggtggggatcgcgggctcggtggcctcgatgtcgggcttcgtttcatcaacgcggatgctcattgcaatatcccttcatatgaacatgcgctcatataacttgcttccgattatatgagtgtatgttcatatgtcaatacaatttgcgttaatttcgatgactgcttgccgcttctgcgattttctgtgggttgggagacatcgacgcaatgctcgccaacatatttcgagatgttcggctagcatgctaagaaagccaccttgagaagcattagaactgttcatatttgtactttatcgtgtcaaataccgcgagaatcagttcttcctctacgggagtttctgcagaatcagttttatctaaagttatattgagcattgctgcagccaatctggcacatcggtggccgaataagtcgaaaaatgtaggtggacatccgcagagatcgcctttagaagagcgaattctcaattagatcaataatcgtgtcgtcgtccgtgcggttttcatcgatttttgcgaacatgtcgcattcccaagccccattgatttcctcagcaagggccccgacgtgttgcatgtcgtcgggttcgggcacatcgttgatgctcgggtcatcagcttgcggatattggcttgcaatttcgcgcttggcggcctcttcttctttgagtgtctccaggacgcggcgaccgtattcgaagtagcgccgcaagacaaattgacgaagagtttcttgcaggatggcgaagttatccgggagtcgaccgggccatatcttctcgcgaatgcgaatcgcttccatgacccgtttaaaagcggactgcttgaaaaacgaatgacgattaaccgtgataacggcatatcccatgtttcgcagcgtgtttcggcgctcctcgtcaattgattgctgctcgggttcgtcgtggtaaaagccgttgtattcgatatcggtcatcgaattttcgagcagcgcgtcgaggtagaaaaccgtccgtcgcgttagggcggcgtatcttttggggactgggatcggataatccgttttgatagcgcgtatggctaagccacccattgacttgggcattgtcagcatcatgacaaacgccgtttcgagtggggagcgacagccttcgtgtacataagaaagtgccttaagtgctttattagatccacgataccccggtgcctctgaaaagaaggctctgagctcttcaacgctggttagggctgggcgctcgcgatattgagtttcgtcggacgttccaagcgcgtaggagccgcagatttcaaagtaatactcaacgagctccgaaaggttgaggtcggctgttgcttctaacgcgcacagcttgatatcgacgatgtagacgttcggctcgagttctaggtagctttctgcatcaaacgtatagcgcgtgcagtggcagatgcagcccttgcggtgccttttggcattattggaaaacgtcagcacatggatacgttcagaatcgacattctttctgttgagccatgctcgtgccgcttccaggtcggacgtggtcggcgcagacaccctgatcttttccataggtatgggaccggtcgcgtagcttgcgagcgagttggctgtttggtatacagcgcgtgccgtggtatgtgacagaatgattcccatacgcgcatgatggcatagcggacgccgcatacgcccgaaacttcgggcaacggtattggggcgcggcttatcttctgcgaacggtgggtttttgagctgtcgtattgagggagcagctttggctggggaggtttctgccggctgcccctttttgatgaactttagttgcggattcgtagcttctaagcgtttttgccgaccgctcagatgcctcaccaacataatttgagttattcggccttatcctatacaaatggtgcgatcgcaacgtcctattcgaattgattcaggtagatttatggggcttggttgcgaaattaaggcgattttagcttcgattgcggttcaaggggccttgactagtggttcagctggccgaacaactcgaaaaatgtaggtgggccaacctgccgactatgtgaagcacgcgtatttgctcgttttgatgaaaactagggtgcagccataaggctgcgccctagtttactgcgtgtcggtgtgcccagacggattgcgctgtgcctggcaggcgctcccgcagatggatcggttatttcgcgaataggttcttgaggttgaactcggcctgaaccgtgcggagcatgaggtcggtgtcgtcgaggcccaggtgctgctcgttggcgtcggcggcgagggttccacggcggcgcgcccagttctcgagtgcggcgggcgcggattcgcgggggagcgagcggacgtcggcatccaggctgcggcagatctggcgcgagtcgatgacgatgatcttgccggcgcggcgtgcctcggcgtaaccgtccaggtggatcttgaaccaactgtcctcaaaggcggcgttgtgcgccatgtaagggtacttcttcataagcttgagcagctgcttctgcagttccttgttctcgcggaatggctttttgccgtcgatgtcgtcccaggtgatgtggtggatattcgacaacggcacatcctcgccgcggtagatgtcgggcaaaccgcagtagtgcgcctcggcgtcgtgcgggacggcgtcgctggtgagctccatgatttcccaacccacattgatgatataaccgcgctcgggtgcacggccggtggtctcgatgtcgataccgagcacggtgccctggatgggcttgcgggcgtaggccacgccgagcgcgtcgcggtcgccgcggatctcgcgcatgaccgacgcggcggtgcgcttttgcatcttgccgatggcggcgcaggtgtcggcatcggacaggccgcgcgaaagcgtcgcgggcgtcacgttgcgcaggcgcgcctcgccaatctggtcgcacaggtcgcggttgcggtcagccaggtcgcgcacggtggcaaagtcgaagctggggtcgccctcggcggtaaagtactcggtttcgagcaccttaagggcctcctcgcccttctggcgctcggactccatggcgccgtgatcgccatagataaacatgggaataaacggctggcgctcgtattcgagtgcttgtgaaacgttcatataactgctccttggacgggccgtgtcgcgcggctcggtggcattgagttatggcgagatgatagtttaccatgggcaactattggcatcgcgcctaggacaactacaataccctagttgaccgctaggacttttacaatgctgccgaaagacatgaaaggttccatccgtcatggatttgctgattgatattctgctcgacgccggcaaggacacgctctcgctggcgccgtttttgttggtgacgtatcttgctctcgagacacttgagcacgttgcgggcgaccgcgtcaacggcgctatcaagcgcgccggcgctgcgggtcccgtggctggctcgctgctgggcattgtgccgcagtgcggattttcggccatggcagcaacgctgtacgccggccgtgtcgtgacgctgggcacgctggtcgccgtgttcctctcgacctccgatgagatgctgccgctgttgctcgccgagcaggtgcccgtgcagaccatggcgatgcttttggcttcgaaggcactgatcgcgctggtcacgggctttatcgtggacgcggctatccgcggccttcgtcgtaattcccgcgcgcatgcggcgattcgccgtaccgtgctggggaccgctgccaatccggctcatgtgaactgcgcgcacgacgaccataccgggggcgacatcattgatgaagtggccgaggcgggcgtgagcgccgaccacatccacgagttgtgcgagcgcgaccattgcggttgcgatgatgatgaagatgaacacgagcgcgaccacggacacagccatgaccacggtcacgcaggcgagcatgagcaccaccacggccatgggcacgaccacggtcactcccacgaaggtgcgcccgtcctgtcgattatccgcagcgcgatctcgcacaccgtgcaggtttcggtttttattttcctggtgacgctgattctagttgccgtgctcgagaccttcggagagttcgcgatcgagcagttcctgcgtggcaacgagacgctcgccgtcttgggctcggcactcgtcggcctgatccccaactgctcggccagcgtggtcattacgcagctgtacctggagggcgcgctacagctggcgccgatgctcgccggcacgctcatttccgccggcgtgggctatcttgtcctgttccgcaccaaccgcagcgctcgtgaaaacgccgtgttcctggtcatgatgtacgtcatcggcgccggctggggccttatcctatccgccttcggcctctaagtaggcctaaaaaatgggcttcaaatagccatgctcggcgcctgcgcaatgcggcgacgcatggcattttgaagcccgttttttgttgagccatggattccgagcgctcacaccgcgcaaaacaaaaaggtagatttccgggcatgtcccgaaaatctaccttggttagcgcagcagctcggtgaggctgcgcttaaagcgggcccggtcttcgctggtaaatgccgccggaccgcgagtgcgaccgccggcgcggcgcaccttcttttcctcgtggcgaataaacagttgcatgtcgatggtcgccttatcgtagacgcgcccgcgcacgccgatggcggcggcatcgcgcccgagcaccatgctcgccaagccaatgtcctgcgtcacgactacgtcgcccgcctgcaggcgttcgacaatggcaaagtcggcgctgtcggcgcccacgctcacatcgagcgtcgtgacccaaaatccgcgtcgcgcatgctcgacgtcgcgcggatcgtcgcggcgaatgtggcgttccaggttctgtgtgctgttgccggcgataacgacggcgacgcccgcccgccgcgcgcagtcaatcgactcgcgcgtgaccgggcaggcgtctgcatcaataaagagcgttcgcggcatctagtgcaccagtttgccaaattgaatagcgcgaacaatcagcgttacgccaaacaccagcagtgcggtgccgctaaagatgacgagcatcttggccgaccacagcggatagataaacacgaacatgccggcgatgatggagagcgcgccgctcaggatggcgagggcacggttggacgaaagctcggactccagaatggacatgacaccttcgacgatccagccaaagccggccacgataaccaccatcgtggtgagcgtcgcggtcgagaaggcctggttgcgcaggattatgacgccgcccaagataatgagtaggttggagatgatgctcgtcacgcgccagccggtgggcagcagtggctcgaaaacagcggtaaacagcctgatcgcggccgtgatcacaaagtagaagcccaagacggtcgttaggaagacgagggacttggcgggcgcaaacagcagtgcgatgccggcgacgagcgccaagacgcccgtgatggcgtaaatccagcgcacggccttgacggctttgcccgccatgcttttctcgtcaaatccaaactggctcgatttttggtcatcgttcttaaagatgcccataatgtctcctttccgtgcggtgcacgtcgcgttcattgctctccgtgcggcgtacgccaaaagtgctgcaacaagtatcgcccaagggcgccgatgcatggggcgggaaggacgaattgccgccccacattcccgaattgttacttttgttcccgctccagtgaggattaatcaacaattgtagaacattacgccgctgtatgtaattgccaaggttttaggttagattctcctaagaacaattgcccgaaattgggggtccctatgaacgaaacagttcccgcggcgccgtcgagcgcggagtcgatggcaaagcagggttgcgaaaagctcggcttggacgcgtttgatgcgttggttcgctgcgcccgcacgtgccgtcgctttgacgagtccatgcgcgtgccgcgtgagcttttgcttgagctggcggagctggcgcacctgactccctgtggtgccaatgctcagcgtctgcgttttcatgtggtaagcggtgcagaggactgcgcgcgtgtatttgacgagcttgcatgggccggtgcgctcaaggattggccgggtcccgatgagggcgagcgcccgaccggctacatcgcgattcttgccgagcgcgccgttccgggtaagcccgccgctcctattactgaggtcgacacgggcattgccgcgcagacgatgatgctcgccgcccgcagcgccacgcccgaggtggctgcctgcatgttcaaggcctttacgccccacgcgatcgatgccatggggctcgatagcgataagtatgagctcaagctgatcatggcgtttggcgttccggccgagacgcaggtgatcgatgcgatcgattccaaccccgacggctcaattaattactggcgcgacgaggcgcaggtgcaccacgtacctaagcgcccgcttgccgacgtactggtgtagctgagcgtcaccgcggtgtgatccggcggtaaaccaccacaaaggtacctgtcccctttgcggtggtgcgaggggaggacgtgtggcagatttgtatttggtgcggcatgggcagactgagctcaatgtgcagaacattttgcagggtgggcacgattcgccgcttacggcgcgcgggcgcgagcaggcgctggcgacgcgcgcggcgtttgaggcgcgtggcgtgacctttgaccgtgtgtattcctcgccgttgggccgggcgcggcatacggctgagctaattgctggtgagggccgctcgatagagctggtcgatgacctgcgcgagtggcatttgggctcgctggagggtacatcaaatcgcgagatgccgccgcagccctggggtgattatccggtggcctttggtggcgagtctgaaggcgagctccagtcgcgcatggtcgcggcgctgtcccacatcatggccaggccgcagcacgactgtgtgctggcagtctcccacggctcttcctgccaggagtttcttgagtatgtgactggcaggggagagctacccgacaacggtgccgtgcttcattttggctattgcgacggtgcgttttcgctccttgattggtaacgaacgaaaggacccctatgaataaagacctgtatctggttcgtcatgggcagacaatattcaaccttaagcgcattattcagggttggagtgactcgccgctcacgcagctgggatgcgaccaggcggcgcgtgccggcatgttcttacgtgcgcgcggcattgaacccgatcatgcctacacctccacacttcatcgcaccgagcagactatcgccaacctgtggccgggcttggcgtacgagcgcctggacggtctgcgtgagtggttctttggcgactttgaggccgagcgcgtgatgcttatgcccgagcgcccgtggcgagatttctatcgtcagtttggcggcgagggccagatgcaggtgcgcgagcgcatggcggcgacgataaccgatcttatgcgacgtccggaccacgagtgtgtgctcgcggtgagccacggttcggctatcaaggagtttttggaccacgtgcggggcgcggcggccgacgagcgcgaacgcgtgccgggcaactgctcagtgctgcattttgcgtttgacgatgcggccgatacgtttgaactggtcgaagtctttacgcaggaagactacgcgcgcgagctggggcttgaaccgctcgtggctactgcgggtccgcagcgcggataacgcgagcgcggcggcacgggtcgtcggcataacttctcgacgcaaaaggggcggagatgcatgtacctgctgcatctccgccccctgtttgttgggctgccgatttttgtgctggacggtctggtcttgctagaaccgcgcgacctggtgcgtgagcagacccgtcggaacctgcgccgcgccgccgctgacctgcgcggcggggaagagcgcagctacggcaaagttgaacggctctttgcccgtgtaggtgccggcggcacgtgcaccgtcggccaggagctgtgatgcctcgactagtgcgacagcgtaggcagggtcgtcggccagtgccggctccggcgcctggtcgagcatggcgcggatggccccgacggcgtcctcgcgcttgacctcccacacgcggtgcgtaatgccggcggggtcggtgacggcatagagtgaagcgccctcttttgcggcgccgaggatgatatccatgacgggagaggcttcgtagacaagcgttacgggacggggctgtaccttgaggtcggcgattgcgcgcgcagcggcggtcgtatcggcggcaaccgcgtcgccgcccgccagcgcaccaaccgggcagatcgccacgacacctgttacgcgccccggctcgcccgagcattcgtacacgtaatacgccgcgcccgggtccttgagcatcaggccatcggcaatggctccgcgcagagcatcgttgccgctcaggatgctgcccattgcaggcagcgcctcgagcacgcggtcctgagccgggcggatgcagggaaacggaagtgctttcatgggcggtcctaacgcacgagtcggtttgttcgcggcttattatgccccaacttggccgctcgcgtcccagagcacgttatcggcgagcgcgatcagcacctgctgacaacgaacgatatcggcatggggcacatattcgttgggcttgtgcgcgagcgcgagcgacccgggaccgtagctcatgcaattgcggttacctgtcttgccggcaatgacagcggtgtcggtgtagccggtaaagaagccgacggtcgtgtccgcccccgtcacgtcatcggcggcacgcttgagcgcggctagaagaggagagcttggatcgcgctcgatagcggggcggtcgcctgtcacggtgtagcttccatggcagccggggaccgcggcttcggcaacggcgatggcctgctctaccatgcgcgtcgcggcggccgtatcggtcggcggggtcaggcgcatgtcgacccagactttggcgcggtcgggcacgacataggggcgatatccgccctcgatttggccaaacgtgatggtcgaaggccccagctcatcgtgcgcgggcagcgccacaaacgcgcgacggagcgaacacacgacctcggccatggcggcgacggcatccgcgcccttccacggctggctcgcatgcgccgttacgccagccatttcaatctcgagccacgtgcgccccttgtgcgccacctggatctgtccgtcggtgggttcggtgtccagcacccattcgcgcgagccgacccagccggcatcgatcgcggcctctgagccgcgcataaagtcctcctcgtcgaccgagcaaatgagtgagaagccacggcggggcagctcgccttctgccgccacgcgctcgagcgtatggaccagtgcggcaatggcgcaggccagaccacccttcatatcgcaggcaccgcggccatagagtttatcgttgcgcacgatcgctccgagcggcggaatgtccgcgtcccagccatcgcccagcgtaacggtatccatatggcagatatagacgagccgtggctcgtcgctcagtcccggcacggtgaccataaggttgcggcgcccgggcagcacctcgagttcctcaacctgcacggcatggagcaccggatggctcagctgtgccacccgttcctcaaccaacgctttgatatagcgctcaatctcgtcctcatacgcacccgggtctgagctgtcgatccgcacgagtccttgcgtaagccgccaagcaaaatctgtatcaaccataggcacctcacagatagttaggtcaacatacagattgtatgtcaagaagcggctcggtgtatttaatggagtgctcacaaaaacgggggcgcctctcgtgcgaaaggcgtccccgcgggcattcaatgtcagtgacgggcaggccacatggggaactgcccgtcagatcagccggcgctatttgattacgcgcacgcgatacatcgacggaatctgcttgagtgcctcgatggtgctgctgtccaggtgctcgtcggtgtcgaacatggtgtaggcgttctcgccggcggactcgttggtcatacgctgcacgttggcgttgtccttggccaggatggccgtgatctggccgatcatgttgggcacgttggcgtgcaggcaggcgatgcggctcgcggcgcgcgccttgcccatgctgcaggcggggtagttgacgctgtgcgcgatgttgccgttctccaggtaatccttgagctcgctgatggccatgtcggcgcagttggcctcggcctcgccagtgccggcgcccgagtgcgtggtgataaacgtgttgggcatcttgacggtcttgggcgtggcgaagtcgcagctaaaccagctcagcttgccctcgcgcagggcagcgtcgacggcgtcctcgtcaatgatggtttcgcgcgcgtagttgatgagcacggcgcccggggccagcaggttgatctgctcggtgctgatcataccgatggtgtcggccttgctgggcacgtgcacggtgagatagtcgcagccgcggcagaggtcctcgagcgtgcccacgcgctgcacctcgcggctcagcacccatgcgtgctcgacggaaatgaacggatcgtagccgtagacgtccatgcccagatcgacgcaggcgttggcgaccttggatcccacgttgcccagaccgatgacgccgatgcgcttgcccttgagctcgcggcccacaaaggccttcttggctttttcggcatcgacctggatctcggggtcgtcggcgttgtcgcgcacccagttcatcgattgcaccacgccgcggctcgagagcaccagcatgcctaggacgagctccttaacggcgttgctgttggcaccgggggagttaaagacgacgacgcccttcttggcgtactcctcgacggggatgttgttgacgccggcgccgcagcgggcgatggcgcggatgccctcgggcagctcgtagccgtgcaggtcagtcgagcgcatcaggatggcgtcggcctcctcggcggtgctcacaaattcgtagccctcgccaaactcgactttgccgtccttggtgatgtcgtcgatggtcttaatcttgcgcatgaaaaactccttagcaggtttggtttaaacaggtggtttgaagtggctggtcggcccgcgcgttgcgggctagttagatcgcgggctcaaactacgctgcgtttcgaagtccttcatgtacgaggccagtgcctgcacgtcttccatggttacggcgttgtagacgctggcgcgcatgccgcccaccaggcgatggcccttgacgttttgaatctggtgctcggccgcgcctgcgacaaaggccgcgtcgagttcggcgtcgccggtgcggaaggtgacattggcgatggagcggctgtcggcctgcgtggtgccatggaacagctcgctgtgctcgagcaggtcgtagagcaggttggccttggcccagttgcgctcggccatggcggcaagtccgccggtctcctcgacccaatggaacaccttgccgcacacgtagatgccaaaggtgttgggcgtgttgagcatggagcccttggcggcctgggccttaaggtccatgtactgcggtgtctgcgcaaaggcggggccgtcggcgatgaggtcgtcgcgcacgataaccacggtcacgcccgcggcgccggcgtttttctgagcgccggcgtagatgagcccgtagcgctcgacgtcgagcggctgcgacagaaagcagctcgagacatctgcgaccagcggtacgtcgccgcaagcgggcagctcgtggtacatggtgccaaagatggtgttgttctggcagatgtaaacgtagtcgagcccgtcgcccgcggcctcggcggcaatgcgcgcgttgatgtcggccatgtcggggatgcggtcgaagttggtgtcctcggaactcgcgagcagcacggcctcgccgtacttgtcggcttctttgtatgccttgttggcaaagttgccggtcacgacgtagccggcgcggccgcggcgcatgaggttcatcgggatgcccgcaaactgtagcgtggcgccgccctgcaaaaataggacgtggtagttgttcgggatgctcagcaggcgacgcagggttgcctcggcgtcgtcgatgatctgctggtacatgctagatcgatggctcatctcgagcacggacatgccgcaaccgcggtagtccatcatctcgtcggcgatctcggcgagcacgcttgtgggcagtgcggccgggccagctgagaagttgtgcacacgtgccatcttctagtctccctcgtagtcgtttgaacgttcgggatactttagcacagtggagcgccaggcgcgaccgcatcacggtaaaactcgactgcgccgctatgatttacagtatggttacatgggagaggggcgaccttactcctcaggcaaatccaaatctgcgagcgaagacatgaggttctctaggcgcttgatctcttcgtcctaaattagctacctcctagttagtacgatgctagcgtggcgatgacgacttcgtcgccggcgtatattagggtgttgccgtcggggatgatcgtttggccttcgcgcttgagcatcaccacaataaacggatgcttgccttgtggcacatcgcgcaggcgctggccggccaggcgaccgtggggcgtcacggtgacctcgcgcagcgtaacctcggcacgctcttcgaacgttggggcggccatcaccagcagatcgccttcctggatcacggtatcgccgttgggcagcaccggatgggcgccgtcacgcagcaccaagaccaccagcatgtccgttgcgctgccaatgtcggcgagcgagcgtccggcaaacggatgtccagcgcctactttgagcttgacgaacgacatgccgtcttcgtcgcggtagtcgttaaaggtgcgacgcacgtcgccggtcgcatcgatcatatcgagcttcttcgccaccgccggcagcagcgagccctgcaccacaatgctcgacacggcaatcgcaaacaccaggtcaaataggtcgtgtccgccgggaacgccggccactacggcaaagagactaaagacgaccgaagctgctccgcgtaggcccgcccagcttacgagcgcgacctggcggggattcgtcttaaagggcgctaggagcacgccgacggcgatggggcggctcacgaagagcatgaacgccatgagtgccaggcccggcagcagcatctgcggcaggcgtgcgggcgttacgagcaggccgagcaagaagaagatcgtcatctcggccatctcggtgagggtgtcaaagaagtgcgccatctcgactttgccggtgatgtcgctggcgcccagcacaatgccggccaggtacacggctaaaaagccgttgccgcccaggtagctcggcagcgcgtaggcgacgatggccacggcgaacaaaaagatggtctgcgcgccctcggccgttgcgtgcgcgcgttcaatcaggcggcccgccgcccagccgatggcaagacccaaacccgcgcccaggatgatctgcttggccagcagtgcgggaatgttgatgtcgccgccggccgcgagtgtggcgagcacggcggtgagcaggtaggcgacggggtcgttggagcccgattcgacctcgagcagcgagtctgtgccgcccctcagcgaaaggttgtgctcgcgcagcacgctaaagacgcttgccgcgtcggtcgacgccacgaccgatcccagcagcaggccgccgatccagtcgaagcccagcacagagtgggcgaacacgccggtgatgccggcagtgatgacgacgccgagcgtgctcagcagcaccgccggcgcagcgacgggcttggcgcggtcgatattggtgttaaagccgccgtagaacatgatgaacagcagcgccgtgctgcagacggtttcggtaagcgcgtagtcgctaaagtcgatatccgccgggccgttgacgcccaacagcatgccgagcgcgataaagataagcagggtggggaaggggagctttttgccgacgggtttgatggtcaggcacaaaatgatgacgaggccgataaaaagaaggatctggttcatagatggtgtccgctcctgggtggttggcgtggcacggtcagttgcctgcggttatttgtacccaaagatggtgggtttatggggttggattgcgggcgtgcgcgatatcgtcatagacgactgccgtctttgcctctgctcggaaaccctttccagctttattgcaacggagtacaatgggtaacgtttaagttcaacttgaagttttagttgcggagccgggcttcggccgcaatgcaaggagaggcgtaccatggcgatctatgtgacatctgatgctcacgggcacgtgcgtgcgcttgacgaggccctgtctaagatctcgttgacgtccgacgacacgctgtacgtgctgggcgacatgatcgatcgcgggcccgatccggtcggcgttattaagctcgtgcgctcgctgcccaacgcccgcgtgctcaagggtaatcacgagcagatcatgctcgatgccatcattggtcaggatccgctcgatgccgagacctgggatatcaacggtggctggacgacgcgcgagcagctcaacgacatggaatttgaggcatacgaggagctcgtgcgatggatggccgcgctgccgctctacgcggtggtcgagaccgaggagcgcccgtatctgctggtgcatgctggaatcgagatgaaggcggcgcgcgcgtttttgcttgagcatggcgtcgattgtgccgatggcgttggagcggtgggtgccgatcgcgagctgctgcagcagatgctcgcggtacagtcgtccgatgacctgctgtggattcgtcacggctattgggatgtgccgaccgggctgctttctaccgagggtaagggcccggtcgttgtgagcggtcacacgccgacggtgtcgctcgggcgttattgcgaggtcggtggtcttgcggggctcgacgaggagtcgggccgcgggcagatcgtgcgcctgggcggcgaggatgccgccggtgtgcccgatcgcatcgacatcgactgcgctgccgccaccggctccgagttcggtcgcgtgggcatcctgcggctcgatgatggggcggagttctacgcgaacatcaacccgggcgaataatcggtgcaaggggtagctaatatgggaagggttttttgactacttttgcccttctgcccgcaaattgatttctctgggacgggattaaataatcatttggctgcccgccggctaagtgagtagacttttttggaaatgccgagcacccaacatatttgcctcaataaaaccgcaggtcacagacttgtgctctgtcggtgtggtcggggattcggtaaaaatctactcacttagttttacgtgtccgcaacgagactccagccggggtgattccaccgcaaattagcttctcccatcgccgcaattaggcgccgtacggattccggtccctctctatgcgttggcggatgtgggcgtactcgataatcaacagtaccagcagtagggccatgatggtcaggtagctcacgacggcgcccatcaggccgagcagattgatcagaatcaccgggagcaccacgctcacggcaaagcagatcaggtagatcttggtgacgtcgccggcatggcgcagcaccgtgatgatggcgtagataaagtcgatggccgcggtgacgccgccggcgacgaccatcagcagcgccaatgtgcggtagcgctcaaagttgaggccgtacatatagctcatgaggggaataccgggaccggccataaatgcggcgcacacgccggtgatgaccacgatcagcgccataacggcaacaataatcaggtcaaagcgacgacgcttgcgaggattagcccaaatgctcgacaagcgcaggagctgcggtttatagacaaatccaatgctcaacagaatagcctgagctggaaaaaacagggcattaaagtacaactggtatttgtaggccagtgttccttccatcacaaacttgggcatgctctcgataagattgaacaggaatagcgcgccaaagagtggggcgcactggacaaacaggtggccgacctcgcgcaggcttacgcggcgcgatttttcggtctcgagcagggcgagcggcgcggtgaccagcacgagcgaggcgatcgcggcgatgcccatggccatggccgcgatgggcatgctacgcgtgaagaacagcgccacgctgaagaccgcgatgacgccgacggagcgtagcgtttgactcattccagccaagtagagcttgtcggcctgctgcaggcggccttcgtacacgtcggcgacgccgtcgatgaccttatacaggtagacgcccaggccgatcgtcgccatctgcgcgtcatagccgcgggcgctgctatacatgaggccgcagcctagggcgagcgctccgcagatccaacgattgagctggtaggaggcgaaggacgtcttttcgtcgatgtccgagacctggaaattgcgcacgccgtagttgcatgcgatcatgatgagcgtgccggtgacaaaggcgatggagaacttgccggcttcttcggcgcccacgagctgtgtggacacgatggtgagcagcggaaacgccaagccccacacggcggtgccgagagcgttccaaaggtaatcgcggcgggtggcgtgctcctcgtattccgcttcctgcatggagaagccgccgccgtagacggcaccgagcagacggttccaccaagcgttgaccatgcggcggacggggccgggcttgcgatcgcgttcgcgccggcgacgtgtggcttggctgctatcgggcccgccggcgttgcgctgactcagctcttggatgcgtgcgagttcctcggcagtgtgcgaggcagggaagaggccgttctcgatgcggccgccctgggccttcgcggcgccgtctctcgatgcagcggggttggagacgccgttgcggcgggcgatggcgcggcgaatgctatcgaggggcgtgatgctcaaagcggagtcctttctattgctgcgctttagtatagacgcgacggtgttcgttcgtgtttttgaacggattgttcaataatttcggcgggcggctgtaatttgtcggtaaacgtgcggtatcctgttgaagttttgtgacaccccccgatgccgcccacgcggtaccaaggagcttctacctatggacgtcgccgcattcttactggctcttgtgccgattatttggctggtcgtgatgctgctgtgctttaaatggccagcttggaaggccgctatcggatcgtttgtcctttcgtgcttgcttgccttcgcatggtggcacctgccggcagcgcagatcgcgaccgcctcgctcgaaggttttttgatggctctgtggcccatcgtcctggtgatcatcgccgcggtgttcacgtataacctgtgcgttcgtacgggcgccatggacgtgatcggcagcatgatcacctccatcagcagcgaccgccgtctgctggcgctgctcgtggcttggtgcttcggtggctttatggagggcatggccggcttcggtaccgctgtcgccattcccgccggcatgctcgcgggcctgggctttgaggccgtgcctgccgtgctcatctgtctgctggccaacggcgtgcccacgccctacggctccatcggcatccccacggtgtccgttgccgacctggtgggtttggattcccttcacctagcgaccgttcagctggtgcagctcgcaccgttctttgtggtgatgccgctatttattgtgctggttgcgggccgtgttgccgatgaccagggcaatgccgcgagtgtgggcgagcgtctgcacggtgttgccggcgtggcgttgctctccggcgtgtcgtttgtcggcgcggctctggtcgttgccatgtttgtgggccccgagctggccgtggtcgtaggatccatcgtttcgctcgcgctgacagctgcgcttgccatgcgcgccgagaaatccggtcacctggacgctcgcttccatatgaatatcgaggccggggagaagctcaccgttaagtcggcgctttcggcctggtcgtgcttcatcctgatctttgtgttgctgctgggcacgtctaatctggtgcccgctgtacatgctgcgctcgcgccgtttgcgagccatgtgcaggtgtattgcggtgagaatcccggtacgcttacgttttcatggatcaatacgccgggcgtctggattttcctggcggcgtttgtcggcggtgccattcagggcgcttcgccgcgcatgatgggcgaggtgctggccgcggctgtgaagcagatgacgccgacggtgatcaccatgctttcggtgctgggctgcgccaaggtgatgggctatgccggcatgatttcgtcgatcagcgcgttttgcattgcggtcgccggcggtctgtacccgattctggctccgtggatcggtgcggtcggtgcgttcgtgaccggttcgggcacgtcttcgggcatgctgtttggccccattcagagccaggctgccactgcgctgggtgtgagcgactactggatggtcgcgttgaatgccttgggcgtcgccgccggtaagatgatctcgccgcagaccttcgccattggtcttgccgccgtgcacgtgcgcggtaaggatgccgagctcctgggcgcggtgctgccctacgctgccggcatgctggtcctgatgagcgccatagccatgctcggccaaggcctgccactgtagtcggcacttagggacgttccttatgtgccggcactttgggaacgtccctaagtgccggcatccgaggacactccttgaatattgcctgttcaagagtgtccccaatgactagtcgtttaaaaacgtccccaatgactaggccgcttgcctgcgatttttgaccgttgggcgggcttgccgcccttgccgcaaaaacgtttttgcatatcgggtacaacgggctttacgtgagtaaagtgcgcgtcgcgtccacgtgtcgcgtttttaaaggaggccccatgcctggtgttacccctgcagaagttttgtccaactttggtattacgctcgttgaagatcccgccgagaatcagccccgtctgctggtcgacctgccggcagccgagctcgtcgaacacgctatccgccgcgaagaaggccgcatggcatccaatggcgcgctggtgatcgagacaggggagcacactggccgttcgcccaacgaccgctttatcgtcgacacgcccgacgtgcacgacaaaatcgcctggggcgcggtcaaccgcccgctgtccgtcgagagctatgaggccatcaaggccggcatcgtcgactatctcaacgagcgcgacgtgttcgtcacccgcggcatggcgggcgccgaccgcaaccacacgcgtcgcctgctcgttgcctgcgagcgtgccagccaggcactctttattaagcagatgctcgcccgcccgcttgcccgcgaaatcgcgcgcaccggcgaacccgacttctgcgtgctcgcagcgcccggttaccagtgcgaccccgccatcaagggcctcaactccagcgccgccgtggtcatcaacttccaggagcgcgtgattttggtcgcgggtaccggctactccggcgaaatcaaaaagtccatcttcagtgtcatgaactatctgctgcccgtcgaggatgacgtgctgcccatgcactgctcggccagcatggatcccgtcacgcacgagactgccgtgttctttggcctgtccggcacgggcaagaccacgctttctgccaaccccacgcgcctgctgatcggcgacgacgagcacggctggtccgacatgggcatcttcaacatcgagggtggctgctacgcaaaatgcgagggcctggacgccttccacgagcccgagatcttcaacgccgtccgttttggcgccatttgcgaaaacgtggtgctcgacgagaaccgcaagcccaactacgacgacatctcgatcacgcacaacacgcgcgtggcctatcccgtggagcacattcctaacgcgtggactaagggcatgggcaccactccgagtgtcgtgctgttcctgacttgcgacgcttttggcgtgctgccgcccatctcgcgcctgacggccgacgccgccatgtaccactttgtgacgggctttacggctaagattcccggcaccgaggtcggcgtcaccgagcccacgcccacgttctcttcgctgttcggcgagccgtttatgccgctcgaccccatggtttacgccaagatgcttggcgagcgcattgccgacggccgcacgcgcgtgtacctggtcaacaccggctggatcggcggcggctacggcgtgggccatcgcatcgagcttgcctacacgcgctcgctggtcgcgcgcgccctcgacggcaccatcgaggacagcgagttcgtgcacgacgacatctttaacgtcgacattcccacgacgtgccacggcgtgcccgatggcatcctggtgccgcgccaatattggcagagcaccgcgcgctacgacgaggccgcgcacaacctggcggtgatgttcgaggagaacttcgagaagaagtactctcacctgcccgagtccgtcaaagccgccggcccgcacgcccaggtgtccgccgaggcccgtcatcgcggccgcggcctgctggggctccgccgctagcgtcgcctcagactcaaaaccatcataaagggggcacctttgtggtggttttgctcgtgtggatgactcgggttacaatacgtctgacatatcgtccccttctccggatggggacagcgcaagcgttcttgtgacggcaccgtaggactttgaaggtggccgttgtaagggcgctttttgtttaggcgccctcactcgggcgcgcacaatgaagggagagcgtatgaagagctttattgccgaggattcattctgggagctgtttccgcaggcagcggtcggtgttgtggtcgtggagggcatgaagcccacggctcagattcctcaagaggacgtggatgcgattgcggcgttgctcgaccgcgccaatatcgatgcggagcgtcatctgaccagcgatactatcagcgagaacgcaccggtcaaggcatggcgcgaggcctatcgtctgttcaagaccaaaaagggcgcgcgttgctcaatcgagaacctgctcaaacgcgtgctcaaaggcaagccggtgggccacattacgcccgcggtggacatctacaacacggtgtcgttgacctacgcgctgcccgtcggaggcgaggacctacatgcgatcgagggagaccttcgcctgaaggtgaccgacggtggcgatgcattcttgccgcttggcgaggaggcggacgatccgacgctgcccggcgagctcgcctacatcgatgatgcgggcgccgtgtgccgctgctggaactggcgcgacggcgttcgcacggcgctgtccgacgattcggccgatgcattcttggcgattgagtgcgtggagcccgagcggatgggggattgccaggccgcgatcgatcgcctagccgagctgctcgagcgctatctgggagcgacggttgtcattaagacgcttgtgacccgcgacaatccttgcgtggagctgtagcggcgcctagaacctattgatgccccaaaccaccacaaaggtgcctgtcccctttgtggtggtttttatgttgatgggttaacaaatggggtatttgggtacgagtgtcgccttatgcgactaagatgtttacccgttagcattatgcaagcgaaaggcggtcgtctcccatgcagcagaacgacgagacacgttttgaggattttgtcggactgatcagcgggctctacaaggagattcagcgcatcaagacgtccgaaggcgcaaggctcggccttaagggctccgacgtcatgtgcctgtactatcttgagcgcagcaaggacggcctgaccggcgccgacctcgcccgcatggccggcgttacccgtgccgccgtttcgcgcacgctggcacatctggaggagggcggctacgtcgaggtcgatgattcgggtgatgcggccgtcaagtaccgtgccccggtgcgcctgactgccctgggcggcgagagcatgagcgaggccgatcgcatcattcgcgaagtgctcgacaccaccggtaaggccatgggcgtggagcaacgcgagcagatgtacgcgtcgctgcgtacgattctcaacaccctgcgcgagatctaaggccgccaaggcatttgcttccaattaacaactgcatcgtcccgtttgagcgcgcacgccgtgtcgggacattgttgtcaaaattccctgcgcgagatctgcgcaagaaaggattcgctatgtccgtccgcattattaccgattccgccagcgatatgtctccggcggagcaccccgctctacgtgttctgccgctgtccgtcacctttggctccgacgtgtatatggatggcgtcgacatcgatcaccagcgcttttacgagatgctcgtggagcgcgatgagctgcccaagaccggtcaggtcaacccgtatgccttttcacaggcaattgccgaagcgcgtgaggccggcgacgaggccgtgattattaccgtgggcgccaagctttcgggcaccaatcagagcgcccgtaccgcacttgccgaggcgccgggcggcgacgtgttcgttgtggacagcaataacgtgaccttgggcgagcgcgtgctggttgagtatgcgctgcgcctggtggacgagggccgtagtgcggcccagattgcggcggccgtcgaggccgttcgtgaccgcgtggtcgtcatcggcctgctcgagacgctggaatacctggtgcgcggcggccgcctgtctgctgcggcgggcgctgtgggtacgctgctcaacgtgaagccggtcgtggccgccgaggacggcctcatcgtgcagttgggcaaggcgcgcggttccaagaacggtcgaaacctgttgaaccagaaggttgagcaggctggcggcgtcgacttctccatgccgctggcgcttggttatacgggtctttcggacgcggtgctcaagaagtatatcgaggacagcgccgcgctgtgggccggccatgccgagaacgagctgcccatccacaccattggcgccaccatcggcacccacgtgggtcccggcgccgtagccgtagccttcttccgccccgccaactaactatccggtcaaaaccaccacaaaggggacaggcacctttgtggtggtttatgctggttccggttgaaaggagcgcatgttggcgtctgagggcttttttgagcgtgtgtacgaggtggtcgagcagattcccgaggggatggtcgccacgtatggtcaggtggcgctgcttgccggtcgtccacgaagtgcgcggtacgtggggtatgccctgcatagcaatccgcgccctggtcagattccctgccatcgtgtggtgtttgccgatggtcgcatttgcgagggctttgcgtttggcggccccgatgcccagcgtgagctcttaatgggggagggcgtgacgtttaccgatcccatgcacgtcgacttggccgcctgtcgctggccagtagggctctagcggctctaccgtggccaaaaccaccacaaaggtgcctgtcccctttgtggtggttttccgttgcaggtttaccggggttaacttatggagaagctatggcggtgcatattgacgctagaaagtaaaccatggtgaactatattggtttcagcaacggagcaggcaataggcgatgaaaaagcctgccctgttgagtttgattcgcattcctcccctctgtgcgattcaacggtgtacttcgggaacaggcccgctggcaactaactgccagcgggcctgttcctgtttcggggagaaatctaatctcaccgtctatgttgtgcgaaagcgctttgcctagtacaccatgcccatggcgtcctgaacctcggccagggtctgatcggcgatctcgttggcgcgacggttgccctcgtgcaggacgtcctttacatagtccagatcgttctcgtagcgctgacggcgctcgcggatcggcgcgaagtactcgttgacggcctcggtcacgtacttcttgagctggccggagccgcccatgccgatctcctcggcaatctcgacctcggagcgaccggtgcagatggcggcggtcgaaagcaggccggacacgccggggcggttctcgggatcgaacgtgatcatgcgctcggagtcggtctggctcttcttgatgcgtttggccgtctcctcggcggtcatcgaaatattgatggcgttgccgtagctcttgctcatcttgcggccgtccaggccgggcagcagcggggtctcggacagcagcgcctcgacctcggggaacaccttgccgtagcggttgttaaagcggcgggcgatggtgcgggtgagctcgatgtgcggcagctggtcgcgaccgaccggcaccacgttgcccttgcagaacaggatgtcgcaggcctggtgcaccgggtaggtgagcaggaggccggtaagctcgtggcccgaggcctccatctcggccttgaccgtggggttgcgcgccagctcggcctcggacaccagcgacaggaacggcagcatgagctggttggcggcgggcacggcggagtgcgcgtagatcatggtcttgtcggggtcgatgccgcaggcaaggtagtccatgaccatgttgtacacgttgtcctggatgtgctcggtggtgtcgcggtcagtgatgacctggtagtcggcgatgagcacgttggtcttggcgcccatgtcctgcagctcaacacggcccttgagggtaccgaagtagtggcccaggtgcagacggccggtggggcgatcaccggtgagcatggtgaacttctcgggcgtattggccaggccctcgcgaatggcgttgctcttttgcagcgcgacttcgtagctgttctcgtttggcatgattgctcctaacgtatgttcatgggtcaagatgataacgcgtttattggaggggcgggacgtaagtaggcgaggggcgggagaggggtggcttgtgcggtgggtgcggcgcggccgcgcttggccaacggtgccttggcacatcctcggcagcttgccctagagcttgtggtggcgctcttctttgcgctcctcggctgcctgctcctcctgcttaaaagcggggtcgtcgggggtgacgagctcgtcctcgtgcgtgcgcttgttgtaatggtggcgcagcacgggctccaacagatgcagatgcttggcaaaggccgccgagccaatggcgagcacggtaaagatgagcacacgcatgggcacctcgacctggttaatcgcggcggcgccggccgaaagcatgatgcaccaggcatagatgagcagcacggcctgtttttggttgtagccttcttggatcaggcggtggtggatgtggcccttgtcggcctgcccgatgctaatgtgggcgcgcttgcggcgcacaatggcgctaaacgtgtcgatgatgggcacgccggcaacgatgagcgggatgataagcgaggtgagtgcggcggtgcggctcacgttgagcagcgagatggagcccagcgcaaagcccagaagcagcgaccccgagtcgcccaagaagatgcttgcggggttgaagttgtaacgcaaaaaggccagacaggcgccaaagagcgcaatggagagcgcggcggcgtcgatgcggcccgagagaacggccatcgaaaacatggtgaacgacgcgatgccgcagatgcccgtggccaagccgtcgaggccgtcgatgaggttaatgatgttggtgaatgccaccagatagattacggtgatggggtaggcgagccatccgagcatgatctcgccgggggcaaacgggttgacgatgacgccgatttttaggccgccgatacaggcgataagcgcggcgaggacttgtccggccagcttttgcttgggcgtgagctggaagacgtcgtcgatagcgccggtcgcaaagatgacggtaaaggagagcgccagcatggggtagctgatgtgcagacgggggtggggcaccaaaacgggcggccaacccaggtaccaggtgcctaggatttgcacagtgcaggcgacgaccaggcccaaaaacaccgccgttccgcccaaacgcgggatgggcttggtgttgatgcggcgcttagaaggatagtcgacggcatcgagcttaattgccaagcgcttgaccaggggcaccgcgaggaaggtcgtgataaaggccgccgctgccacgcataggtacggtatgtagctcggggatgaagccatgaatctaaaaaccgccaagcgtcgaaggaaaaggtcagaagaacgccatgcgcaaagggcatagccgaaccataatactcgaccaaggggggtacatggaattgcacgcagcgataatcacgcgcttaccagatattgggatgttgtcgatggcttgtcgggatgccggcggggatccatatggactgtaatggtgattttcggcaaaagaaaaccaccccccacgttacgaaaatgaacccacctaaaacaggtgggtgccctcatcgactgttccagcgtccttaacaacgaaggatacctgtactaggtacgactgtgtgggctccctaaataaacgcgacggttcacccagttgctccgcggggggcggaatacctacatcataaagcggcactttatcgattccagtcttgacattacaaaaatcgtgtcggacgattacggcgccttgggctcgagccgtctgtggggttgatccctttacgtttgagctgctgaatcgttgttttggagcatggttttatgccgacgtcgttgaccgaacttttttcgcccgcctgccatttgtgtccgcgccgttgcggtgcggcgcgcgatgagggcgcgcacggcgtctgcggtgctaacgacacgctcaaggtggcccgcgccgcgcttcatatgtgggaggagccgcctatctcgggcgaggccggttcgggcacgatcttctttagcggctgctcgctcaaatgtatctactgccagaaccacgagatctcgaccggcaattttggccttgagatttcgcctgagcgcctggtcgagattatgctggaactgcaggaccagggtgccaacaacatcaatttggtgacggcgacgcactatgcgcacctgttgcctgccgcgattgccgcggcacgggcgcgcggactggttatcccaatcgtctacaacacgagtggttacgagcgcgcgagtgccgtggcggcgctgggcgacctggtcgatgtgtggctcaccgactttaaatatgccgatgcggcgcttgcgcagtcgctctcccatataaaggattacccgcgtgtggccgtgtcgggtctggcccagatggcgcgcgagatcgatcgccgcgggggagagctggtggatgacgacgggctcatgaagcgcggcatcatcgtacgccacctggtgctgccggggcatgcggatgactcgtgccgcgtgttagacctggtgtggcagacggtgggcgacgtgccgatctcggtcatgaaccagtacacgcccaatgcgctcatgcgcgagcagggcggcgagttggcgcgcgccgtgacgcgcgaggagtacgagcaggtgctcgaccatgccgacgacctgggctttacgacaatgttctggcaagagggcggcgcggtagacgagagcttcacccccgccttcgacaccaccggcgtcctcaccagcgcaaagtagagcgcacgctgatgatttttctgggacggggattaaaaaatcatcgagaggatcgcctgttcgaaaagttgtcaaaatagccgcgtcccaaaaagactggttattgggcgttgacagttggcgagccgtaggtaaaatatcgacttgtcctggggacgtagctcagttgggagagcgctgccgtcgcatggcagaggccgagggttcgactcccttcgtctccacccatggatttgataagccgctgacattgtgtcggcggctttttttaaaagaaagggctataccatggccgagcttgagtcccaaccattgtccgacgaggagcgcgccgagttggaagagctccgcgctgagaaggcccgccgcgaggcttgggaagaggcccgtcgcgagcgtgaggagctggctgccctgcgtgccgagcgtgcgaaggccgaggaggccgccgcgaacgccgcatccgcatcggcgcccgcgcccgcacccaagcccgctgctgcgaagcctgcacctgccgcgcccaaacctcagcctaaaaaggccgcccgtcccaagtccgtcgagcccaagccgagccgtgacgagatgacctttgcccagcgcatggttacctccaaggagcctatgggcgagaacgagatccctggcatggcgccggctcaaaaaatcatcattgtccttgccctcatcgcgtttgtcatctttatgggctacacgatcctgaccagcatgggcctgctctaaccgactcgcatcgggcgtcatgtccgcatgctctgctctcgtccaaccctcaaattctgcaccacacatccgaaaggtcgccccatggctttgaccgacatctcgcatcccaccgacattgcaatgctcaccgatctttacgagctcactatggcccagggcctgtgggagagcggcaaggccaatgagcagggttgttttaccgcgttttaccgcgaccatccctttggcagcgcctatgccgtcatgtgcggcaccgccgagctgcccgagctcgtcgagaacctgcgctttacgcccgaggatatcgactacctcgcctcgcttgaggcccctgccggcggcgcgatgttcaagtccgcattcctcgactacctgcgcgattttcgtgcgcatgtaaatatcgacgccgtccccgagggcgagctcgtctttccgcgcgagcccatggtgcgcgtcaccggtcctgcgctcgagtgccagctgcttgagacggcgctgctcaacatcgtcgggttccagacgcttgtcgccaccaagacggcgcgcgtggtgctcgccgccgacggtcgccccgtggcggagtttggcctgcgccgcgcccagggtcccgatggcggcctggccgttgcgcgcgcgagctacgttgccggctgctcctctacgtccaatgtgctcgccggccgccgctatggtattcccgtctttggcacgcatgcgcacagctgggtgatgagcttcgattccgagctcgaggccttccgcgcctttgccaagtcgagccccaagaactgtacgctgctcatcgacacctatgacgtgcgcgagggctgcgagcatgccattacggttgccaaggagatggaggcggtgggcgagcgtctgtcggctattcgcatcgactccggcgacctcgccaagctctccaagtatgttcgcggccgttttgatgccgagggcctgccctatgtggggatctcggtttccaacgatcttgacgagtacacgattcagtcgctgctggaccagggcgcgcccatcgatagctttggcgtgggtaccaagctcgcgacctgctatgaccagccggcgctgggtggcgtgtacaagctttccgcccgccgtgcgagcgaggcagatccatggacgccggtggtcaagctctccgagcagccctacaagcgcacgatcccgggcgtacagcgcgtgcgccgttattacgacggctttggcggcccggtctgcgacatgatctacgacgaggaccatctggcgggggagggcgccgcgcgcggcaataccctcgtggccgtgaatgatgccgccctggtgaccgacgtgtccgaacttgagtatcgtgagctgttggtgccgatcgtgcgcgacggcagtgcggtggctccgcgtgagagcatccaggacgcgcgcgagcgctgtgtttgggcgctcgatcatctggatgcggctttcaagcgcttcctgtatccgcagacctacgtggtgggtatggaacagggcctggcccaggtgcgcgacgagctcgtgcgcaagaatatggccgcggcctcggctttcccctgggcaaaatgattccttgggcggtaggggcgagtcacgctcccttggccgccagctcggccgttcgctgaacagttgattggtttgacgtatgacgacttcttataaaacgatggtggtaaagatcggttcgtccacggtggtgggcgccgatggcaaggtcaaccgcgcctttatcggcggacttgccgatcaagccgcagcgctgcgcaagctcggctggcgtctggtcgtggtgagctcgggcgctattgcctgtggctatcccgtgttgggcttcgaccgcaagccggtcggcgaccttccgagcctgcaggcctgcgcctcggctggtcagtgcatcatctcgtcggcctacgacgaggagttccatgcgcgcgacctgctcacctcgctcgtgctgctcacgcgtcacgacacggcgcgtcgcacgtcctacctgcacgcgcgcgacgccctgctgcgtctggtggagctgggcgtggtgccggtcgtcaacgagaacgacaccgttaccgtcgacgagatcaagtttggcgacaacgacacactggcggcgctcgtgagctgcctggtatctgccgatctgtgcgtgacgctctcggacatcgatggtctctatactgccaatccgcatgaggaccccacggccgagtttgttcctgtcgtgcataagatcgatgccaagattattgcctcggcgggcgattcttccacatcggtgggcacgggcggcatgattaccaagatccgcgcgagtcgcatcctgatgacggcgggcattcagagcgtgatttgctcgggcgaggagcccgatgcgctcgtgcgcctcgcccgcggcgagagcgtgggcacgctgttcgatccgccggcggagcgtctggacatcgcgccccgcaagctgtggatcgcgctgggcgacaaggcacatgggtcggtgacggttgatgatggtgctgcgaaggcgctggttagccgtggctcttccttgcttgcggtgggtattcgcgaggtcgatggccagtttgccgagggcgatgtgctcgatgtgtgcgatccgagcggtatggtcgtcgcccgcggtatcgccgaggccgattcggacgtgctggaacttgctgccggtcgccgccaggaccagatcgccagcaaccgcctgctcgctaacctggccgagaagccggcgatacacagggataacttgatcgtatttgcataaagaaagacagcactgcggatcgtttcccgcagcgctgtctttctcgtgccggcacttggggacgttccttttaatatgagcaggacattgtcaagaggcaaaatcgggcctggccccaacgatatggggtcaggccctctccctatatcaacccgtccgcggcgacctcggcgtgtcttcccgacgctcgtctttgcagtttaatatccgcccgtggcgatctctcgctgggcaatccgttgctacggctgaggcttcttcgtcgaaccgacagtctgtgcacgcgtgtggcgccctgggcgctcgcagaaaagggacctgaggttcgcctcaacggcttcggatccaaccgcttccggggtgatcggcttatgtgcgggggagcctccccctacgcctcctcggccatgagaccgaccgcccacacccagcaggcgagctcgcgcgccgtggcgacgttcgccttgttgttgtggaccccgcgcgcgagcagggccccgcgcctctcgaccagcctccgcacgcccttggcggcatgcctgcgggcgcccgggtccggggcctggcccctggcgggctccttcggccgcgcggagcacgtcaggtagtgccacgcggcctcgaccagcgccttcctcaggtgctgttagcgctactgtaaaaacaaccaatttcgccatcgcactttagccgattccgcctcagggaggcggggctgtccctcccggaatcgtccaaataggtgttgccaatccatgccgaagaccacgaggttcgagagcgtgcagagcgcgaggcaccagagcgccttggcccaccaggcgcgcccgagcgggaagcccaggcctagaagcccccgcatccgcgtgcgcgcgtccgcccgcgcgacgcacgccaccacgagcgagagagccacgggcaggaagagcgcgtaccagtagttccacgcgctgaagatctgcacgccccggtagggcatcgcgccgagcagcggcatcggcagcgccatgagcacggccaggcgaaccggtgccgcgtggcgcgacttcagggcctcagcgcgcaggcccgcgagcaggccgcctttctcgcccgtcatgccgccacctccccgcgcgctcgtcgcccctcccggcagacgctcatgaagagttcctcgaggtcctgcccgggtcgaagcgcatcctcgtaggcgaggcgccccccgtagatgatgccgatggtgtccgccatctgctgcacctcggagaggatatggctcgagacgatcaccgtcgtgcccgccgccgcgaagccgcggatctggtcgcgcagctcctcgatgccgatggggtcgaggccgttggtgggctcgtcgagcacgagcaggcgtggccgggcgatcagcgccagcgcgagccccaggcgctgccgcatgcccatcgagaagcgcccggcgcgcttcttcccagtgtccgcgaggtccacggcggcgagcacctcatctatgcggctctcgggaaggcccagcagcgtggtgcgcacgcgcaggttctcgcgcgcggtgaggttggggtagagcggcgcctcctcgatgaggctgccgattgcgtagaggtcctcgcggcgccaggcgtgcccggcaaagaggatctccccggccgtcggccgcagcattccgcagatcatcttgagcgttgtcgacttgccggctccgttgggaccgagcagcccgtacacctcgccctcgcggatatgaaggctcacgtcggccacggcgtcctgcgcctggtcgccgcggccgaagcgcttggtgagcccacgtgtctcgagcatgtaacccatgggtttatcctttctcttccgggcgcgcgggccgagccaccgtgcccgcgcgccttacctttcgggttcaccatccatgatggggcgcgtttctaacgaagccgtaacggccgttgggctcttttggcgccagcccttctcgacccgtacgccactcatggtatgtttatcgcgataacaaggacggaggtgcccgtggcacgcaataagtacctggaggagacggtcgagaagattctcgacgttgccgagcggctcttcgtggagcgcggctacgagcacaccacgatgatctgaagagcaatacgctaaatcgaaaaaggcaatcgaagccgcgcctgtggacttatcgagggtcgagattcccgccccatccatcggcacccagcagaaggtcgtcgacatcctcgaccgcttcggcaccctaacgaaatcgctcaccgacggtaggataaacccccatgaatatatgaattgacctgctgactccaatgaagattggagggtaactgccaggggtgacggcccggcgagtgttattttgcgagctatgcgcattgaaagcgacctttcgtggtataaactacttgccggaagccgcggctttcagggtacggcttacgtgtacgtttaacctccgtgggcgacggggtgccgcaaggcgtagaatatcgcccacctgtaggggcctgcagcgatgcgggccccgcttcgtatgagggggcgtaaccgatgaagatcgtatccatctcccaggacttcttcgacctcgtcgatggcgaccgtgagctcatgcttaagcgcgaccgcccctgcatcgcggtggcgaggctgcgtttccgaggaaagcgcaggaacttcgccgtgccgctgcgctccaacatcgccccaatgtgctcaaagaccagtacttcgcgctgccgccccgccccgcgacgcgccccggctgccgccacggcatccaccacatcaagatgttccccataaccaaggcctaccagcgccgcttcaggaccgagggctcggcttactacgagacactccagcgcatcatcgatggcaacaccaagcgcattgtctccgaatgccaggcgtacctcgaccgctacgagcgcgagggaaggcctcgctttgccgtcggcatcgaccgcatcgtggggctgctggagggcgagaagtagggcacctcggctcagtctcgagccatgcggagtcgctccgcatttttgaacgccgcgtgtgcgtcccaaatacttgagaagcaaactgcgaagtgcagtggcgcgcccgtgcccgtgcatagtcgtcaccatcggcgtctacgcggcgtcggcttcaagtggaactggcgccgctgctgtatatggtttgccttgctgcaaatggcgatcaatgcccgcgatgcttctgtttgcgcttcagctctcgctgctcgaagcgcgcctccgcctcatccgcgcgacgctggcttcttgcttgggccgactcccgcttcatcgcttcccgctgtgccgcgagcgcctgttgtgccttggtgctcaccgcgggccgtttaagggctttcgctacctcgcgagcgcgccgcttggggttcttcgcgggcttgcttgtttcagtggccttgtcgccgaagaacgagagcttctcccattcgcttgtaacgaatcgcaggatctcctcatcggacggctccgcgccgaagacgatgcgggcgacgccgtactttccgccctcgacgtgctccgccagcccgacccagaattgaccgtcgtgatatacggtcagggtggacgacacgctgatctgcatggctggttcctcctttatgtagatgaccatgcagagaagggacaaccaaggaggcaggttactgatgcggactcccgcacgcccacgactacccgacggggactgtgttttcatctctgatgcccgcattgtagcacgcgcggatgcgcccttcatcgctgccgacatgacgtggctgggattcgttcctcgacacatccttttgtatattgccttcccggtttcgaaactttaaatcaattcgagtttcgaaaccgggaaggagagcgtatgtgagaggcgatatgagcatcaacttgatgcttgagggggagctcgcgtcgcttctgcccatcggggacgtgttcccgaaggtcctcatctcccgcatagggcatgagacctgtacccgggaaggcgtactcgtgctggacctcgcgcggtgctgctcggtgagcaggggttctgaacactgcgtagggatatagcgcgacagggggtgcagcaccgtttgcgccttgtctagagagcacgaacgagagatgtggtctgcggacgactgaatagcttcatctgttttggttacaacgaaatgtgtgccgcgcgcctgcggcatgaaggagggagatttctatgaatatcgttgtattgagtggtagcccgcgcaagggtgccaataccgacaccatggtcgaggcctttgccgagaccgcgcgcgaggccggccatacggtcgaggtcatccgcgttgccggcaaaaagattgctggttgtctgggatgccagtactgctttacccatgagggcacctgtgtgcagaaggatgacatggccgacgtgatcgagccgctgaaagacgcagacatggtcgtctttgcctcgcctatctactggttcgatatcaccgcgcaggagaaggccgccatcgaccgcctgtacgccttcggtgctacgggcttcccgttcaccaagacggcccttttgctcgatagccatagcgagggcgtctatgatgcggcgatcgctatgtataagtcaacctgcgcgtactgcaagtgggaggatcagggcattgtcaccatcagcggtatgaccgagcgcgacagcatggtatcgtcgcccaagttgaaagaggtgcgagagctcgctcgcaagctcgcctaaggacaagaggggcgcatggcaatcagcactagcggaaatgcttgctgcccttaccaggaggaatgctgattgccatgcaacgatgctcccgcggacaattccggtgtgctaaaacgccttctcgttcaagaattctctgaacgcggggatgtcgaagccgacgaggccacgcccacgttccccgataacgccgtcctcgaggaggcggcgtttgtattggcttgcgtagttgctggcgacgcccatgcgtttggctatctccgagatcctgctggggccagaatcgggcagcatcgcgagcaaaaactcaatgtctttatcggaaagctctcgataggtcgtttcgagagaagcccgatgccatgcttctcgagttgcctgaagatgccattcatgcacgtgcgccagttgccctgggcttcttgaacatatgtccaatcgatgcccactggaccaatttgaacgccgttcatgcgcgcgtgagactgtgaaaggtagctatctgccgcttctttggttcgctcgataatatcttcgagcatgcctggcatggcggagccatttgctgtactccatggtggctcctttgcaagttttgctaatttttgcaacttttgctaacttttgcgagttttgctaacggcttaggacggtgcgggaagcccccgtatcgtcgacatttccgaggatgacctccgcaacgagcggggcccggggcgcgatattgctgcgctccgggccccgctgctttgtaaaactatggcggttctgccgtcgtcctagtcaaacagactcggcatgtcgttttctttcatgagggcaccggcggagggcagactctgcgcggtgaacttctcggccgagacgccggcgccaaggatctcttcggttgtgccgaccgtggtgaccgagcggcccttcttggccgtaagggcctggacgccctgcgtgttggtggtcgtcttggtcttgagcagcgacgtgttgaagttcatcaggcgatagtcgctcgagaccagcgcgatgtcgcgatcctccttgagcacctgggcatacagcagcttgctgccaccgtagatggcgttcttgaggcgcttgcggttggttttggtgacgtatccggcaagtgcgacacgcaccacgcggccgttttcaaagacaaacagcacgtcggccttgtagtcctcggggtcgatgacccagatgacgctctcgtcgggttccatctcaagatcggtcggcaggtacgagcccagctgggccgacttggtgtcctcaaacgccgcaaccttgcacttgtacacctggctcttgttggtaaacacgagcagctcgtgcgtgttggaggacggaaactcgataaagggtttgtcgccgtccttgtacttgagcgtggtcgccttcttgagcacgcggtctgtcatcttcttaaggtagccatcgcgcgagagcatgatggtgaccgggtactcctcgacctcgggctccaagcttacttcgataacctcatggggctcaatcctgcccgtgcggcgcggcatcacgtacttcttgttgactgcggccagctcgtcgctgatgaccttcttgatgttctcctcgctggagaggatctcctcaagctcggcaatctcaccctctagcttggcgatgtccttggtgcggttgaggatgtactcttcgttaatgttgcggagcttgagctcggcaacaaactcggcctgggtctcgtcgatgtcgaaacccttcataaggttgggcacgacctcggcttcaagcttggtgccgcggatgatggcgatggccttgtcgatgtcgagcaagatcgcctcgaggccgtgcagcaggtgcaggcgctcggactttttgcccaggtcatagttaatgcggcgacgtgtggactcaatacgccacttgacccactcgtgcaggatctggcgcacgcccataacacggggatagccatcgacgagcacgttgaagttgcacgagaacgaatcctgtagcgtggtcgagcgatagagcttggccatgagcttgtcggggtcgacgccgcgcttaaggtcgatggcgatgcgcagacccgaaaggtctgtctcgtcgcggatgtcggcgatctccttgaccttgccttccttggagagcttgacgatgcgttcgatgatgacatcggtcttggtggtgtaggggatctcgtagacctcgatgatgcgctcttcgggaatccaacgccagcgggagcggatctggaagctgcccaggccggtctcaataatcttctccatctcctcgcggcggtagatgatctcgccgccggtcgagaagtcgggcatgggcatgtactcgagcaggtcgcagtcgggatcctgcaggtagtgcatcgtggcggtgcagacctcgttgaggttgaagccgcagatgtcggacgccatggcgacgccgatgcccttgttggccgagacaaggatgttggggaacgtggtgggcagcaggcgcggctccttcatggcaccgtcgtagctgtcgacgaagtcgaccgggtccttgtcgatgtccttgaagatctcggcgctgatgggggagagcttggcctcggtataacgcgaggcggcgtagctcaggtcgcccgaatagtacttgccaaagttgcccttcgactctacgaagggggcaagaagcgcctcgttgccggtggccagacgcaccatcgtctcgtagatcgcggcgtcgccgtgcgggttgagcttcatggtctggcccacgatgttggcgctcttctggcgctcgcccttgagcagacccatcttgtacatggtgtagagcagcttgcggtgcgagggcttaaagccgtcgatctcggggaacgcacgcgagacgttgacgctcatggcgtagggcatgtagttgacctcgagcgtctgcgtgatcggctggtcggtgacctcggagtgcaggccgatgacgttctcggcgttgacctgctttttctttggctggttcttcgtcttcttctttgccacgatatcctcttgaacttcttatgggccgtcgttatcgatttgctgttactgcaggtccagctggtccaggtattccttgccgtgctcggagatatggcgcttgcggcctgcctcgtcgttgcccagcaacagattgaacatggtctccatcttggtgacgtcctcgggctccaccttgatcaggcgacgcgtctcggggttcatggtggtgagccacatcatgtccgggtcgttctcaccaagacccttggagcggttgatggagcacttttggtcgccaatctccttgaggatgccgttcttctcgagctcggtgtaggcaaagtaggtcttctctttgcagttgatctcgtagagcggcgattcggcgatatacacgtaaccctcgtcgataagcgtgggcaccaggcggtagagcatggtgagcacgagcgtacggatgtgataaccgtcgacgtcggcgtccgtacagatgatgaccttgttccagttgaggttgtccaggtcaaaggcaccaaggtttttgatgcgcttgtccttgatctccacgccgcagcccagcacgcgcatgaggtccatgatgatgtcggacttaaagatgcgcggatagtcttccttcaggcagttgaggatcttaccgcggacgggcataacgccttggaactcggcgtcgcgcgaggtgcgaatggcgcctgctgccgagtcgccctctacgatgtagatctcgcggcggctcttgtccttggagcggcagtcgatgaacttctgcacgcggttggccatgtcggtcttctgctgtaggttggtcttgatgctctgacgcgtcttctcggcgttctcgcgcgaacgcttgttgatgagcacctgctccatgatcttgttggcagcgtctttgttctcgattaggtaggttgagagccgctccttaaagaaggccgtcatagcctgctggataaagcggttgttgatggccttcttagtctggttttcataggacgtctgggtggagaagcagttggtcaccagcaccagacagtcctggacgtcctgccacttaatgccgctctcgtttttgttgtacttgccctgttgcttaatgtaagcatcgatggcactggtcagagcgctgcgggcggccttctcgggcgagccgccattctcgagccacgatgagttgtggtagtactcctgcatcatgatggtgcgcgagaagcacatgcacgcggtgatctttacattgtagtcgggcaggtcctcgcgatcgcgaccgcgacggtcggcctcgataaagaagggctcggtgaggtagtcggtaccgaccttctcgagcacgtagtcttcgatgcccttgggatagcaaaagtcctcttcggaaaactcgccatcgtcgccctcaatgcgcaggcggaaggtcacgttggcgttgaccacggcctggcggcgcatggtctcgcgataccaatcgtgggggatgctgatggaggtaaagacctcaagatcggggcgccatttgatggtggtgccggtacggtcctcgtcgctgggctcaatctcgagtgccttctttttggcgccaacgaccttgccctttttaaagtgcagggagtacttgttgccgtcgcgccaaaccgtgacgtccatgtattcggaggcgtactgggtcgcgcacgagcccaggccgttggtaccgagcgagaagtcgtagtcgccgccctggttgttgttgtatttgccacctgcgtagagctcgcaaaagacgagctcccagttaaagcgcttctcggaggggttccagtcgagcgggcagccgcggccgttgtcctctacctgaatggaaccatcgcgaaaggcggtaagggtgatgagcttgccgtagccctggcgcgcctcgtcaacggcgttggacaggatctcgaaggcggcatgcgcgcagccgtcgagtccgtccgagccaaagatgacggcggggcgcaggcgtacgcgctcctcgtccttgagctgacgaatactgtcgttaccatagtttgcggtgttttttgccatgctcgctctcttggtacttcctcttgtgtatttaagtcgtatagatagtcaaggtagcatagcccagcccgtgggcgattccaaccaacacgaaatccatcgaacaatcgttcggattaacagggatagtgtttagtggtagcgcggcattgttaaacaaatttggatacagatgaattttatttaatagggatctagttttactaaacaaaatcgaacgatgctgatcgcacgagcgggcacatcgatcgactatcaatcacgtttactcggacaaaaccgagtcggttctgtccgagtaagtttgaatagtgaaccgaagttgtaatgtccgcatggcgatgacagacatggttttcataatgacagatatagttgacatcctttgatggatgcaatatatttctgtcatgttgcaacggatatctgtccattactacgaaaggaactccatgccgggcaaaaggaacctacgcatgaaggcggcgcgcgcggcggttggcctttcgcaagctgacttggccgaggccgtgggcgttacgcgccagaccatcggccttatcgaggcgggcggctacaaccccacgctcaacttgtgtgtggcaatctgtaaagcgctgcgcgttacgttgaacgatctgttttgggaagacgggatcgacgtcgaccctaacgctctttagaagttcgctatgaaatttgaagatttaaaactcgtgcaaaagtggcgtgaatatgccggcccaaaggatgagcgcctggaggctgagagcgcgaaggtctacaagattggtttcgtgctgctttcgtttggcatgttgatgatctttttctaccagtttatagctcgacaggttgcgtgggttcacagcgacgccagtgaaatgccgcatggctttgcagcgccgtttgaggcagccatgtatttgtggctcgttctcgtgatgttgatttgcgcaggactgcaaacgcggaagggctatgtcgataccaatcgttttgggcaaaccgagtatcttcctgttggatatttcctgcttctcagcggtcttagcggcgccgcgttcgcgcttgttattgccgcaatgcgctgtatcgctgaggcgcagatcgtaccgctcgaaagcgtcttttggttggcgaacctggccacgggcgtgttctgcggcgcgacgattttcgcggccacgtttgctgtcctgtgcgcaacgtttttcacggcgaaaagacgccgtgccaagctcgaggcagaactcaactcctctgacgacatctaatgcgtaatgggctggctctgggtatccagaaccagcccatttgatgttcgatgagccgagtcggcgtctctcacaaaagtaactaggagctagcgaggcttatcagaattgacctcatcggcggtgtctttttcgagcgccgtgcggcgggcgctgtaggcgatgaggccggcgcctgccgcggcgagtgctgcagcggctgccgtaaggggagcattgacatcgcccgtgccagcgagcgcgcccgcttttccggagcgcttgttagtgccgtggtccttgccactgctggagctgcttccgccggagccgccgcccttgtcagtaccgccgccactcgtgccgccatcgccgtcgaccgtcatcggggcgtcgtgaagttccgtcgtatccgcgttgtcgcatacgccgacctgaacttctgagcgttcgcatgccgcgtcgggcacatgaagctcgtgcagcacggcacccagcgccgagtttgcgcccggtcgaatttcctcgagcgttacgggatcgagcgccaccagattacgcgccttcgcatatagcgttacacgtttgcccacttcatcgctccaactctcggggatggcgaagctcatgcggaactgtgccgtgcaacccggtgccagcacggcgttgccactgtcggctaccagcgggtgcgttgcaaaaggtgtgcccagcgtctcgagcgcgtacttcacgtgtgccgtgtcgttggccgaagcgtcctcggcaagctctggatcgtagatcgatgccatgcgtgtgttcgctccgaacccgatggatgcgctggagaacggctggctggagccctctcggtacagatcgattgtgccggcggtcagcaaggtgttgccgtcgtttcgcaccgtgaccatgaaggattcgcctgctgctccgggcaccaccgcgcccgaggtagcgactgcgcccgtcggagtggcacacgccaccaagggcacttcgatgccgtgtagttctgcctcgctcttctccgcgctcacaatgtgcgtggcgagcgcggagagcatgctccccgacgtcaaaaatgtcgttatctgatcgacgggatggtccagctcgcacatcacgaacggctccgtaaacagatcgcctgccaaggtgctggcgaagatgcggaagtgcttgcccatcactgctaccgggttgccttcttcgtcgtaggtttgccccaccttgccatcggtgttctctacatagagcacgcacctgccgttgttgcttacgctaaacgatgccgggccacagcctgcggcacccacgggctgcgttgcaaatgccgatgcgcctcgcgtccaagtaatatgctgcagttgctcgttgacggtagccaaaaagcccgtgtgctgcggccacggcaccgcgtggggtactgtggcatctggcgacataacgccccagctcgcaatggactggccgatcacggcgtacgatgcacagccacaaccgcctgcggtctcgtatgcaatgggcaccaccattttgccgttgatattctcgggcgcgccgagctcgatgctcgacggtgcctgcggaaagcggaggacctgacggaacgtgagactgtcgcccgaaacgtccgaccacagggtaaagcactccagcgcaacctcggcctcgctgccgagcgtcttttctgcggtggttccgcggcggtggaggtaggcgcccgacaggcgcccgtcgacaagtgtcttgcccaccgtgatgcgtgggcactgcaggcaatggtagccatcctcctgaaggcggccgcgcgagatgctgcgccacgacgtgtgcgatatcacgcgaactccgtcgttgcttatgcgcaggcgcacaacggacagtatgccggatgtgctcgccgtatcgaaaagggtgttgtcgccggcggggcgctcgcccgagaccagcagcacgtaggcgtcctggtttcctcttccgtccgtatattccactacgtcgaagtcgtaatcgtatatgctgtcgcgctccacgtcgccctcgccaaacccaaggggaaagtccacaggcgtgggagcggaccacgtcccgtttgcctttgtgtgtaccaccaggcgcgagcgaccattgtcgccgtagcgcaccgaggcgatacggaacaggcattctacgccggcaatcattgccagcttcatgtgggcttcgctgagcacgccagcaaacagcacgttgtcgctcgagggcttgatgccgccacgctcgtcctccgacacgccggcagaatcggcgttcgggtcggcaacggtgttcgttgcctgaccgatgtaggtgtactcatacatcggcgcggcgttttcgtcgttctctatcagtgcatggacgaaatgctcgatctgtcccgtgtcgtcgctttctgcatccgcctcgagctcaatgcgcgtgaccgcccgatcccaatcgcgcacgacaggcgcggcgtttacggcagtggccttaacctcggcgcgtgcgagcagctcggcgttggtgacgatggtggccgatgcgataaattgcggaacgccgcccgcctcgatgttgccgggcgtgccgaagcgggcgtccagcgtgtaaggcgtatctccacccaatgcgagctcagagcgctggagcgcatactggtcgccattgttcaccgacatattccacgaatcgatgagtgtgggccacgaccccgaccaagccttggtggtccacttgaacattacgaactggagtatcacatcgacatcgacgtctgcacctacgcgcagtcgcggaagctggtgtccatccgccttctcgtacccaatgaacagcgtgagggatgcggcgccgctcacggcagacgaagcgacgcctgcaacgccggcgccaaaggtgacggcgagcccgatctggatggtgaacgagcccgacgtgtttgaatagtcgagcgaaatgtttttaaaaaacgccgcgccgctgccgtgcgtgtgggcacccacggcgagcgccagttttgccagcacccaggggttgacgtttaggaaaaatggcaccggtcctagggtaaactgctcggtccaattgaggtcggttcttacctggaagagggccttaatattgccgtatgcggggtcgttgttgttaccccaggttttgcccacccaatcgtaggcgagcgagccgtacagctgtgtggcgatatccatcgtgaacagcggcgtgcaatggtggcgaaggagcttggtgtttcttggatcggtgcccgaaccggcactcatcctcttgtactgattccacttcccctccatctcgtcgaggtagcggtttgcctgcttggcgcccgactcgcgcggcgatttcttccagtattccggatcagggttgcccgaatcgttcatatagctagctggtttgtaccctccgccaaacagcacgtatccagcaaacgagaaatcgaacagaatgggaaatgtgggcatccagcacgtgaacttattgccgccgataccgggaaacgccgcggggaaatcaaacggagtgatctcttggtccatggtggtgggaatgatggtggtcgagcccgattccgcctttgcggccggcgcggtgacaacggccataggggatgagagcgtgtaggttttgccctggtagtcgagcataaagcgcagcttgcacccttcctccagaaggcccgaagctgcatcgaggaacgtgtcttcgagcgtgaacgtcgccagattatccgcgcccgatgcgctggccttgatctggccgatctgcgtgacggtttcggttgagctgcccgcagagggcatcactttattgatatgcaacgttgcctgcccgccctgcggcagatgagcctgcacggtaaaagcgtgcgtgtcgggctggtcgtttgctgcttcgtccgctggcattgccataaacgtggcgtcggcgtactggatgtcccattcgtcgaacgtgagctgtcgaaagtacggctcgccatcggagagcggacgtgtgggtgcggtaatagcggtgccgccctggatacgcgcaaggggaatctcgacatcgcggtagcctgccatgctaatggagatgccgccgttaaagtcgtacgcgtcgagaagcgttgcctcgtccacgtagccttctgaaagaggggcgacctcaaagatggccgtgccttcgtcatcggtcgtggcggtgagctgcttgcctgcggcatagcgcgatatgagcgtgacctgggcacccgtgatgggcgtattcttgttggcgacgtcgaccacgaccacaccgaacatggtgcgcgagagaacgagcaccctgaaggggtctttttcgtcggcatgggcttcggtgggtgcgaacggcaatatgaaggcgtttgcgcttcccggcacgcgcggcatcataatgctcgctaacgaggacgctccggcgacaagtaacgaacggcgatcaagcatcttgggctcccatcccgcaagtatcggtggaaataatccaattttgcgagaaggcgccccgtggcggtagtgccgttcaagggtcaaaatgtccaaattgatcgagcgaagcgccgggttccggaacgcgttcgatgcgcttggtagtccggtcgctaacgtaacatatgcgcgaccagctcggcgcgtgtgccgatgccaagctttgcgtatacgccggataggcggtttttgacggtgcccggcgatactcccatatggcgtgcgatttcggcgttggtccacccacgacaggcgagcatggccatggtgaattccgtggtcgttagatcgtcggcaacgtcctcgcccgaatcggggttgtggatgcgccgccagccgtagctgaagcggtacgtgatctcgatgatgcgcgcgaagtcgtcagggtattgcgtttttaggcatgcctcgataagcccctgtaaaaggccgtgatgctcgccaatgagctcaataaggccgtcgggacgcgcaatgttccaagcaactccgaagtgcgtttttgcggcgtcgatgtccttgaggctcatgcatgccatggaagctgccaagtgcaggaacagctccgagatgggataacttccctgtttcatgatcagggcgttttccgccatgcccaggctgcggccatattcgccgcgcaggtacagggcatgcgccatcacgtagctggcgaacaggcgcagaccttcgggcagatgcgccgcaagcggataaaactcttcggcggaatacggggaaggcaagtgcagcaggacgctcgcggccgaggcgaacaggatatgcgtggcgtggacggcgggcgactcctcgtcagccggcgtatcgaggatgcccgcaaggcaccggcgggcgtcggcgatacggttgagcgacaggctggcgtatccgcagataaagcatgcggaatagcacagcgcgggatcggtggcgtcaagataggggcgcgccgtcttggcagcgagggcggcctgtccgcgaaagtacagcgcttctgccgtggcgatggtgcgtgaatcggggtcggaaatgcctgcaaccgcagcgtcaatctgccccggcacaaaggcggtgcacatcaacggcatgggaacgcatgggtagccatcgcagtccatcttccatctcccaacagctggcaacaatgcagcaattgtactcctgttgctcgggacccctttcgttttactgttcggttaacgctgcggatcgttttggaaggcttacgagtatggtagtaccgttctcggaactttcttcgacctctaccgtgccaccgtgaagcgctgcaatctcccaaacgagcgctagtccgagtcctgcgccgccgtatgccctactgcgggatttgtctagacgaaagaacggctggaagatgctctcacggtactgcttgggtattcccgggccctggtcctcgactcgcaggaacacatggctgtcgttgtcgcagatggagacgttgacagtcgagccggtgcggctgtaacggatggcattttcgaccaggttaaacaccagcctatagaggagcgtgtcgctcccgattactaaagcgtctccagcacaattgagggctatgcccttattttcggcaagtggcgcaaggtcggtgaggacctcttcggacaaaggaccaagttccacatcgtcctcgcaagggacgctgcggagctcactcatctcgagcaataccttggccattcgagacatgcgctcggtttgttcttgtagcaggccgagcagctcggctgtttcgggttgcaaaccggagtgctcggagatgaatagttcaatctgtgcttgcataagggcgagcggggtgcgcagctcgtgtgcggcgttgccggtaaactgacgctgtgcagagaacccttcgccaagacgggcgatcatgtcgttgaaagaggcgctgcatcgttgtagctcggtgggcacatcttcactgagtctgatttcgcttaggttgtcaggctgcacgcgctcaacctgggctgcaaaagcccgtagcggtttgagtgcacggccgctcacaaagtatgccagcacgccgccaaggagtgtgactccagccgtgatgtaccaagctgtcgtgccaaaagattcctgtgcgtcgtttacgacgatcgtgaccttgtcatcgggggtcgctttcgttgggtcgaacacctggggcgaatccgcgccggcagcgttaaaggccgagatgtcactgccgatggcatccatatagcgcatgcccgtatagccgaccaggcagttcgtcagcacgcacgccgcacacgtcagcagcgccgtcatgatcgttatgcgccattgcagcgaaagccttttcattcgctatcctccataacgtagccctctccaatccgattgcgaatcgggtcgtatcccaaagcgctgcgcaacttttttcggagcgacgagatgtgaacgcgggttgcgttgctaaagctgttcacggtgctatcccaaacgtgctcgataagctcctcttggcttaccggtcgcccctgattaagtatcaggtattccaagattcccgtttccttgcgtgtaagagataaggcctcgctgcccacggaagcgatgcgcgccttggtgtcaaagctgagttttccgcaggttaatactatgtcgctttgtgcgaagcgcctgagggtaaggctgcggatccttgccgcaagttcgtccagatgaaacggcttggtgaggtaatcgttggcgccggcatcgagtccgtcgaccttatcggatacttcgccacgcgcggacagaatcagcaccttggtctcgcagtcggttttcctaagttccctgagtacggtcatgccgtcgatacggggaaggttgaggtcgagtaccacgaggtcaaagacttcgacgcccagcaggtcgagcgcctcccgtccgtcgtgacagcagtcgacgctgtatgccaggtttcgcaagctgcgcgcgattgcgtcacacagcgcccgctcgtcctcgacgatcaaaatacgcataacagtctccttgcacatttcaaatcgcgcctaacacggattttatagtcgatatggtccaatggtcgcgtaacgaaaggagtggtcgagttgttcaaagcggtaaaacccatggtacaggtcgctttgttgatcgtcggaattgccatggtgtgctttggtgttatgcgtggcgaggcggatgccgtgctggccaaagcgattaggctgtgcttggagtgtatcggaattggataaaagagcaaacaccgcgtcgcatgttttggcccgatttcgcggactcattcaggcggcggcgacgctggtcaccaacattcacctgccaaactttgccaaaggcggcatctatcagggcgcggggaaaacagtctgcgtacctggacttaattgctattcgtgccccgcggcatcgggcgcgtgccccatcgggtcgttccagtcggtggtaggttcatccaagttcaacttttcttactatgttaccggtacgctcattttgctcggcgtgctgctgggacgctttgtatgtggctttctgtgtccgtttggctggcttcaggagctgcttcataagattcccggcaaaaagttctccacaaaaaagcttaagccgctcacgtacatcaagtacgtcgtgctgctgtttgccgtggtgctgctgcccgtcttggtggttaacgacgtgggcatgggcgacccgttcttttgtaagtacatctgtccgcagggcgtgctcgagggcgccattccgctggccattgccaacgccggcattcgatctgcgctggggcagctctttacctggaaacttgccgttctcattgccgtagtagtgctgagcgttttgttctatcgccccttctgcaaatggatttgcccgctcggcgcattctatgcgctcatgaatagggtgtccttgttggggattcaggttgacgcgtgcaaatgcgtctcgtgcggcaagtgttcaagggtttgtcagatggacgttgatgtggtccgcgcgcccaatcatgccgaatgtatccggtgcggaaagtgcatcggggcctgtcctgtcgatgccatcagctatcgctatggcctggatgtgtcggcggaaaagcttcccttgaccgccgataaaaagtaaacaagcttcgacaaaacggaggaatgatcatgaagctttctaagattgcggccctgtttatggtgccggtattggccttgtgccttgtggcatgttcggcgtccggtggcaatgcgagcgaatctgcgagctccgatcctaagatcgcagaactcactgcgcagaagccgaccaatgccgacgaggccgccgagctgtatgcgaagctcatgaaaaaggagaacgatatcctttcgagtgataacgcgccgtgggaaaaggtattcaatgcggcaaataaagactcggtaatgattgaggacggcagcaattacggcgatttcctgctcaagaccatcgacggtgccaaggatgagttcacggcggatgagcttaagacgctcaaggccggtgcgcagcagatcaaggagatcgaggacaagctcgagagcctggagaaggagttccccggctgtggaagcacgccgagctcaggcgagagcgtcgacgcttcgaccgctggcatgacggctggtgccaatacttcgagcgaggcgacgaagttccccagctttacgggcaaagacctggatggcaacgacgtgagcagcgacgagctgttcgctaagaacaaggtcaccgtcatgaacttctggttcaccacttgcaagccgtgcgtgggcgagctgggcgatcttgagaaactgaataaggagcttgccaagaagggcggccaggtcgtgggcgtcaattcctttacgctcgatggcaacaagggcgagattgcggatgccaaggacgtgctgagcaagaagggcgtgacatataagaacatctggttcaagtcggatagcgaggccggtaagtttacgtcaaatttgttctcgttcccgacaacgtatgtcatcgatcagaatggcaacatcgtaggggatccaatcgtgggagccatcagctccgccgagcagcgcgcagcactcgacaagcttatcgaccaggcgattgcgaatagcgagcagtaaaaaccgcgtaaagcatagcgaggatcgtgtgtcgctgtgcgaagtagtctgctgcctttcaagataagctccaccatatagaggtcccgctcgggacctcttcttttgggcgccgtcccgttcgttttttggcgcggtttgttacattcctcactggcgtcggcaaaaaatggggatagagtaggacaaaagcgtcgaatacgaacggcggaggagagcgggcagggtgcctgcgcaggagaggttgccgtccatgctggagctcaaaggtatttgcaaaaggtacgttacgcagtcgtttacgcaggtagcgctcgacagcgtgagcctgtcttttcgcgataacgagttcgtggccattctgggaccttcggggtcgggcaaaactacgatgctcaacgttatcggtgggctcgatcatttcgattctggcgacctgctgatcgacggtatttcgaccaaagactttcacgatcgcgattgggatgcctaccgcaacaaccgcatcggctttgtgttccaaagctataacctcattccgcatcagaccattttggaaaacgtggagctggcgctcacgctcacgggcgtggggcatgccgagcgtcgccagcgtgcgcgcgaggcgttggagaaagtcggcttgggcgagcacgttaacaagcgcccgagccagctatcgggcgggcagatgcagcgcgtggccattgcccgcgccctgatcaatgaccctgagatcgtccttgccgacgagccgactggcgctttggattcaacgacatccgtgcaggttatggatttgctcaaagaagttgcgcgcgaccgtctggtcatcatggtcacgcacaatcccgacctggcataccaatacgccacgcgcatcgtcaacctggcggacggcaagatcaccgatgattccgatcctttcgatgtcgctgacgccacgcgccgcgaggccaagcctacgcgcaaaacctcgatgagctttgtgacggcgctggggctttctgcccgaaacctcatgaccaagaagggccgcacggccatgacggcctttgcgggctcgattggcattatcggtatcgcggcgattctggcgctgtccaacggcgtaaacggctacatcaaaaaggtcgaggaggatacgctctcgagctacccgctcaccatttccaagcaggattacgacctgtcgtccatgatgggcggacagggggctgcggatgatgactcgcctgaaaacgtggattcgtccgacgacagtgccgaaaccgataagattcccgtggtcacggccgtaaaggatatgtttgcgagcgttaagtccaacgacatgacgagctttaaggcatggcttgacgacggcggcgacggtatcgacaaagaggtcaacgccattcagtacggctacggtgtatcgccggttgtctatcgtgccggcaagggcgatgagaagcccgttcggcttgttcccaacgcaatgaccgaggctatgagcggaggcgcgagttcggcggcaacggtgagcatggaatccatgggaacctcggtctttaacgagatgattgacgaccagagcctgctcgacagccagtacgatgtcgtcgccggtcattggcccacgtctgccaacgaagccgtgatggtgctttcgagccgcggtacggtgggcgactatacgctctacagcatcggtgcgctggatatcgatgagctcaacgatctggtaaacagtgccatgacggccgacggtggggtcaaagcacccgagaccggcaccgactttacctacgacgatgcgctgtccacgacgtttaaggtgctgtcgccggccgatgcctatcgcaaaaacgaagagaccggcatgtggaccgacatgtctggtgacgccgactttatggccgccaaggttgccgatggcatcgacgtacacatcgtgggtgtggtgcgccctaacgagacggccaatgcgagtgcgttgtctccgggcattgcctatacacatgcgctgactcgccagcttatggagcgcgccgccgattcgcagattgtgcgggagcaactcgcccaccccgagacggatgtctttacgggcaaaaccttcgacgaactgcaaggcgaggccaaacaaggcgtggatctgggcagcatgttcagtgtggacgaggcggcgctcaagagcgcgttctcgttcgatacctccgtgctctcgggtgttgccggcggtatggacccgtcgtgtcttgacttgtccgagctggacattgacctttcgggcgtagggaaggatatcgacttcagcgacatcatgtctaaggcgccagcccccgatttctcgggtgtcttcgatgggttggagcttacacccgagcagatgcagcaagtgggggcgctcgccaaccaactgttcacgggctttatgcagtcggaacagtttaaggcgctgacgcccgaagatcttaaggacgcgtcaaagcttgccgccgcgttctcgacgtatcttgagagtgatacggcagcccagcaaatcctggctcagctcaaggcactcggcggcgatgccctggccgagcgcctgcagcaggcgatgaccgactatgtacaaaagcagctggctccgtatctgcagcaggctctggatcagatgatgaagtcgatcagcgaccagattgcgacgacggtgtcaactcagctcaaggcaggcgcggcagggctcatgggccagatggcgacgcagatgtcatcgagttttgccaacctggcgagcgctatgcgtgtggatgcgagcgcctttgcccgcgccatccacttcaacatggacgccgaggacctgagttcgcttatgatgagttatgccaaggcatcgcagcttacctatgacaacaacctgaccacactgggttatgcggacgaggcagaccccatctcggtcaagattttcccgcgcgactttgaggcgaaggagcgcgtgctcgaccatatcgatgcgtataacaagcaggtcaaagctgctggccacgatgagcaggcgatttcgtacaccgactatatgggaatcattatgggctcggtgaccgacattgtgaataccatcagcttggtgctcatcgcattcgtgagcatcagcctagtggtgagctccattatgatcggcatcatcacctacatcagcgtgctggagcgcaaaaaggagattggcatcctgcgcgcgatcggcgcgtcgaagcgcaacgtggccaacgtattcaatgccgagacctttatcgagggcctcatcgccggcgtctttgccattgtcgtcgtggtgctcgtgagctttccggttaatacctgggcgcttgcggccaaacaggtgcccaatctgatgagcctgcccgtgcaggatgcgctggtgctcatcgcaatttcagtgctgctgacggtcgttgccggcctgctgccggcccgcagcgcatccaagaaggaccccgtcgaagccctgcgctccgaataatgcgacaaagggacagtccctttgtcacattgagacccttgcgaaaacggggtctaattaccgttcggcaggttaagaactccctctccccgcttaatgcttgacgaagagtcctctggtttatatacctatcggtaggcatataggatgtattgccgatagaaatggagcaaccatgactctcaccacaccagccaaaaaagattgtctccgtgaaagcggcgcatttgcttgggtcgtcgttattgcgctcggcttaatgtccgccggaacaactggcacatatagcattattgccggctcattcgttgctccagtatgtgaagatctgggctttgactacacttctttttctttctatttcaccgcgattcttcttggccttgcgcttgggcttccgcttttgagtcgcttcattccaaaagtaatcggcaaaccatggcatatttgcattgaactcgtccttattgccgccggcgccgcaatggcgttctacaccgaggtctggatgttcaccgtctccgccgcagtgatcggcatctgcttttcgtttacaacgggcgtctgcatgtccgatgtcattgaccaatggttcagcaaatcgtccggtctcgccatcggcctcgcttggggcgttaattctctctgcacgctgttattgagtcctgtcattacgctggtcatcgagcagcaaggctggcgtacgggatacatcgtgcttgcggccgtttctgcagctatgattttgcctgcaagcgcatttatcattcgccttaacccctctgatcgcaatatgcttccgtacggagagaccgtctccgaaacccatgagagctgcagcgccgatgagcaggaagatgtcctttcgggcatggcactccgcgatgccgcgaaaacgccgtcttttattctctgtgtcctcttgctttgcgtggcgcagctcacctgctgcatgaaccagctgtttccaacctatgcaagcgaggtcggtttcaatcctatcgtaggaagcttaatggtctcggcagcttcactctccgatatcttcctaaatcccttcgtgggcaaaacatgcgacaagcttggcgctattaaagcaacggtcgcatggacaggtgtcagcattctttcattcctgcttcttatcattggcggaagcaatgagaccgtttccatcattgcagctggtgtaaacgatgtcatgttcgccatcgttggaaccgcaatgccgatgcttctcctctcgctctttggatcacgcgattttggaaggatctattcgatcgtttgctcagcgggctatgtcgtcggtgcttttggaatgccggtcatgatgaaggtttacggcatggcagggtcattccagggagtatttatcttctgcattgcctgcaaccttatgattgctgcgtttgctatcgtttccggctttctcaataaggctgctgaaaagtaataagcgccgattgcaccggcatagattgccacgcaacaggggtcgactccaagccagattggagtcgacccctgttttcgttttaaaggttgcccgcaggcaccatgggcgccaacatgcgcttcagcttggctggtctatttgaacataagctcgactattcccgcccaaaccgctttctcatcaatatcctcaccttgagcgaccgtattgcttgctccctccagaacggtataaagaatttgtacgtagagcattacgtcggcgctatcggaaaacgcgccaatctctacaccatgaagaaggatgtctttaagcgcatccatggttcgtttggtcgccgtcgcttgacgttcctgaactgcaggaattcgatttgcttgaacgctaacctcggccagcacgcgccggcgcttttcatcgcttcgatagccacctataactgaattgccgagctcgataagcgcggccttgaacccgtccctatcgactattagcgagtagtcgcgccgatagtcaatggtcggaaacatgctgtccaagagcgtagtgaaaatctcctcttttgagggaaagtagtagtacaccgacggcttggatataccgacaaagtcgcaaatctttccgatagacgctttgtcataaccgacttctgccacaagatcgtacattgcgtccaatattttttttcttgtgctcacgctgcatttctccattgcaaatcacttccgcactaccaacattattaaggatggcaacggaacatcaattcgtgtccaaacatgaccactatatacggcgaacggtatgtatcagtaggcgagcggcaattattcaaaattatctaccgaacggtaggtatagtagtactatagcaggtgaaaccccgctattgtcgcggccggacagcatcgcgggaaacccgacggaaggaccaaccatgtacgagaactatcgtatgccgggcgagttcgagaagcgctccaacgtctatgtgacatggcttcccgattacatccgtgcagagggctacgataaccgccagccctgcgttgacgtgatcaaggctctgctcgagtatggcgacgttacggtcaacctcaattgcggcacccccggctcctatgaggaggcttgctcgcgcctgaaggaggagggggttgatctcgatcgcatcgagatcacgcagttcgaagactccaacttctatgtccgcgacaacggtcccagcatcatggtcgacgacaagggccattcttatatggtcaaccccgcttggacctattacggcgtgtgggacaagaactccccggagtgccagtccgcacgtaaggcagccgttcacatggcggttgcgctcggttgcttcgatatcgtcaattccgaaatggtttcggagggcggcgaccgcgagtttgacggtcacggcactctgatcgccatcgaggacacggaatgccgcaagcgtaatcccgagttcacgaaagaggaaatagaggccgagtataagcgcatctacaacctcaacaaggttatctggcttccgcagcctatgctcgaggacgacgactatcgactgggcatcctcgacgagaaggaagacggaactcccgtctttggcatgagctttgcagctcacattgatgagatgtgtcgctttatcactccgaacaagattcttcttgccgaggtgtccgatgaagaggcagcctcgagcaaggctggagcagagtctcgtcgccgcattgaggcagcctacgagatcctgagcaacgaaacggactgggagggcaagcccttcgagatcgttcgtatgcccaccgccgagcctattgaagtcgttatcgcccctggcgatgaagattacgagctctataagggcttcatcgacgaaatgggcggcaagtttatggatggcaccccctggcccgagggccccgtccacttctacgccgcagcgagctactgcaatttcctgatttgcaacggcgtcgttcttggccagcgttattaccacgagggcatgagcgaggtcgtgaaagagaaggacgagcaggccaaggcagttcttgagagctgcttccccgatcgcaaggtcatcatgattgattccctcgcgcttaacctgtccggcggcggcgtgcactgctggactaaggacgtggcggccagtcgttagtgagccttagagcctgcgctctttggcttaggcgccacatgtaccgctccccgagggatatccgtgttttcctcggggacacattcaacaataattttgataataattcgaaaggaaataggcatgaacaacagcctccgcggtcgcgactacatcaacatccatgatctttcctccgaggatttccgctatctcatcgatcttgcctggaaccttaaggctcagaagaagtccggtgtcgaccagcactacttccccggcaaaaacgtcctcgccaactttgagtggggctcgacccgtactcgttgcgcattcgagacctcctgcaatgatttgggcatgggcttcacttatctgaccaactcccacatgggtgactgcgagaccgtcaaggatgccatgcgcgtctttaacggcatgtacgatctcatcgtctaccgcgcacagaaggacgagcagttcctctatgacgtcgccgacctggttgacatcccggtcatcaatgcccttactctcggcgatcacccgactcagatgctcgctgacgctcttacgatggaagagcaatggggcggtttgcgtacgagccgcggcaagaagatggctttcgttggcaactgcgccggcgccccagtgtggtatggccgtctgtgcgctatgctcgacatggacttcctcgccatcggccccgacgacctccgtcatcagatgtgcaaggaaatgatcgaagaggtggaggcctgctacgccaagtacgctcccaataggacctttaccatcacctctgacctcgatgccctggatggcgttgacgttatcgttaccgaggagtggcgctacatcaaccccgagtgcggcgaagaggttctggatcccgacgactacaactcctggttgggcgatgccgagtctttgtacccctatcgcgtcaccagcgagctgtgcaagcgcaccaacaatcccgacatcttctgcatgcatgagcttccctctgtccataacgcagatcaccgtgtcggcaaaatgctcctcgaccagtgcaagaacgacctccatcgcgaaatcatcaccgagggctttgagattgccgacgagtgctttgaggccaacgcttcggtcatcttccgtgaggcagagaaccgtcagcacaccatcaaggctgttatgtgtgcccttctgggtctctaggagctgtatcaatggataatgcaaagttaaagagcagcaaggtttacgcatgggttctcgtaatcgcgctcggccttatgtctgccggcacgaccggatcctatagcgtcatcgcgggctccttcgtcgcacccgtgtgcgaggagttcgggtttgactattccatcttctcgtattacttcaccgcaacgctcattggtcttgcggcagctcttccgtttgtcggaaaactcattcccaaggtcgttggcaaggtttggctccccgttgtcgagcttattttgctcgctgccggcgcaggcatggccttctacaccgaagtctggatgttcatcgccgctggcgccctgattggcgtttgcttcgccttcaccaccggcgtcgccatgtccgacgttattgaccagtggttcaaaaaatctggtggcctggcaatcggtctcgcttgggcagtgaactcgatttacatgctcatcatgagccccgtcatcacctctgtcatcgaggccgctggctggaggactggctatctggtgctcgctggcgtctccgccgtgctcattctccccgcttccgtcctgattattcgctataagcctcaggacaagggcatgctgccctatggctacgtcgagggcgagacggtcaccgagaccgaggagacgaccgaggatagcacgcgtggcgttagctatgcgcgcgccattaagtcgcctgccttcttcttctgcatcggcttcctctgtctcgttcagctcacttgctgcatgaaccagctcttcccgacgtatgcttccgaggttggttttagccccatggtgggcggcttcatggtatccgctgcatcgctcttcgatctgttcctcaatccgatcgtcggcaccacttgcgataggttcggcagcacgaaggccattctgggctggctcgctgtctccatcctctcctttgtcatgctcatgatgagcagcggcaactcgacgctcagcatcctcgcagcaggcgtgaacgacgtaatgtacgtcatcgctggcactgccctgaccgttttggttatggatgtctttggctcccgcgatttcggtcgcatcttcgcgctgatctgctccgtgggctatatcgtcggcgcctttggcatgcccgttatgatgaaggtctatgagcttgtcggctccttccagggcgtcttcatcttctgcatcgcatgcaacgttattatcggcctgttcttgctgctggcaaaaaagactggtaagaacctctcctgggacgaatagttcgattcgtcttagacatacgctgtagggcttaacctgcagccgctttggggcatcgactaacatcggtgccctttttcatcgaatgtgacaaaggagcagccactttgtcacattgagtggcatgtaaatcgaggtctaatacttttccgagaagtgaacggccatacttggacctccgaagcatcgacatttttagacgtcaaacccgcaggatttggctggcaaaaccgcaggaaattgcatctcgaaagtgccgatgcttcgggggcccgttttcactcgttcacttctcgggaaaagtattaaacctcgttgtatggggtgcggctggagggtggtcatcgttcagtagctacctcttccttgtgaatcgcctgaagcgcaaggcataatgcatgtgacaaagggacggcccctttgttgtgttgatatgagagaagagtagatgatcctttcgctggcccctatggaggggattaccgggcatgtgttccgtcgcgtgcatgcggagtgcttcggtgcgctcgattgctattacacgccgtttttgccgccgccgcgggtgggaaaccgctttggcggcaaggcgtttaaggagatcgatcctgccaataaccaggggctcaacgtggtgcctcagctgatgtccaagaacgcggacgagtttgtgtgggcggcacaggtgctcgccgacatgggctaccgcgaggtcaatctcaacctgggttgcccttcgggaacggttgtcgccaagggcaagggctcgggtttcttgcgcaatctcgacgagctcgaggcgttcttaagcgatgtgtgcgagcggtcgccgttgccggtgtcggtaaagaccaggctggggctggagaatgacgacgaatacgagcgcgtgctcgatctgtattgccgcatgccgttggcagagctgatcgtgcacccgcgcgtgcaaaaggaccgctatacgggatcgccgcgcaaggagttttacggcgagacgctggggcgtgcgccgttccccgtggcctataacggcgacattttcgatcttgaggatatggatgcgctggtggaggcctatcccgggacgcgccatgtgatgctggggcgtggcttgcttgcgaaccccgcgctcgctcgcatggtcaagggcggtcccgctgccacggcagccgaactgcagcgtttccacgacacgctgtttgcggcctatgcagaagagattggcggcaatgcggtcttccgcatgaaggagtggtggttctacgccaagtgcgctttcgctgatcccgctaccgtccacaagatcgtacgcaagaccaaaaaggtcgacgaataccgcgctgccgtcgagcgcgtctttcgtgaacagccgcttgcacccacagctcgcttccacggctaactagtcatcgggggcgttctttaacgactggtcatttaaggacgtccccaacgactatgtagcaaaaacatgtacaccagcatccaaagatgtcgaaaaatgtcgactttggatgctggtgtacatgtttgggtccgacgggggagcgggcctaggcaatcagtgcatcaagtgtaatgagctctctgagccgctccgtgcgtgtttgcccatggcgtttggctttttcgtcaaacgcctcaagaatcgattcgcccacacgtgctgatataacgacgctcggctcatcggagattggtggccttcccaacttgatggtgtgacctttcggccactcatctttttcgtaggcttccgcggctttcttcaactctccgggagcaaaccccatcatcttttcgagctgcttagcatccatggcgcctcctatcgatcgacataatgtcgagcgccggttctcggattctctttttgtatacaattttgtagacaaaaatacaagcagttcatcgggctaattagcttgttttgacctgcctgttcgataggaaatgagcattgacggcttcgatactcctttgcttttcagcttggaatttggatgctcattgaacttccggaggggagccctttattaagctattgagattctgggcaggagctctcactggtcttcggtaatggggccagcttaattcgcgacacagtgtgtcgcgaatgggagtagtcgttaggtgtccttcaatggctactcatataagaacgttcaagtgtcggattttgtcatttagtgtcgctctcagcgactattctggagggtcgtggtcaaaaaagggcaaatatgagtactgttgccattatggttgcatttatttgctataaattgtagttcctgatgagatttgttcccattaagagctacttttattgaacatatgaggagaaataacgtcgtctgcggacgagtggaacgttgaatagttcctgaagtgatcaaaatcgctgctactaaacaggtagcagtactcatatttgcccttttttgaccacagccctctcggaaacctttccagaggcgtcaaacagccataatccaaaggtctcctcaaacaattagccggccaagagcgtccatgactaccaaaaagctgtacgccagcatccaaagatgtcgaaaaatgtcgactttggatgctggtgtacatgtttgggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcatccaaagatgtcgaaaaatgtcgactttggatgctggtgtacatgtttgggtcgtatgggttggggccctggacggacagagcgtgcgtactagagcaggttttcctgtacccatgcgatgatgtcgcttgactcgtagagcggcttgccgtcgatgaacaagcagggaacctggcgttttccgccgacggcgatgagtgtctgctcggcttcggtatcggtcgagatattgcgttcgggaatggtcacgctgctatcggccaaaaagcgcttgacctttatgcaatacgggcagccggtcataacgtagagcacgagctcgtgatcagtagtcataggtctccaatcggttgcggttttgattgaaatacccaaagccgccgcggtctatgcgcacgtcaacgacgactcgatggcctggaccagaaacgccgtggctccggtgccgcagggcttgtcgtagtagtcaacaaagcgctggtcggcaagatagccgtgggcgaggcccaggtacgcctcgtcttggggctcgcatccccagttgagagcaatccatcgacggtgcattgtaaccagtttttgagcttcgttgctctctgggtcgccaatgcccatggcaatcgagagctggcccaaaatggcgcgttcaagttccttcatgtcgttccatgtctgaggatccatatccagtaacgtttcgtttgctgcatcgatagcctcattgccatagcgagctcgagcctcggcgccgtagcattcctcgttttcctgcacggtgcgccagcgctccagttgcggcaggacggcgcccatgagcgagacggcttcgtcaagcgacatgccggtgttttgcgccaggcgcggggcacagtcctcgatcatcgcctccatggtggtggcgtaggtgtacttgccgtggtcgtagcaccacttgcagtaatggtcggtcgtggcgcccgtggcatcggtgccgcagtcgtcgggcgtgagtatcatgccgcagctctgacaatagtgctcgggcatttcgagcaggtgagacaggggctcgccggttacggcggcaatgagcttcatcatgtcgatgcccggtgtgacctcgccgcgctcccaacggctgatggcctggcgtgtgacgaagagcttggcggcgagctgctcttgggtaaggtgatgggcgcggcggacagcgatgagcttttctgcaaaggccatagcggctcctttctgctggttgatggcttaagcatacgcggtgacaggcgcccttccaagcaaccgttggttgcacgacgggggaccgcggcgaagaattgcgcgtaacgccccatgcccccatgccgtacaatgaccggcatggaacctatcgcacacatacataccgacctgccgcagaagttcggcatcccgcgcaacagctttttggcgccccatctgcagggacgcatcgtttttgagccggaatttgcctccaatgcagcggttgagggtctggactccttctctcacctgtggctgctgtggcgcttcgaaaacggagcgcccggcggcacggttaaggacatagctaccgatgccaagacgcaggacaggtccggcaccaacgtcaagtggtcgaaaaccgtgcgtccgccgcgtctgggtggagccgagcgcgtgggcgtatttgccacgcgcagtccgtttcgccctaatcccatcggtcttacctgcgtcaagctcgatcgtgtcgagctcaccgacgatggtccgatcatccatgtgctgggggccgacctgcgcgacggtacgcccatctacgacattaagccctacattccatttgccgactgtcacccggatgcgaccggcggttggattgaggatgctccgtggcaaacgctcgatgttgagtttccacaagcgctgcaggatatggtcccgcccgcaaagctccccggcctggtcgaggtccttcgccaagatccgcgccgtgcgggcagtaagcacgagccaaaccgcgtctatcatctggccttcgccgggctcgacatatctttttcggtcgataaaacccagttaaccgtagtcgccgtcaacgacgcgcgagactaaccagccattcgcccgcacccgtcaaattaagcgccaaaccccgcgccaaaaccgcccacgctggtggacaataacgcctaccaaaacaatcaactttgcacgggagcttagcatgaaatacgactttagctcgcttatcgaccgccacggcatggacgccatcgccgttgactcttggggcgagatccccggtatggcgccgaacgcacccgacgagggcttcgatcgcattcccatgtgggtggccgacatgaactttgccacggtgcccacggtccaggaacacatcattcagcgtgtccagcaccccatgtttggctatttcaatccgcgtcccgagtacttcgaccgcatcatcgaatggcagagccgccgtaatggcgtcgagggtctgcgccctgaacatatcggctacgaaaacggcgtgctgggcggtgtcgtgtcgacgctgcgcgcgtatgtccagccaggcgatgcggtgctggtccacagccctacctacatcggctttaccaagtccatcgaagccgcgggctatcgtattgtccacagcccgcttaagctcgatgaccagggcgtgtggcgcatggactttgaggacatggagcgcaaactcgcccaaaaccacatccatgccgcggtgttctgctcgccgcacaatccctgcggccgcgtatgggagcgcgacgagatcgagcgcgccatggacatctatcgccagcacgattgcgtggtgatctcggacgagatttggtccgatatcatcctgccggggcacaagcatatcccgacgcagtcggtgagcgaggatgcccgcatgcgcacggttgccctctacgcgcccagcaagacgttcaacctggcgggtctggtcggcagctatcacatcatctataacgagacgctgcgcgaccgcgtgtgcgccgtgtccaacaagacccactacaacgagatgaacgtcatctccatgcatgcgcttatcggtgcctaccagcagcagggctacgagtggctcgatgagctcaatgaggtcatcgagggcaacgtcgactacttctgcaattacgtggacaagcattttgcgggcgtgtcctattcgcgtccgcagggcacgtacatggtgttcctggactgcacagcgtggtgccgcgagcatggccgcgatattcagtggctgctcgacgagggcgctcgtgtgggcgtggggtatcaggacggccgcccgttccacgggccctgccacattcgcgtgaatctggcactgcccctttcgcgggtaaaggaggcgtgtgagcgcctggaccgctacgtttttggggtatagggggcgctcgattcgagtgctgccccatgcgcccacgccgtcaaaatgcgtgggcgcatggggcgcagagggtagcgagcgcgtttttcgcattcgctacttttcatgaatctgcttgccgcaaagatgctcaatcgaaatctcgtagagttggacgcccttgatgtctttggcgatttcttcctcgacttcttcggcagaagggtagtacttaagcgcgagctggcggactttgtcctcgataaacgcgggcgcttcatctaccaggcgacaacgaccaaagacaacggtactcataacgtagggagcccagtcgccgtccttgtaccactcgttgccgtaaacggtaaagcagatcttgtcatcgcgcttgagtgcgtcgaccttgtggccagccttggcgccatggaaataaatcttgtcgtgctcggcgtcgaagaagtagttgacgggaatggcgtacgggtagccatcgtcgccgttgacggcaaagacgccgcgcttgcaggtggcgagcaactcgcgcgcttcctcgtcggtgatggcgcgtttctttcgacgtaagggcccaaacatcgttggtttcctttctggtcgtgcatggtggttgagcacaaactatagcgaaacggatccgtatttcttgatgcgggcgagcatgtttttgagcttgttaaagtcgagcggcttgggcaggtgagcgttcatgccggcatcgtgtgccgcctgggcatcctcggcaaaggcgttggcggtgagcgcgatgatggggatatcggccgcatcggccttctcgctcagacgaatcgcgcgggttgcctcgtagccgtccatgcccggcatcatgatgtccattagaatcgcatcgaagctacccgcgggacggccaacgtataggtcgaccgtttcgttgccgtcggcggtgcgagttacgacgatgccctcgctttcgagcagagcctgggcaatctcggcattgagctcgttatcttctgccaaaaggacgttcatgccggcaagcgagcagctgtttgcctggccgtccgcacgttcccttgcctgagggttcttgtcgatatcgagcggaatctggacgttgaacgtactccccgcgccaacctcactcgaaatctcaatcgtgccgcccatcaggtcaataagtgacttgacgattggcatgcccatgccggttccctggaacttgctgcgcgcatcgtcaccttcctgggcaaacggctcatagatatgctttaaaaactcgggagccatgccaatgccggtatccgaaacgctaaagcaaaagagcgcgcgcccatcatcgagtggcttggtctgtgagctaaaggtgacggagccgccgcgcttgttgtacttaatgctgttgtctagcaagttgattatgatccgtcggatatgggtgggactgccgatcatgtatggccccgtagcgtacggcaggctattgtcctgcaatgtgatgccgttaccggacgcgcggagcttgcacagcaccagcgcatcgtcacagagctctttgaggttaaaaggagcatgttccagtgttagcttgcggtcttcgattttgcccatctcgaggatatcgttgatcagcgagagcaggtgattggcggcaacacgcgccttggcgcggctttcgcgggcgacttgcatatcgccgtctttcaattcctcaatttcgataagacccaggatgccgttgagcggcgtgcggatgtcgtgactcatgcgcgtgaggaatgctgtcttagcggcgttggcggcatcggctttctgctgttctttctgcgcgcggtgaagcgaccagacaaggatgacgatgccggtgagcaaaatgcagatgacgactgccgaaatgacgatgcggttgcggtagagaagtcggaacgcatccgattcttgcgccgagtacgatgtgggggaataactgcttgcagagagcgattcgccggcattgacgatgcccttattgataattcccaacagctcgggcttgccgcgcgaaattaaacacgatagttgcgccgtgttggtgagttcctgcgtttcgaaatcctcgatgccataggtgtcgcggatggtttccaagcgcgtgctggggacaatgatgcaacttgcctcccccttattgagggctttgagcgcctcgccgccatttggatattcggttatcgttgcgtcggggaagaggctctcgagctcaagacggttgacgatcgcgctctgcgtgcaagcgattttcttaaggtcgcggttcaggttattgctgctgtgaatggcggtcagggaaaccgttcccatcgggtttgactgcacgacccctttctgttcggcaagccagtagtcgcgaaacagaggtagggcgacatcgatagttccgttggaaagggctttgaccatttgcttgttatttgagatcgcgactgttttaaccgtaatgccaaacttgtcgcgcaacgtcgttgcaagcgaggcgagcgacccttccatctcgccgtcgtcattttgcgtgcagtagggaagttggtttttaagatagccaatcgtgatggtgttgccgtttgctttgagccaggaggtctcggtgccggtgagcgatgatgagccgctgttttgggccgagtagctcgatttgacttcgtcgttatagcgcgggttgacgcgggcgattgccgtcatggcggcattgatgtcattcatcaaatcggggcggcttttgggaacggcaaaatagtagtcgctcgagcctacgtagaacatgggcgaggcatcgggcgacgaaatggtgtcgttcatgatgacggcgtcgacctcgccgtctgcaagcgcctcaaagagggcgccaccggtgttgatttctttataggtacaggtgatgccttcgttggcgagccactgctggccgacgaaggtttgcatagcgccggggttgtagccgatggtaaggccttggagcgcttgggggtcacccttggccaggtcgtcgcgatcgggcctggcgtagatgtagtagcgctcggtgccctcgggattcgaggaaaagagcaacttttgggcgcgttcctcggagtaggagatgttgggcatcaggtcgatttcgcccgcctcgagcttgtccatgagctcggtgaaggtgccactgacgtattcgtattgccagccgggcgtgtagtacgaaagcgtctggaggtattcgtaaccccagcccgagaggcgttcgcccggcgtgccttcctggaaacccctgttgctgacgagccagccaacgcggaccgttttgacctgctgatcagagtcgccggcatagacgggggcgggcatggcgccgcccagcacggtaagtgcggtaagcacgatgaccagggcacgatatatagttgaacgaaggacagcggcagttctcacatgcaatcctaacgaatcgagacattaccgcataaggataccagctcaggtgccccgttcgcccacagatatagtcatcggggacgttcttaaacgactagtcattggggacgttcttgaatgactagtcgtttaagaacgtccccgatgactagttccgtttgcgggggaggcgtgggacaatatcgagcaaatgtgaatgattgtccgcggaaggggtcgcgatgaaaaagctgaggacacttgccgatgtgttgcatcaggctggctttgcccacataacgggcgtgtttcttgtctttttcctgctctgctcaacggccgtctggctgtccgagcccacgaccctcacctttggcgacgggctctggtttagctttgagaccgtgtcgaccatcggttttggcgatattccggccgagacgccggttgcccgcgccatcaccgtcatcttgagcgtcatcagcatcttctacatcgccatgctcacgggtgttgcggtgagctactgcaacacgctcatcaagctgcgccaaaaggacaccatggcacgctttatggacgacttggagcatttggaagagctcgaccgcgacgagctcgccgacctgtcgcgtcgcgtgcgcgagtaccgtcgccggcaacgttagggctagcgcatcgcgcaacaagggggattgcatatgaatatcacggtgtacctgggcgcgagcgtcggcaacgatccggcgtttctgcctgcggtgcaggagctcggcacatggattggcgctcatggtcacgcgctggtgtacggcggatccaggtcgggcctgatgggcgcgcttgccgatagcgtgctcgatgccggcggccacgtgacgggtgtggagccgagcttttttatcgaggcggagttccagcacgacggcatcgacgaccttatcgtgacgagcgatatggccgagcgcaaggcgaagatgatcgagcttggtgacgcgtttatcgcctttccgggtggcacgggtacgctcgaggagattgccgaggttatgtctgccgtgtcgttggggcacctcaacgcgccgtgcatcttgtacaacctggacggttactacaatgacctgaaggcactgctcgagcatatgatcgacaagggcctatcgagcctgcagcgccaacagggaatttattttgccgacaacctgcaaaagatcgcatcgatcatcgacggctaggcaacgggctcgcatgcgcgcgacacccaatagtgccatttgcagcgcagatggttggcgcgttcaggccacgtccgctctacaataagacgtatttctgtcgactttgactacgggagggcccgatggataagcttgccaaacctaaaaaccgcgcgctgtttttggtcagcgttgccgtgaccggcgcgttcgcaggtgccgcagtctggctgttcttttttgcgatggagcacggcatcgactatctgtggaccgagatcccgcacatgttgggcgccgcttcgcccgagctcgcgagcggcccgttcggctttttgccgtatccgtttttcgtctgcctgctgggcggtctgctcatcggtctgtacgaaaagctgaccggcaccaagaccgacgacctcaaccaggtgatggccaaggtcaagcaagacgggcgctacccgtacgacaatctgggcaagctttcgctcgcggcattgctgccgctgctgtttggcggaagtattggaccggaggccggcctgaccggcgttatcgcgggtctgtgcagctgggtcggcgaccgcatgcgccgctttggcgccgagtttagggagctcacgttgttgggtacccaggccgcgctgacggcgctctttaccgcgcccgtctttggctttgtggccccgctcgccggcagcgccgatggcgatgaggattccacgtctgacgagatcaccattaagctccccaaggcgcagaagactgtggtctacggcatcgcgatcgcgggtggtttgggaacctatctgctgctcggccagcttatgggcggcggcatgggcatgcccaggttcgaggctgccgaggtgggcaacctcgagctcgcatggcttatccccctgtcgctgatcggcacggtctgcggttggctgtactttgtctcggagcacgcgagcgaggcgctggcccatgccataggggagcgccccgtcgtcaaggccatgctggctggcctggcgctcgccatctgcggaacggttctgccctacaccatgtttgccggcgagacgcaggccgatgtcctcatggaaacctacctgaccatccccgccggtgtgcttatcgcgaccggtctggtcaaggctatgctgactcccgccctcatcaacatgggttggcgcggaggccacttcttcccggttatcttctcgggcgtaagcctgggctacggccttgccatcctcaccggcgccgatccggtcttttgcgttgccgtctgcacggcctcgacgatgggcgccgtcatgcgccagcccgtcatggtcgtgggcctgctgctcatgtgcttcccgctcaagggcatcgtctgcatgatcatcgccgccgtcatcgccgccggcattccgttgcccaagtcactgcgcaagtagcgcggctttatcgcggcacaatgctcggaggataagaaatgattctgtactttagcgcgacgggaaacagcgagcatgtggcgcgccgtgttgcagcggcaacgggcgataaggtcatgtcgattgagcgctttgatgccgagtcccttcgtcttgccttggcgggagggccctgtcagcttggatttgttgccccggtgtatgcctggggcttgccgacgccaatgatagagtttttaaagactgccgacctgtcgattgccgctggcgcaaaggacggcgggcgaccttatacgttctatgtctcgacgtacggttcgacgaccggccaatcggcgaagtttgcccgcgatttgctgcgcgagcgtgggctcgagctggacgcggcgatgagcgtcaagatgcccgatacctggacgcctgttttcgacctgtcagatcctcaaaaggtcgagagcatcaacaaggctgccgaggcgcagattgatgccgtggtcgaagcggtacgggcgcggcgtacgggcaacatgatgcgccatcgcgtgcccctgtttgcatcgtgcgcatatcacgcgtttgggctgccgcgcatgcaacggacgagcaagtttgccgtcgatgccgatcgctgcatcgattgcggcctctgcgccaagcgctgccccatggcggcaattgagatgcgtgacgggcttcccgtctgggcaaagccggagtgcgccgcctgtctccgttgcctgcactgctgtcccaagtttgccatctcacgcggtaaacgcacggctgcccacggtcagtacaagcattccaagcccggcgtgaggatgtaacggctgcgtgcctgctctctaaaagctcatggtaagaaacaagccgcgcgaggccgtgtgtttacggtctcgcgcggttgttgtttagagcttcctcaacacgattgcgatggtgttgaggtattcaagcgcgcccgcttcaacggcggcgcggtcgcccgctgcgtactcgttatcgcaggcgagccagtcttcccatgcctcgttggtgcagagcatgggctgcatcgagacggtctcgacgccggcggtcggctcgatcatggcgcgccaccaggctatgtcgtgcatgtagtcgagctgctcaggcgtccaagatttgagcaggcaatcgggcagattgtcgtggcagtcgcggaccatgccagggatgctccggtagagcattccaccttgctttacgtaggggagcaagcgcccgcccagataatgcgggtcacgcccatagtagttgtacgagtcgatgctcacgaccgcatcaaaaaagtcatgctcaaatggcagcccctgagaggcatccgctttaacaggatgaatggtgttgcggggaataccgagtgaatcgaagaacgcgcggttctcctcggggtcgctccacagatcgacggcgtaggtgtcaaacccgtattcgcgggcaagcagggcgctggtgataccggtgcccgacccaaggtcgcagacgcgggcgccgcgggggatacgtgcgccgcgaagcagctcttcgcagagcttgaggggattcggccccataattttagagcgtacgagtgtcgcgtcgaagctggtggctttcgggaaggattgagattcctgggattgcattgttctttcctatcaggtgcaaattggcagatgacggaggcggaacggcgcaacaaaccacggccgttggacggccgtcttcatggttctatgcgattgaccgttccctaaagaacaatgaccaaaaagacatccccttggatgatcgagattgggccaaggcccgtgacgtctctattgtaggacgttacgggctggcgggggatatgccatttgtcatgtattggcggacagtcgattatggccacgggcgtgccgagactcgcgttccctgcgccttacttccatattgcgagtgcggcggtgcccaaaacgatgagggcaaggccaatgccgctgcggcgcgagagtttttcgttgaaggtcaggcgcgcgaacaataccgaaacaaggatcgagagcttgtcgatctgtaccacgacgcttacctgcccggcggcaatggcgtagtagtagaacagccatgacgcgccggttgcaatgcccgatgctgcgagaaacgcgagttcatgtcggtcgacgcacgcgacctgctccagttttcccttggccgccacaatcgcccacgccatggcgagtaccacacaggtgcggatcgccgttgccagattggactcgacgccctcgatgccaaccttggcaaggatggatgtgagcgccgcgaaaacggcggcgccgatggcgtaaacgagccaagtcaggtcttgcttctggcccacgccggctgactgtctcttctcaatcatcaggaatgtgccgagggtgattgcggccgtcccgataagctttacggcaagattgcttgtctcgccaaagagaacaatggcggtaagcgcggcgagtacggtgctcatcttgtcgacgggtacgactttgttgacgttcccgatgctgagcgccttgaaataacagatccacgaggcgccggtggcaagtcccgagagaacgaggaacagccaggacttgggcgcgatgctgccaatggttccggcggatccggaaacacctgccattgcccaggcaaatatgagcaccatgcaggtgcggatggcagtcgcgatgtcggagtcggtatgtttgatgccacatttggccaaaatagatgtgatgccggcaaagaatgccgatgcaaacgctgcaacaacccacgacacgggtgcggtgcctcctcaagaacgactacgccaggtctacggtgctcgtccgatgataccgcttgcggctacaagtcgcgtgctcgatagatcttggtgctgacggtgcagctgattgcaaatagcacgaacgccaggacggcaatgccggcgcacagacatccgatgacggcggggtcgggatttgctccggcaaatgacataagccagatgctaatggggttggaggagctcagtattgccatagtgccgcagccaagtagggcaaacaggccgacggataggcgcagtgcctccatgtgtccaaatcggaaaaatatcggctgtgccaaaaacaccatcatgagggagatgagcatcgacgtcgccgaggcggttgcgatttcaaagatcgtctggcctgtcgaagggatgcccatgtggtcgaagaacggaagggcgaggatgttcaggagcgtagccgcgcatgccatgacggccgaggaggcaataatgcacaggtagcgtgcgcagacgatgtctttgcgcgagaacggcaacgttgctcgatagcgctcccaaccgttttggttatcgtagccagccagcgagttcatgattatgatgggcgacatggcgctgactgcacaggtgccggcgctcatgccggagtcaccatccgtcgcgttggcaagggtcagcacgacgaatatgaacaggccgacgccggcgatgctcgggagaaacgagcgcatgatggcggtctcggacataaaggcgcgtttcatttggatgcccctttcagcgtgaggcgcagatagtcatcgatggaaatccgatcacagggaatcgcgggaaaggcctcgagcgtttcgcggcgattggggacgagtacgtcaacgctgtaggcgtgacgggtggcgcgggcgccttcgacgtaagccataagctcggcagcttgcgcctgggaacagtgagcaatgccggcgcgatcggtaatgtcctcgcgcggcaggtcgaacacaatcgagccactatcgatgcaggcgacacggtcggcggcgcgttcaagatcggatgtaatgtggctcgagaacaatacgccgtgctgtccgtcggcaacaaaggcgagcagctcgtcgagcagctcctcacgtgccatgggatcgagacctgccgtggcttcatccaggatgagcagctcggccttgtggctgagcgtacacgcgagctgcagcttcatacccatgccgcgggagaggtctttgacctttgccttggggtccaggccaaaccggttgatgtggccagcaaacgtttcatgactccacgtggggtatgccgggcttacgagtgcctcgacctcggccactttgagcgtggaagggaaggggcacgtgtccagtacgagaccgatgcgggagcgcatgcggcgttgttgttcatcggacgcattggcattgcagcgctgcccaaacaggtacacctcgccggcatcgagctttatgagtccgagtgcggcgcggatggtcgttgttttaccggcgccgtttgcgcccacaaagccgacaatctgaccgggttctacggtgagtgtgacatcgcgcagcgaaaagcgatcacttacgcggcgtgagacacctttgagttctagcaagttttgcatggtatagcctttcttgcagatggctactgcatggtttcgggggctaccaggtcgagcatctcgtgcaacttatcgcgcgtgacgcccagggcttctgcctgtgtcgctgcctgtgcaagcagctcttcgacatggcagagctggttttcgcgcaagagctcttggttgcccttggcgacaaagcagcctttgccttgcacggtgcagataaagccgagctgctctaggtcggcgtaggcgcgcttggtggtgatgacgctcacgccgaggtcgcttgcgagtgcgcggatgctggggagtttggctcccgcggcgagcacgcccgaaaggatttgagccttgacctgcgaggatatctgctcgtagataggcttgtcgctcgaattggataggataatgtccacagcggctccttagctgatgggctacacgtgtatataaccggtaagcacagtatatatacactatgcacagttacgcaagaggaaaatcggaatgattggccaccgtttgtctaaatctgtaacaacaagccccgaatatcccagctagttgttacagattaagatgctgtttgtccgccggtccttttgtctcgatttgtaacatctggagcggttttgggcggctagatgttacagttcgagattttgccggcaggcccatccgtttgtctcgatctgtaacaggtagaggttcaaaaaccgctccagatgttacagatcgagacaaactgctgcggagcgccgccgccgaccggcagtcaaagcctcgactgatgaatttgtcctgataggtgccctgtcgcagcatttcgcggctacaatagtcgcgttacaacgacgtaatgcactcaatgcaagaaaggatccgcatggcaagcctgtcggatgaaatctcgtcgcgccgcacattcgcgatcatcagccacccggacgccggtaagaccacacttaccgagaagctgctgctctataccggcagcatccagactgccggctcggtcaagggcaagagctcggccaagcatgccgtctcggactggatggacatcgagaaggagcgcggtatttccgttacttcctcggtgctgcagttcacctacaacggcgcctgcgtcaacatcctcgatacccccggccaccaggacttctcggaggatacctaccgtacccttatggccgccgacgctgctgttatggtcatcgacggcgccaagggcgtcgaggcccagaccaaaaagctctttaaggtctgtacgctgcgccacattcccatcttcacctttgtgaacaagctcgaccacgaggctcgcgatccgtttgagctcatggaagagatcgagaacgtcctgggcatcaatacgtatcccatgaactggccgatcggcagcggccgcaacttccgcggcgtgttcgatcgtcagacccgtcgcgtcattgccttcgagggcgacggccacgccaacgccaccaagaaggtcgccgaggtcgaggccgagctgggcgaccctgccatggatgagctcatcggcgaggagaaccataagaacctgatggacgacatcgagctgctcgatggcgctggcgacgagctcgacttggatgctgtggcctgcggcaagctgagcccggcgttctttggctcggcgctcaccaactttggcgtggagcccttcctcaaggagttcctgcgtctggccccgacgccgcgcgcctataccgatacgctcaccagcgagccggtcgatccctgccgcgacgactttagcggctttgtgtttaagatccaggccaacatggacaagaaccaccgcgaccgcatcgcctttgtgcgcatttgctcgggcaagttcgagcgcggcatggacgccttccacgtgcagggcaaccgcaagcttaagcttgctactggcacctcgatgatggccgatgaccgtgcgattgttgacgaggcgtacgcgggcgatatcgtgggcctgttcgatccgggtatctttagcatcggcgacactgtgtgctctggcaagcgccacgtgcagtatccgcagatcccgacgtttgcccccgagatgttcgctcgcattacgcaggtcgacacgctcaagcgcaagcagttcgtcaagggcatggaggagcttgcccaagagggtgctatccagatcttccgcgaactgggtgccggcatggaaagcgtcatcgtgggcgtggtcggcgtgctgcagtttgaggtgctcgagcgccgcctcaaggccgaataccgtgttgaggttcgtcgccagccgttgccctataccgatatccgctggatccagaacgaccccgacactattgatatcccgggcctttcgctcacgcgcgacaccctgcgtgtcgaggacatgcgcggcggtaagctgctgctgttcacgagcccgtggaacgtggattgggcaaccgaccacaaccccgaccttatcctgtcggagtttggcaacgtagcgttttaacgcatcggcgcggtggccctgcggggctgccgcgccgattgcttgcctgatgccgcgcgagcggctatcatacccaccgtcgtctcaagaccggggcgtccgagcagttcgggtccgatatcctgctcgttaaacctaaaaccaaaggagtacataatgatcaagaaggtcatggaggactacaaggtcctgctgcggagcattcccgcggcaacggtttcgctgtttttcgtgagcgtcatcatgatgaacctgctggccaacaaagagctcatcagcctgccatatctggcgctcgactgtggctttgtggtgagctgggtttcgtttttgtgccaggacatgatctgcaagcgctttggcgccaaggcatccatcaaaatctctatcctcgcgctgctggtcaacctggccgtgagtctgtgcttttgggcatgctcgctcacgcccggcatgtggggcgcctactacgacacgggcatgatcgaggtcaacactgcccttaacgccaccatcggcggcacctggtacgtggtgctgggctcttcgctggcaatgctcgtttctgccgtggttaactccacgctcaaccagtcgctcggccgcatgctcaaaaagaataactttgcgagctttgccttccgctcctatgtgtccacgggtgttggccagtttatcgacaacttggtctttgccattgtggtgagccacacgttctttggttggacctgggtgcaggtccttatgtgctcgctgaccggcgctgttgccgagctgctgtgcgaggttttcctgagccccgtgggctacaaggtcgtgcgcggctgggagcgcgagaatgtgggctccgagtacctcgagcgccacgcaaccgcctaaggagcaagtatgcgggttttgatcacgggtgcttcgggcggtatcggagccgcatgcgtgcaacgatttttggacgagggccacgaggtcgtgggctttgatttgctaccggcggcgatcaaacacgagcgctaccgccatctgatcgttgatgttcgcaagccggacgcgtttccagacgatcttgaaccccaggtgatcgtgaacgttgccggtacgcaggattcggctgacgacatcgccgccaacctgtatggcaccatcaacgtgaccgagcgctacgcctttgcgggggaggggcttgccgccaagccggcgccggctatcaaatccgtggtcaatgtggggtcggcgagcgggcatacgggatcggagtttcccgactatgccgccagcaagggcggcgttatcgcctacaccaagaaccttgcaaaccgtctggcgccgcaggctatcgccaacagtgtggacccgggtggcgttatcacgccgctcaaccgttgcgtgatggaagacgaacacctgtggaaccagattatggagctcacgccgcttaagcgctgggccactgcccaagagatcgccgagtggatctactttgtgggcgtgaccaaccggtttatgaccgggcagagtctgctgatcgatggcggcgaggccggccgcacacaatttatttggcccgaataggaaacgcgcccgatggaatgaactgcaccccaaaacctggacggcttaaataagaactacgccgcaagggacttcagggaggcggggctgtccctcccggaatcgtccaaataggtgttgccaatccaaggtcgtcgacctggccgtccacggcgactcgcgcggctggttcaaggagaactggcagcgcgccaagatgaccgccctgggcatccccgatctcagggtcgtccagaacaacatctcctataacgacagccgcggcgtcacccgcggcatccacgcggagccctgggacaagttcatctccgtggcccgcggctcggtcttcggcgcctgggtggacctgcgcgagggcagcgagaccttcggcaaggtctacacctgcacgctcgacccgtccaaggccatctacgtcccgcgcggcgtgggcaactccttccaggcgctggaggacggcaccgcctacacctacctggtggacgcccactggtcgctggagctcaagaggacctacaccttcgtgaacctcgccgaccccgagctcgccatcgagtggccgatccctctcgacgaggccacggtctccgaggccgacctcaaccacccgtaccttaaggacgtcgtccccatggcgccgaagcgcaccctcgtcaccggctgcaacggccagctgggccgtgcggtccgcgcgctcgccgaggagcgcggcctcgccggcagcttcgactactgcgacatcgacaccttcgacatgtccgaccccgacgcctattccaagtacgactggtcgctctacggcaccgtcatcaactgcggcgcctacacggcggtcgacagggccgagacccccgagggccgcgtgaccgcctggaaggccaacgcgaccggcccggcccttctcgcacgcacctgctctgagcacggcatcaccctcgtccacgtgtccagcgactacgtcttcgacggcaccgccgaggtgcataccgaggacgagcccctcagcccgctgtccgtctacggccagaccaaggccgccggcgacatcgccgtggccgggtgcccgcgccactacatcatgcgcagctcctgggtcatcggcgaggggcacaacttcgtcaggaccatgaagggcctgtccgaccgcgtcgccgaccccgaggacgggctcacgcaggtcacggtcgtggacgaccagctgggccgccttaccttcacgcgcgacatggccgaggccatcttccgcgtgctggggacgcacgccccctacggcacctacgactgcaccggctccggcgccgtgaggagctgggcggatatcgcccgcgccgtcttcgaggccgtcaacggcaacggcgagagggtcgtgccggtcagcaccgccgactactacgcgagcgccgccggtcccgtcgcctcgcgcccggtccactccgcgctcgacctttccaggctcgagtcggtcgggttccacatgcccgactgggaggaagagctgggggagtacctcaagacgctctagccgccgctattgaattgacgagagtaaatagccaccgttttttgacggtggctattcttgttggaggctatttgcgcagtggtgccaatagtattttgcgaaggatctacctctcgcttgacttggtggaggagcggccgggctgatcgttataggcgtatttgctgtacacgttgacctcccactgctttttttcgacctttgccacggaatccaggatgaatccggtcgcaaggctcagaccgcacaggaacataaacgaggcggcgagtatggcggtggggaagcgcgggacgaggccggtctgaaagtactcgataaagacaggaatgcccaaagccaggccgataatcgcgaataaaagcgcaaccagactgaagaacttcagcgggcggtagtccttgaacagcgtgccgatcatcgcaacgactttaatgccgtcgctcacggtattgagcttggactcggaaccttccggacggtcgcggtactcaatgggcacatctttgatgcgccagcggtggtcgacggcgtggatcgagagctcagtttcgatctggaagccctcggaaagcacggggaaggttttaacgaacgggcggctcatggcacggtagccggtcatgacatcatcgaagctgtagccatagatccacttgatcatcgcgcggaccagattgttgccaaagccgtggaaggcacgcttgttctcctcggcataggtgccgttggaaaggcggtcgcctacggtcatatcggccgtgccgttgaggatgggctcgcagagggctttggccgcctcggcggggtaggtgtcgtcgccgtcgaccatcaggtagcaatcggcgtcgatatcgcgaaacatctggcggcacacgttgccctttccctgacggggctcaaagcggaccgtggcgccgtgctcggtggcgatgcgtgaagtatcgtctgacgagttattgtcatagacatagaccgtcgcctgcggaagctcgcggtgaaagtcgtcgatgactttgccgatcgtgagcgcttcgttgtagcaagggatgatgacggcgatggattcagaattcacttaatgctccttatacattcaatcctagaaagtatagccgtttgggcctggcatcctaagatgtgggttagttctccagttttgttgcgcgaatcgtttgcatggccgtcgggtctatactgttcgtttgtcaacgattacgagtaaaggagttgcatccgtgtcggatcagacaaagcaacaagaaactcgcagtctgcctgcgacgtttgctaagaacgaatttgagaaggacgcgtttatccttcgtcagctggttaccaaggattttaagatcaagtatcgccgtagcgttctgggcgtcgcatggtcggtgctcaacccgctgctgatgatgatcgtcatggccatcgtgttctcgacgatttttggccagggccgcaatggctcaatgacgcccgagatgtacccgctgtacttgatcgtgggtaacatcacctttgccgtcatgtctgagtctactaaccaggccctgacgtcgatcgtgggcgctgcccctctgctcaagaaggttaaggtgcaccgctgggttttcccggtgcagaaggtgctcttctcgctggtcaactttgccttctcgctggtcgccgtcgccatcgtcatgctgtggttccgcgttatgccttcttggcacctgattctgttgccggtttgcctgctgctgcttatgtgcttctgcatgggcctgggcatgatgctctctgcccttacggtcttcttccgcgacgttatgcatctgtggagcgtcgtcattacggcgtggacttacattacgcccatcttctggacgactgactatattgcgcaaatgccgcatctcgtgcgtatcttgatgtatgcgaaccccatgttcaactacctgcagtttatgcgcgatatcttcctgttccagactacgccctcgcttatgacgtttggtatgtgcgtcgcttgggcggttcttgcgcttattattggctataccgtgttccataagtccgagcgcaaatttatcctctacatctaaggagtgctgtgatgactgaatctgttgttgattacagcgagcagcctctggctgtcgaggtcgacgacgtcaccatgatctttaacatggcgtccgagtcgctgaccaacctcaaggagtacttcattaagcttgccaagcacgagctgttctttgaggagtttagggcgcttaagcacatctcgtttgatattcatcgcggcgaggttgtgggtctggtcggcaccaatggctccggcaagtctacgatgctcaagattatcgctggcgttcttgagcctagcgagggcagcgttaaggtgcacggtaacatcgcgccgctgattgagcttggcgccggctttgaccccgagctgaccgcccgcgagaacatctatctgaacggcgccctgctcggctataccaaggagttcatcgacgccaactttgacggcattatcgagttcgctgagcttcagaactttgtcgatatgccgcttaagaacttctcttcgggcatggtggcgcgtatcgcctttgcaatcgcgacgattaccgagcccgatattctgatcgttgacgagacgctgtccgtcggtgatgtgttcttccagcaaaagtgtgaggcccgcatccagcactttatccagagcggcgacgtgacggttctgttcgtttcgcactctatggagcaggttgagcgcatctgccagcgtgccgtttggattgagaagggtgaccttcgcatggacggcccggtcgatgaggtctgcaaggcgtaccgcgagcagttcaactaggttataattacttgcgcctgacaggcttgtgcttgcttgggcgtgcggttatttgctccattagctcagttggatagagcaggggacttctaatcccaaggtcgacggttcgaatccgccatggagcaccatcgtttattaagcccagaccgcttgtggtctgggcttttttcatcttgtgtgttgctggagccgagcgcgagcaagccgctgctgtttgttggggttggcattttacttttcgagatgctctttcagcagctccaacgcgtgggcgtagcccttcaggccctctccggtgatggtggcgaagcaggccagacgggcgtagctcacctggcggaagtcttcgcgggtctcgactgcgctaatgtggacctccacagccgggatggcgacggctttgagcgcgtccaggatggccacgcttgtgtgcgtgtaggcggccgggttgatgacgatgccgtcgacctttccgtaagcctcctggatcttgtcgacgatgctgccctcgtggttagactggaagacctcgacctcgtcgaagccctgtgcggcacccgcttcctggcagatctgcactaagcgatcgtagttgtcgctgccgtagatgcctggctcgcgaatgccgagcatgttgaggttggggccgttaatgacgagtgctttcatggttgcttcctttgccattgaaaaaccaccacaaaggtgcctgccccctttgtggtggttttggttagagagcgggtgggagggtgtcgaggagggcatgggcggtgttggcggcgcagtcgcgtgagtcgatgatgtagtcggcccaggcgcggtagcgcggcatacgctgctcggccagcttgtcgatgccgtcgcgcgcggtgatggggcggcccttgtgggcgagctcgtcgagcttgcggttgagcatcacgatttggctgttttggtgcagcagagggtagttctcgtcgcgcgtaaccacgccgccgccggtggagagcaccaagccgctgcgcttggagatgtcggccagcgctgccgtctcctgctcgcggaaggccgcctcgccgcacttgatgataaagtcggcgcagggcatgcccaggcgctcctcgagggcgcgatcgagatcgatgtgctcgcggcccgtgagctgggcgatctgctcgcccacacgggtcttgcccgagcccggcatgccgatcagcgcgatgttctgttcgcggcgtgacaggcgctccgttacgtccaggatcctctcgcgcggggtggctttgccggtatagcgctcgacagcttgtgccgcctgggcaacaagcataagcaggccgccgatgcaggggatgccgcggcgctcggcctcgagcatcaggcccgtgcgggcggggttgtagacaatgtcgatgacgccctcgagcgcatcgaggccttcgagcgtgcaaggcgcgtcggggcaatgggggaacatgccggcgggcgtgcagttgacgagtagggaggcgtcggactgctgcgcgatattgtcgtagttgacctcgctcgtgcgacccacgggtacgacgatggcgcccatgtctcccagcaccatacttgccgtggtgccggcgccgccggtggcaccgagcacgagggccttcttgccggcaacctcaacgcccaactcctcgaccaggcactggaaaccgaagtagtcagtattatcgccgtgcaggcggccgtcgggcaggcgcgtgatggtgttgacgttgcccatgcgctcggcgagcgggctcagctcgtccaggtattccatgacggcgcgcttgtaggggatggtcacgttggtgccctcccattcgtcgcccgtcataaaagcctcaagatcctcgggctcgcgctcaaaacgcacgtactcaagccccgccagctccttgtagatggtcggggtgtagctgtggcccagcacgcggcccagcacgccgtaggggcgggttgcggcggtatcggtcatctagagcacctccgtgtagctgccaaagtaggtgaagctctcgcatacgtcgtcgatcgaatcgagcaggtcgtcgagggccttgctgccaaagggacagtccaggtcaaagtagaacataaactcaaagtcgcgaccggggatggggcggctctcgagcttgatgaggttgatgttgagtgcgtagaagcgctcgagcacgcgatagagggcgcccggctcgttggccgtggtgatcatgagcgaggtacggttggcaccgggatagacgcgtggctcgcggctgatgacgacaaagcgcgtgtagttgttgtccgagtcctggatgttggactccagcacctccaggccatagagtgccgcgcagctgcgcgatgcgatggcggcaacatcggtgcggtcggaattggcgaccatctcggccgacatggcggtgttggggtacttggtggcgtgcaggtcgtgggactcgataaagcccgcacactgggcaatggcttggccgtggctgtaaacctcgcgcacgtcggcgagcttggtgccgggcttgacgagcagattgtggtcgatcttgaggcgcagcgagcgcacgatgtggaaatcgaactgggcgagcaggtcgtagacggcgttgaccgatccggcagttgagttttcgatgggcaacacgccaaactcgcagaagccgtcgcgcacagcgcgcataacgccttcgaaggtctcgaaaaacgcgatgtcgggcacgtcgaagagcttgcacgcggctatctggctataggcaccttctacgccctggcaggcaacggtggccgtttgagggaagggcgtgtcggaggctgcagccgtggcgtgggccttttgcgagacggtgatgcccttgagctcgttgatgtagcgctgctgctcggctttgctcatgctcatgaggagacggaacagggtgatggtctgcgcctcgtagcgctcgggcgcgcggctggcgaggttgttgagttttgagcgctcgcgggcggggtcaaagacggccttgcccatctcgatctttgatttggcgacctcggtggcaatgtccatacgctcgacaaagctgttgaggagcgtggtgtcgatgccatcgatggcctggcggatgtcagcaaggtccatagggacccctttcgtgaatcgttgtgcgggggtagttaatttgggacggggctattttagctaccctttgactgtcggcgaatcgatgggtgccagggcaaatatgaaccggtatatgggggtagctaaaatagccccgtcccaaattaactacccttggggtgggtggactaaagctgggcggcgtcctcgaggagggcgtcccaaatcgcgagggcagctgctgcttcggcaacggggacggctcgggggacgatgcagggatcgtgacgaccgtggaccgagagttgggcgttttccatggtgtccatgtctacggtctgctgctcgcggccaattgagggcgtcggctttacggccatacgccacatgacgggcgcgccggtggagatgccgcccaggatgccgccggcgttgttggactcgaccgcaatctcgccggtctcggcatcaacgcgatacgggtcgttgttctcgctgccgcgcatggcggccacggcaaagcccatgccaaactccacgccctttacggcgggaatgccaaacgcgatctgcgcgatgcggttctcgatgccgtcgaacatggggtcaccaatgcccgcgggaagcccatagatgccgcactccacgatgccgccgatgctgtcgagttcatcgcgcgcggccagaatttcctcgcgcatgcgaccggcagcggcggcgtcgatgcagggcagatcgttcgtaaggatcgccttgcggtcggccgcgcgatagaccatgtcgtccatgggcaggtcggagatgccgccgatctgcgcgacgtgcgccatgaccttgatgccacgggcctcgagcgcctgcagcgcgatgccgccggcgatgcataggggagccgttaggcggccggagaagtgcccaccgcccgcgacgtcgtgcatgttgtggtacttcaagcgcgcagggaagtccgcatgtcccggacggggcttgcggcgcagctcggagtaatccttggagcgcgtgttggtgttctcgataatcgcggcgaggggtgcgccggtggtatgtccatcaaccacaccggcgatgatatgcgcggcgtcggcctcgcgacgtttggtcgcggtctcgtcgcgaccgggggcgcgacggtcaaggaaggcctgcagctgctcctggtccacggcgatacctgccggaatgccatcgagcgagcagccgatagcgggggagtgcgactggccgaagatgcttaagtgcaagacgttgccaaaggtcgaggacatgctattcctcctcgagcgtgaccttgccgcccagtaggcggtagtggtcgaagaaatcgggataggatttgttgacggcctcggcgccgtggatcacgacctcgccggtggcgcggctcgcggcgatggcggccatcatggcgatgcggtggtcgttgtgcgaatcgacctcgccgccggtgaaggcatcgacacccttgatgatgaggtcatcgccggcaatgcgcacctgcgcgcccagcgcggtgagctcgcgggtggtggtgaccaggcggtcggattccttgatacgcagacgggcgcaatcgcggataaaggtgcggccctgtgccagcgatgccacggccgagatgacgggcaccaggtccggaatgtcgtgggcgctcatctcaaagccggcgagcttgtcggactgcacggtggcggcgttggtggagcgaacgatgcgggcaccaaagcgcgaaagcgcggcgagcacgttgcggtcgccctgtgcggagctcagcgacacgccctcgacggtgatggggtcggtgccgatggcgccggcgcacagccaaaaggcggcgttggaccagtctccctcgacggctacgctgccgggcgtgcggtacgatccgctgtttacgcggaagttcgtgacctcgggctggccgtccttggccggaatacgttcgacgttgacctcgacgccgaaggccttcatggcctggatcgtcaggttgatgtaggggcggctctcaatgaggccggtcacttgcacacaggagggctgggccagtagcggggccgccagcagcaggccggagatatactgcgagctcacgttgcccggaagcacaaaggtgcccgggcgcatgcggccgctcgtcttgagcggaaaaccgcccagaccctgtaggtcgcagccggcggcgataatctcgtccgagagcggggacagcgggcgggcgcctaagcgtccctgacccacaaaagttgcttctgcgcccagcgcgcaggcgacgggcaacataaagcgcagcgtggagccactctcgccgcagtcgagcgtgccgccggctagggccttgagcaggccaaattcaatgctcttcatggtggggtggacctggaagccgtcctcgacggtctcgatgcgagcacccagggccgtaaggcaacgcaccgtagcctcgatgtcggcgcaggtggtgttacaggcgacgtgtgtctcgccgttggcaagcgcagcgcagatgatgagacggtgcgccatcgacttggacgcgatggcgggaacggtgcccttaagcggggacggggtgatgcgggctagcatgcggatgcgtctcccttctggccgaggccctcggcaatgagttcgtggaaagtggaaagcggcgtgcggtcgatgctgcagcggccaatgccgtgcggaatcaccaggtcgatggtgtcgcccgcgcgcttcttgtcgtggagcgcctcggcaaagacggcatcggcatctaggtcgcagcgggtcttgaggccatggcgggcgcagagctcctcaatacgaccgggcagtgcagcatcgcaaatgccgtgcagggccgcggcgcgcgtgatgatgcccatgccgatcgacacgcagttgccgtgtccgagctcaaagtgctcgcaggcctcgacggcgtgtccggcgctgtgtccaaagttgagcagcttgcgctggttggtttcgtgctcgtcggcgacgaccacggcgcgcttgatgtcgatgttgcgggcgatgatgagtgctacgcgggccacatcgcggttgagcagctccagcgtgagcggggtcttttccagctcggcgaaaagctccgggtcggcgatcacggcgtgcttgacgacctcgccgcagccgtcggcgaactgctcgggcgtgagggtggccaggcaccccacgtcggcgataaccacattcggctgccaaaagacgccggccaggttcttgccggcagcaaggtcgatggcggtcttgccgcccaccgacgaatccaccatggcgagcaggctcgtcgggatctgcacaaacttgcagccgcgcatgtaggtggcggccacaaagcccgccacgtcgcccacgacgccgccaccgagtgccacgatcacgtcggagcgcgaaagctcgtgctcggccacaaactccaaaatggcaacataggtttcggcgcgcttatgggcctcaccggcctcgaaggtgcagatgctcacctcgtagccagacgcctccagactttgcttaacgggcatctggtagagcgggcccacgttggtgtccgtcacgatgacggccttggtgccgcctgcagtggcgcgcacgagcggtcccgcctgctccagcaaaaacgtgcctacatgcacctggtaggggcgtgcggtgtcgatatcgatggtaatcgccataagcttcggtcctttcgacctggcgtgataggtggtctagtgggaggcctcgtcgtcgagtgcgcgcttaatgcggtcgccctcggcaaggagattctccagatagcgctggtcgcggtccttaagggcgcggctgtaggcgccgagcgagtcgattagatggtcgatttcgaaggcgagcgcgtcggcgtcgtcgatcatgagctcggaccacatttgcgggttgaggtgcgccacgcgggtgagatcgcggtagctaccggccgaaaagccgtggtggacctgggcggtcgggctctttacgtaggcgtttgacaccacgtgcgctagctggctcgtgaaagcgatgacgcggtcgtgctcggcggcgctggtcacgctgaacttgccaaagcccaaggggcgcaccatctcgcgcacctggcccaaaagctccagcttgagcgcatcgtccaccgcgggcggcacgagcaccaggggggcgccctggaacaggtcggcgcgggagtgcgcatagcccgagtactgcgtgcccgccatggggtgcgcacccacaaagtaaaagccgtgctcgcgggcaagctcaaaggcgcgctcgcacacgatgcccttgacacccaccgtgtcgatcaccacgggacccatgatggcgtcggtgtcggtggcgtcggcgagcgcctgggcgtgcgcctcgagccactcgatgcatgcctcgggatagcaggcaaggacgatgatgtcgcattcgccgagtgtcttgtcgttgagctctccggcgacagtgcccatgctggcggccgtcatgacatcgtcatcggggtcccaggccagcacgcgaacgcccgtctgtgcatagccgcgggcaaagctaccgccgatgaggcccaggccgacgataccggcgcacttggggccgccctggttaacacgcgcgtttctcaccgtacccatgagctactccatggtctcttggcagacgacctcgcggatggctcggatgcggcgcatggtgtcgtcgaactgatcgggggtgagggcctgggcgccgtcggaccaggctcggctcggctcgtcgtggacctcgatctccaggccgttggcaccgcaggcggtcgcggcgagcgccatgggctcaacgtagcgggtgtagccggtggcgtggctggggtcggcgacgacgggcaggtgcgacaggtggtgcagcaccggcacggcgttgaggtcgaaggtattgcgggtgcgggtctcgaaggtgcggatgccgcgctcgcacaggataacgttgtcgttgccctcgctcatgatgtactcggctgccataagcagctcgtcgatcgtgccggacataccgcgcttgagcagaatcggggtctgggtcttgccgacctccttgagcagggggaagttctgggcgttgcgggcgccgatctgcatgacgtcaatcttcttgtccaagaagacctgcacgtcgcgtggatccatgatctcggtgacgatcggcatgtcgagctcggcagacgcctcgcacagcaggtcgaggccggcggggcccatgccctggtaggcgtagggggaggtgcggggcttgtaggcaccgccgcgcagcatcgtggcaccggcggccttcacgcggcgggcgatgcggatgaggttctcgccctcgacggagcacgggccggcgatgacctggaactggtcgccgccgatcttgacgccgtggccgcagtcgatgacggagtcctcggggtggaatttacggttggcgcgcttgaacggctcggagacgcgctgcacgcgctcgacgacatccatggactcgagcaggaacgggtcgatcttggtcgtatcgcccaccaggccgatgatcgtctcgttctcgccgcgcgagacatcggtcttcagaccctttttctcaatccagctgacgatatggcttacggcctcgtcgctggcgctctgctttaaaattgcaatcatggtgtgcctctcacctcgatggataacttttgcaaaaacggcccgcatcgcgagccgtgtatatatggtgcatgagagtttatactatctgactcgcttttgccttctaaagtgggccgttgcggctcgtcttcctcggaattgcaaagctttttcttttattttgatagcccgtggtgcacttgggtataatgtcaaccgttggccctattagctcaggggattagagcgtctgcctccggagcagaaggccgttggttcgaatccaacatggggcaccatcgaacgtaagaccgtccgaacctcgcatggtccgggcggttttcttataccgacgcgacgtgatgggacgtggtatggcagcaacggatatcgagcgcggactctcaaccgccgaggtcgaggagcgtatcgccgccggtaaaaacaaccgcaacatggaactcaagaccaagtcggtcaaagagctcatcatcgagaacctctgcacgctgttcaatttgatcaacgtgatcttggctttcctggtcattttgaccggttcgtttaagaatctgacgttcctgttcgtggtgttcttgaacaccgctattggcgtcattcagtccatgcgttccaagaagatggtcgataagctcacgctgctgacctccaagaaggccatcgcggtgcgcgatggcgccgaggtggagctcgacctggaccagatcgtgctcgacgacatcatccgcctggggcgcggcgaccagattcccgctgacgccgtggtggtttcgggcgaggcgctcgtgaacgagagcctgctgacgggcgagagcgaccttattaagaaacagcccggttccgagctcatgagcggcagctttatcgactcgggcctgctgcgcgcccgcgtgatccatgtcggcgccgacaactacgtggccaaaattaataacgaggccaagtacgtcaaaaaggtcaattccgagatcatgaacgcgcttaacgccatcgtgcgctttgcgagcatcatcatgattccgcttggcctggctctgttcgcctcgagtgtaagtgggctgtgggatgccgcgggaaccccgggcgatagcgcgctttcgtggtgcttctccgagctgttggctggtcatgtgccttcgtcggcgctgctgtccacggtgggcgccctgctgggcatgatcccgcagggcctggtgctgctgacctcgtcggtgctcgccatcgccacggtgcgcctggcccgccgcaaggtgctggcgcagcagctctactgcatcgagacgctcgcgcgcgtcgacgtgctgtgcctggacaagacgggcaccatcacgtcgggtcgtatggaggtcgagggcacctacccgctgcctgttgagggtgttggctttggcgtggactcggaggaggcggctgttcccgtcgataccacagtgctcgattttgcgctggctaacgtcgcgcgtgcgacttcggccgatgccaacgagacctgccaggcgctgctcaactattacgccgatcgcccggtcgaggtgtctgagccgctgtcggtcattccgttctcgtcgtctaaaaaatggagtggcgcttcttttgcgcagggctcctatgtgatgggtgccgcgcagtttgtgctctctgatcgtgtgttttcgcaggtcgagaaccgtgtcgccgagcttgccgatacctgccgcgtgctcgtggtggcgcgcgtggacggctttacgcccgatggggatatggtgggcgaggccgagcccgtgggctttgtgaccatccgcgacgagattcgtacctcggcggccgagaccatcggctactttaacgagcagggcgtgaccctcaacgtgatcagtggcgacgacccgcgtacggtgtcgtcgatcgcgcgcgtggtgggcgtgccgggggcggacgcttatgtggacgccacgacgctcgatacaccggccaagcttgatgccgcagtggaccgctaccatgtctttggtcgtgtgaccccgcagcagaagcgcgagctcgtgcaggcgctcaagcgccgcgagcacaccgtggccatgacgggcgacggcgtcaacgacgtgctggcgctcaaggaggccgactgctccgtggccatggcggccggctccgatgccgcgcgtaacgtggccgagatcgtactcgtcgacaacgactttgcctcgatgcccgccgtggtggccgagggccgtcgctccatcaacaacctgcagcgttcggcctcactgttcctgaccaagacgctgttctcgatgggcctggcggcgctgtgtatcgcgctgccgccgtaccccttcgagcccatccagatgacgctcattaacttcttctgcatcggcgcgccgggctttgtgttgggcctggagcccaacaatgctcgtgtgaagggtgcgtttttgagcaacgtactcaagcgtgcactgccggcgtcgattgcggtcattttggctgcggcgctcgatatctttgtggcgcgcgtgtttggctttagccagctcgcgctgtctacgatgtgcctgcttacgtcgtgcgcggcgagcgtcagcctaatctggcgcatctcgcagcctctcacgcccttacgtgtggtgctctttgtgtttgtagtcgccggcatcctggtgggcgttatcggattcccggagctgctgtctattgccaacctgtcgatgggccagatggttatcttggctgttatcgtggtctttacctgctcggtgttctttaagctcgccacgatgatggattcgctcaagccgcgtcgtcgtcatgccgcaactggttttggccgcggtgtgcgcgtccgcctgggtcgcggtggcggcaaggtgagctcgacgggctcgacggccgaacgttttgccaagcgcgtcgccgccgacatggcgcagcgccgcgaagatcgcaccgctcgcgaggccgaggcccgcgcactcgagggcgtggcccaggcccagcccaagaaaaagaagagtaccggagctaagcgctctcgtgtgaccaagtccgcccaaggcatcaaagtctcgatgccaagcaaaaagaagaagtagctacgcgccctggcgatgttgaattggtgccttgttcctgtggggccgtggcgatgttatgctctaacctcgattgtttgaattgcttcgaaaagaggatgccgtgatctgcccgcattgccttaagactatcgaggacggcgcctcgttctgcccctactgcaacgcctatgtgggtccgggcgatggtcccgagcacaccgagttcgtgttctgtgagggctgcggtgcccgtctttctccgcatgatcgcacgtgcccaaaatgcggacgccctgctccgggtatcctctccgaggacgcggccgcatccgacctggcagcgggccgcacggcgggctttccgcgcctaacgcaagagcagatcgataccgaggtgcctcatgcgcccgcctcggctgccgcggttctttcggacgccgccgatcctaacgagacctgcgtgctgccggctttcgataaggatttcggtatccccaaggtcgatattcccacgcccgtttccctgcatgacgatgctcaaaaacccaagcgcaaggtgcatcccgacgaggacgcctatcacaagcacaagcgtcatatccccaagccgctcatcgtcatcgcggtccttgccgtcgtttgcggcggtgcctattggttcgtgacggccgatcccatgggtgtcatgcctgccttctacgaccagtttggccaggctgcgcagacgaccttccccacgcgccaaaagggcgaggcgactgaggacgataccaagcaggacgattctgccgaggtggtccaggaagaaaccgtgctcaccgatgatcagctctataccagactcgacggtctgtatcagaccatcgtgtcctacggtgatgaggaccagatcggcgaggtcatcgattcctttaacaacggctatctccgaacgccgctgtccacccgccaggagctgtcgcagagtgcctacgccctgcgcgaccagatcaaaaagacgcaagatgagcttaacaaccttaagtatcaggacgatacggtctatgcggacgacatcgcccacttaaagcagcttgccgagtggatgtacgagcgtgtcgacgtgatctgccagagctgggatatctcgctggccattcccgatggcgagtcgatgagttcccaccaaagcgagatcctggcgcccatcgcacagggcggcaacagcgcgctgaaccagtacgacgccaatgtgggctcctggaagccgcagcagcgttcccaaaattagttcgccatagtcggcataacctacgtgcgcaattgatgtaagcgcatgcttattgctacaattcgtacaaatatgctttaaacgcacgaggaaggaaccacatgtttggttttaagaaagagctctacacgcccgagtatcagcttgccggcgacgagtgcgccgttatcgagacgtcgaagggtaccatcaaggtcaagtttgacggcgagggcgctcccattcatgtcgcgaacttctgcgagctttccacgatgggcttctatgatggccttaagttccatcgctatgtgcccggttttgtcatccagggcggcgaccccaatacccgcgatatgtccggcgccgacgtcgccgctggtcttgagggccccgacggcatgcccggtaccggtggccccggctactgcatcaagggcgagtttgccaccaatccgcgcaacagccatgtcgatggtgcccttgccatggcacgctccatggaccccgattccgcgggttcgcagttctacttctgcctgggcgcccagcataacctcgattccggttacaccgtctttggtaccacggtcgagggtctcgatgtgatttcgcagctgcgtgccggcgacgagatcgtccatgtcgagatcgttcacgagtaaaggggacttccttgaatagccagctgatccaacagggccgcgccgcttaccgcgcgggtgatttttccgctgcagcccagatgcttggggcggcaaaaactcccgatgagattatgggcgaggccgatcaccttcgtggtaacgccttgatgcacctgggcatgtatgccgaggccgccgaggcctacaccgctgccctcaatgacggcacctacggcaagcgcggcgcgctgctcaccaaccgcggcaaggcactcgccgccgtgggcgactacacgacggccgcccaggcgttctctgctgctacgcaggatgcttcctatgccacgccgttcaaggcctatctgggcctgggcaatgcgctgttccagtcgggcgactatgccaacgcgggtactgcctttcgtcaggccgccatcgacggcgccaatccggctcctgccgccgcactcggcgagctcggtcgttgcttcattaagcttggccgtccggcggatgccgtggagacctaccgcacggctatcgactttgccggtccccgcgacgacacgcgtgcgctcaacgccggcatgggtcaggcgctttctgccgccggccgcccctccgacgcactcgacgcctttaacgccgctactgccgatggcatctaccagctcacctccgagcaggccgatgagcttgcccgcgtgcacgattcgcttgccgcgctgtctgcccagacggctatggccacggctccggcgcccgcgatggacgctcctgccgttgatccgctcgatcctacgggcgcgaccggccagtttatgcccgatccctcggacaccggcttctttacgctgtccgagtccgagatggtccagcaggaccgtcaggatcgtaagcaggccaaggtccgtcgtcgccatcgccacacgggcctcaaagtcttcatcgtgctgcttctgctcattttgatcgccgcgggcggtctgggctttgcctacacgcgcggctttggcttcccgtctcaggagtctgtcgttaccgatctgttccaggctgccggcgacggtgacaccgcaaaggccgagtcttgcctggcctcgagcctgtccgaggacgccaagtcgatgatcatctcctcgattccgcagggtgccaccgtgtccgtcgagggtatggatcagtccatgaccgagacgaccaccaaggttaaggcttcgctgtccaagggcggcgagcaggagtacaccgtcaaattcgtgcgctccgacaaccatatcggctgggccgtttcctcgctcgatatggatttctcggctgctgacaaccagtagtgaccttatgggatttagctttgcccggcgcttcaccgcaagtgaggtgccgggcttgcgctagtatgatgagctagtagttttccagcaatcatccaacacatcaggagttgcgttgttttctttgatggatatgttcttcggtagctatgcgggcgatcttgccatcgacctcggcaccgcaaatacgcttgtctccgtgcgtggcaagggcatcgtcattcgcgagccctctgttgtcgccatcgacaagaacgacgagcgcatcctcgcggtcggtatcgaggcaaagcgcatgctcggccgtacgcccggcaacatcgtggccgttcgtcccctgaaggacggcgtcatcgccgacttcgatgttaccgaggccatgctccgctactttatcgacaaggcgtctgagaagcgctatccgtggaccccgcgtccgcgcgttgtcgtctgcgttccctccggtgtcacgtctgtcgagaagcgtgccgtctttgaggctacgatccaagccggcgctcgccaggcctatctgatcgaagagcctatggccgccgctatcggcgccgacctgcccgtcgaggaacccaccggctccatggtcatcgacatcggtggcggtaccaccgaggttgccgttatcgctatgggcggcatcgtcgtctcgcagtccatccgtattgccggcgacgagttcgatcaggccatcctcacgcacgttcgcgatgcctacaaccttgccatcggcgagcgtacggcagaggacatcaagatcaaggtcggttccgccgtgccgctcaaggacgagctcgacgtcgaggtcaacggccgcgacgtgatcaccggtctgcccaagaccgtgcgcatcgagagcgaggagattcgtcgcgcgctcaacaagccgctcgacgagatggccaaggccgtcaaggacgccctcgatgccacgccgcccgatcttgcctcggaccttatgtactacggcattttgctgactggtggcggcgcgctgctgcgcggtctcgacgtgcgcctgcgcgatgagaccggtgtttcggtcaacgtcagccccacggcgctcgataacgtcgttaacggctgtgcccgcgtgctcgaggccaatgcgtttgatggcggcttcgtccagaccaatgcttaatttccaaaaggtggattccatttggcacgatcttcgggtttctccacaaatctgaataccaagcgacaatcaacgggtatgcgcccgttgattgttttcagcctgatttcggtgttgctgctcacgttttacatccgcgagggcgaggcagggccgattcatgccgtgcgttcgggcgtaacgacgattacctctccggtgcgctttgtgggctcggctgtggcggctcccttcaatgcgattggcaacgtgttctctaacctaacggcgtcgcaggacacgctcgacgagctcaagaagcaaaatgaggagctgacctctaaggtcgccgagctttctgaggctcaaaagactgccgagcgcctggagggcctggtcgggctgcaatcgacctacaatctcaaatcgaccgcagctcgtatcgttggtgcctccggcgatgcctggacctcgaccgttaccatcgacaagggctctgccgacggccttaccatcaacatgcccgtgacgagttctgccggtgttatcggccagattatcgaggtatcggccaagacctctaccgtgcgcctgattggcgacgagaactcgggcgtgtccgccatggtgcaggacacgcgcgcccagggtatgctgcagggtcaggctgacggcacgctgcgtcttgagtacgtgagcgtcgactccgatgttaaggttggcgatatcatcgtgacctctggcatcggtggcgtgttccccaagggccttccgcttggcaccgtctcgtcggttgagaaatcggcaaacgacgtgtactacaccattgtggtgcgcgctcagaccacggccgagaacaacgaggaagtgctggtcatcacctcgctgaccgacgaacagtcggcctcggatgaggacgtgagcacggccaacagcacgccgcagggaacgtcgcgcgatgctgtgaccaagacgaaggacgagagctcggatgacagttccgacacgtccgagacgaccgattctggctcgagcgaatagggggcatgtccatggatctacacgagcaggggatgagctcccgcacgtttgtaatcgccgccattgtgtgtgtgctgctgcaggcaggcctggcaccgcagatctccattgcgggaggtcgcgtcaacttcatgattatcctggtgtgcctaagcgtgttctcgggcgacccgacccgtgccgtcgtgtgcggtttttgcagcggcttgttttatgacctgtccgctgccgtgccggtgggcgttatgtcgctcctgctgaccgtgggttcttttgccctggtgcacagcgccgtcggtcagacgggcggtaccccgagtgcgcgcggcgtcaccgtgggcgcctttgcgctcgtcattaatgtgatctacagcatcatcttgctgtttatgggtttggagacgagctttgtcgtggcgatcttcggccatgcgctgccgtcctcgatcctgacgggtctggttgccattccgtttttgatgtccggcgtcgtgccgcagtccggctatggattctccgcacgtggcggacgccagacgggtatgcgctttaagcccaagacccgcaagctcaaataggggaggcccgtagatgtcttcccagatgacggttattatcgccggtatcgtgctggttgtggccatcgtggtcgcgctggtcatcatgcgtcgtggcgattcccgttttacctacgatacacagcatggaacggccccgcgcgccaccgagggcgagggcaataccgcggcgaccgcctttaagggccgcttttccatcctcaccacgggtgtgggcgcgatgtttgcggcacttgccgtcaagctgtggggcatgcagatggtctcatcggactattacgagaagcaggccaatagtaatcagactcgcaccgttaccacacccgctgtgcgcggccgcatcctcgaccgcaatggcgtggcgcttgtccagaaccgtccctcacttgctgtcgtggcctaccgcgaccttgccgaggatgaggttctggttcgccatcttgccaacgtgcttggaatgccttatgtggcggtccttcgcaatattcaggacaatacagagggcgctcagagcctgcataccatcgcgacggacgtccgtcgctccacggttgcctatatcaaggaacacgccggcgagttcccgggcgtcaagattgccgagcgtaccgagcgccagtatccatacggcgagacggcatgccatatcttgggctataccggcaccattacctccgagcagctcgaggcccagaataagaaaacctctggcgatgatgatgcttctgctggcaagattacgtaccagtcgggcgatatcgtgggccaggcgggcgttgagagctactacgaaaacctgctgcagggtattcgtggcgagcagaccgtcaaggtcgatgcctcgggcaatgtgaccggtcaggccggcgccgtgcccgcgaaggccggctccgacattaagctcacgctcgaccttaagatccaacaggcctgtgagacggcgctggcgagcgctatcgagcttgccaagaccactggctacagcaatgccggcaacggcgctgtggtgtgtctcgatcccaacaatggcgagatcctgggcatggcgagccagcccaagttcgatccgtccgtctttatcggcggcgtctcaaatgacgtgtggaccgagctcaatgatgacaagggttcgcacccgctgctcaaccgcgccattagcggacagtacatgtcggcctcgaccatcaagccgctctcggcactggccggtcttgagtttggaacctacacttcaacgcagacaaccaactgcacgggttattggacgggtctgggcaaggcttggggcaagcgctgctggctgacgtctggccacggcaccatgacgctgcagtcgggtatcgccaactcgtgcgaccccgtcttctacgacatgggtaaggcgttcttttatgacgagcaacatcccgagggcctgcaggaggtctttcgtcgctggggcctaggcaagacctgcggtatcgatctgccgagtgagggcgcgggtcgtattcccgatgccgagtggaaagagtcatacttcaccgacgcctctgccgaggaccgcaagtggaatgccggcgatatgaccaacattgctatcggccagggcgacatcctggtgacgcccctgcagatggcgtgcgcctatatgggtcttgccaacggcggcaaacagtacgtgcctcacgtatttttgtctgccgtgtcgcgcgatggcgacggcgatgcctataagtacaatggcaagggcaagaagaagcgcctggaggccaagatcaacagcgattcggatttggctcttgttcgcaacggcatgcacgacgtgatttacacggcatcgacgtccctggcggcgcactttggcaccctgacgccgcaggtatacggcaagtcgggcacgggcgagaaaagtggcgaggacgaatacgcgtggttctgcgcctatgcaccggccgatgatcccaagtatgtcatcgctaccgtcctggagcagggcggcggtggctcagataccgcgatgcatgtcgtgcgcgacgtgctcggcgtgatttatgacgagcccgatacctcttcggcctcgggcgattcttcggttcgataggaggttgcgatggatttttctccggcggatctgttccgttcaaccaagaccggctctcgcagcagcctggaccgcgtcaacaagcaactttcggcctcgcgcggcacgtttcgccaaaaggtgcatatcggtgtgctcgtggctactgtggcgctcgtcgcctacggtgccatcattatctggtcggcttcgcagtttaaggccgatgcttcgttctcgcgccatttgctgggaattggcatcggagcggtgctggcggtgctcgtctggcgaaccgacctgcgcggtatttccaatttctcgacggcgttgctcgtcatcgacctgatcgtgatcttctcgcccaagattccgggtctgtcctatacgggcggtctgggcatgacgggctggatcaagattcccggtatcggcttgacgttccagccggttgagcttgccaagctcatcaccatcttctttattgctacgcttggctcgcagtataacggtcgcatcgataccgttcgcgactacgtcaagctctgcggcatgctgtctattccgtttttggccgtcgttgccatgggtgacctgggctcgggcctggtcgtgctggtttcgggcgccatcgtcatctgcatgagcggtgcacgccgcgaatgggtgctgtcgaccctggccctgctcgtgggcctggtggccctcgtcctggcgcttgattcggtctttgattcgttgctcggccacgatgtgctcatcaagcagtatcagatgaaccgtctgacggtctttatcgaccccgataatgccgattcggacgatgcctacaacctgcagcagtcgcttatcgccgttggctcgggcggcttctttggtaagggcctggggcatgcgacgcagtcggccggcggctttctgcctgagttccacaccgacttcgtcttcgccttcctgtccgagacctttggcttttgcggttcctttttgctcctgtgcctctacgtgctgctgatcttttcgacgattcgcgtcgcctttaagtgcgagtcgctgtttttgcgtctttcgtgtgtgggcatcgttggcatgtgggcgttccagactttcgaaaacatcggcatgtgcatcggcatgatgccgattaccggtattccgctaccgtttattagcttcggttcgtcttcgatgatgattcagctgctgacggtgggtatcgtacaatccatatggcggcatcgttcgggcgccgcgtaaccgctggaggggtttgctatgaaaattcccgtagataagctgacccgcgcttttaagatgggcgcgtccgttaagaaggattccgatacgccggtgcgcgtctcggtctatctggattcgtccgcctcgcgctttctggccgagacggtgcgtgacgcctttgtgccgcagacgacctcgggcattgtgcgcgtcgagcgtctgggggaggagcgaattgctccaaagaccgataccgatgtggtgctggtgctctcgtgtggttccgaccgcttggagagtgccgtgcaggagctcgtgatcgccggcgcgcccgtgtgcgtgcttgccgagtctgctgtggaggtgccgtttatcgaggagtccacgcccatgctcggcgtggtggcggcaatcgataagacgtatctgctcgagacgcttgcccgctggattctcgatcgcaccgacaaggaaacggcttttgcggcgaactttgccttcatgcgcatcgcggcggccaaccgtatcatcacctcgtgcgcgctcaccaatatggcgaccggtgcactggtgtttttgccgggcgccgattatcccgttatggcgctggcgcaggtgggcatgctctttgagctcgctgccgtctttggacgcggcattaaacccgagcgtggctacgaggtcgcgggcgtgcttgccggcggtcttgtgatccgcgcggtcacccgcgcgctcgtcaagcagacgccgcatattgggtttgccgtcaaggcgctcactgctgccgcgggcacctatggcatgggccgtgcgctcgtttcgctctacgagcgcgatgtcgactacagccgtgccaatgaggtggtcactgccacgttttcccgcgttcgcgatcttgtgaccacggtcgcgggcgctacccgtcctatggcgtcctaccaggacgcatcagatctcgctgcttaggggttttccgttgcgcgttccgtaccaagattgttttcatttaattgagccgttgctcgccaaggtcgagaagccgagccgctatatcgatcacgagtggggcacgctttccaaggccgatgccgactaccgttgctgcctgatctacccggatgtgtacgaggttggtctgcccaaccagggcatcgccatcctctacaacatccttaaccaggccgagggcatctcctgcgagcgcggctatgtgccgtggcccgatatgggcgacgccatgcgcgaggcgggtattccgctgctatcgctcgagggtgcagcgccggtcgcttcgtttgatatcgtcggtctgcatgtgccgcacgagatggcggtgacgaacttcctcgaggctttggacctcgctggcattccgctgttagcggccgaccgaggtgaagacgacccaatcatcatcgccggcggtccctcggtgtacaaccccgagccgtacgcggccttcttcgatgccatcctcatcggtgagggcgaggaatcgctgctcgagacctgccagctgcatcgccgcctgcgtgacgaaggggtcccgcgcgcgcagattgtcgagcagcttgcatccattgccggcaactacgtgccgtcgctctatgaggttcgtcatgacgagccctgctcgccgcatggctacaccgtgccacgtgagggcaaggatgcgccgaccgtggtctacaagcgcgtcgtcgaggatttcggcgccacgaatccgctgtcgcagtcgtgcgtgccctatgcgcagctggttcacgaccgcctgtctatcgagatcctgcgcggctgcgcccgcggctgtcgtttttgccaggccggcatgacgtatcgcccggtgcgcgagcgctcggccgaccagatcgtctcgtcggtgattcagggcctggaaaagactggctatgacgaggtgtcgctgacctcgctctccacgaccgaccactcctgcattcgcgacgtgctcggcaggctcaaccgtcgcctggaggatacgggtattcgcgtgtctattccgtcgcagcgcctggattcgtttggcgtggatatggccgagtcggtcgccggcgaaaagaagggcggactaacgttcgcgcccgaggccggcagccagcgcatgcgcgacatcattaacaagaacgtgaccgaggaggacctggaccgtgcggccaaggcggccttcgaggccggttggaaccgcatgaagctctactttatgatgggccttcccggcgagcgcgatgaggacatcgtggccatcgccaatctggccgatcacgtgctggagctcggtcgttccgtggtgcccaaggctcgtcgcggctcgatttcggtgtcgatctcggtttcggtctttatccccaaggctgccacgccgttccagtggtgcccgcagctcgactacgacgacgtcaagcgtcgccagaagctgcttatcacgagcgttcgcaaccgtgccgtccgcgtgcattaccacgatgccgagacctcgctcatcgaggccgcgctttcccgcgccggtcgtgacatgacgcccgtcatcatcgatgcttggcgctcgggctctcgctttgacgcctgggtagagcatttctcgctcgataactggaaggaagctgctgccaaaaacggcatcgacctcaatgagctcgtgcacctgccctacgagttggactggcgcctgccgtgggagcacgtgagccccggctgcacgcgcggcttcctcgagcgcgagtaccgtcgctcgctcgagggcgtcacgactcccgactgtacccgcacgtcgtgcaccggctgcgggatctgccccacgctccacgccaagaatgtattgatgggtgatcgcgcatgagtgagcgcctgaccgacaacccctcgctctttagacttcgtgttcgctatggcaagcgcgatcgccttaagtacctgggccatctcgaagtaatccataccattgagcgcatcgtgcgccgtgcgggacttccctatgccgtcacgcagggcttctctccgcacatgcgcgtgggcttctcttcggcgctgccggtgggtacgtcgtcgacctgcgagtggtatgacctgtttatgaccgagttcgtggcgctcgacgaggcgtttgggcgcctggctgcggcgtctccggccgatctggcgcccatcgaggcggcgtacatcgacgtgcgcacgccggcgttgacggcgcagctcacgcgcctgtcgtatcgcatcgacctgcacttggatcccgaggcgcccgtaagcgccgacgaggtgcgtcgtgcgatcgacacgctgcgcgcgggccacggcatcgactacgcgcgcggcaaaaagagcaagcgcttggatttggatcacacgctcgtgggctatgagctcacggcgggggagcgcccggaccatttggtgctcatgctcgacacccatgccgacaacgagggctccatgcgtccggaaattttgctttctgctgctgatgttttgttgcagggcttgaccccgggcgtggatgcacctattgtttccaccggtatgcaagacctcgtgaccatctgctcctacgatgtcgagcgtcagaatcaagcatgcgaggacgacgagggccgactcgtcagccccatacctgtgcgaacttgtggatttgctccacatactcgttgacgggggtattttcgcctgctactatattcggctgttgcactaactgatgcatgaagggcaagtaaacatgtacgcaatcgttaacacgggcggcaagcagtacaaggtcgccaccgacgatgtcatcaccgtcgagaagatcgagggcaatgagggcgacaaggtcaccctgccggttatcttcctcaacgatggtaagaagatcgtcaccgatcccgacaagctggccaaggccaaggttaccgctcagatcgttgagcagttcaagggcgagaagcagctggtcttcaagttccacaagcgcaagcgctatcgtcgtctgaagggtcaccgtcagcagctcaccaagctgaagatcgtgaaggttcaggctacctcccgcgccaagaaggctgtcaaggcagaggctgaggctgttgccgaggctcccgtcgccgagtagattacactcgtaacgaaagagtaggtatacacaatggcacacaaaaaaggactcggttcctcccgtaatggccgtgactcccgcggtcagcgccttggcacgaagcgctatgccggccagacggtaaccacgggcacgattctcgtccgtcagcacggcacgcacatccacccgggtgagaacgttggccgtggtaaggacgacacgctgttcgcgctggtcgacggtaccgttgagttccacaagggtatcaagcacagggtcagcgtacgcccgctcgcgaacgcgtaattcacccttcatagagcacatatgtgggaggcacttgagttttaggattcaagggtctccctcttttttgtaggaggcgattctgttgtcacagttcaccgatatcagccgcattaacgtgtgcggcggcgacggcggagccggatgcatgtcgtttaggcgcgaggcatttgtccccaagggcggccccgatggcggcgacggcggtcgtggcggcaatgtcgtcatccaggccgatgctcagctgtcttcgctgatcgattaccgctttaagcatcactttcgcgccgagcgcggcacgcacgggcagggtgcccgtcgtaacggcaagagcggcgaggacctgattctcaaggtccctatgggtaccgtggtgcgcgagctcgatcccgagacgcagaccccgatgtttgagattgccgacctggtgcacgacggcgagcgcgtcgtcgtggcgcccggcggtgccggcggtctgggcaacacgcactttgtgacgtcggtgcgtcgcgctccggcctttgcccagttgggcgaaccggccgaggagcactggatcgagctcgagatgaagcttatggccgatgccgcgctcgtgggctttccctccgtgggtaagtcatcgctcatcgcgcgcatgagtgccgcccgtcccaagattgctgactacccgtttaccacgctcgtgccgaacctcggcatggtgcgtgccggtgaatattcttacgtcgttgccgacgtccccggtcttatcgaaggcgcgagcgagggtaagggcctgggtcaccagttcctgcgccacattgagcgtacggccctgatcatgcacgtcgtcgacatgacgggtggttttgaggatcgcgatccggtcgaggattaccacatcatcaaccgcgagctcgagcagtatggcgccgagctttcggagcgtccgcagatcgtcgttgccaacaagtgcgatgcgccgggcacggccgacaagattgccgacctcaagcgcgcagcgctcgacgatggacatatgttctttgccgtgtctgccgtgacgggcgccggcctcaacacgctgatgcttgccgtgggcgagcaggtggctaagctgcgcgccgagttggctgtctcggatgagccggtcgttctgcgcgacgatgagtgggagcgccgtcgcctgcagcgtgagaagcgtttccgcattgttcaggaagagcccggtgccttccgcgtggtcggtcgtgccatcgagcgcatggtcatccagaccgactgggaaaacgaggaagccgtcatttacctgcagcataagtttgcgcgtatgggtgttgacgacgcgctcgagaaggccggttgccgtgcgggcgacgaggtccgcatttgccagcgcgcctttgactttgagggcgccgaggacttctcggagtacgaggagctcgaggatgctggcgaggacgttgccgttgaagccattgacgtggccgatgctgcggatgagggagtcgaggttgtcgatgcggcggatgccgcgggcgatgccgagacctcggagggcgagtaagccatgtcgctgcgcggtggaatcggtctgcccgagcttcctctagaggacgggcaggagtttaggctcggcattatgggtggcacctttgatcccatccattacgggcacctggtgaccgccgagcaggcgcgcgagtcgctcgacttggacgctgtgctctttatgccggcgggctctcctgcctttaagcttgacaagccggtgacgcctgccgaggaccgttatgccatgacggtcctcgccaccgccgcgaacccggcctttttggcgagccggttcgagatcgaccgtccgggtgtaacctatacggccgatacgcttcatgcccttcgcgacttttacccgtcgcaggtaaagctctactttattacgggcgccgacgcgattatcgatattgtgacttggcatgatgccgaacgaatcgctgagcttgctacctttattgcggcgacgcgaccgggctttgatatcgatacggcgcgtgcccgaatcaaagagtcggggctgccgttcgacgtgcgctatattcagattccggcgctggcgatcagctcgacgaacattcgcaagcgtgttgcccgtggtatgagcgtgcgctatcttacgagcgagtccgtgctcggctacattcgcaaacgcaggctatatgccgatttgggccaagaagattttgagtgatgggggtctacgttgtcggtagaggatcagtttgagggcgatgagcgcgcgctgctcaagcgcattcaagagctgctcgatgttcgcatgaaggataagcgcaagcgctatgtgcattcgctgggtgttgccgagaccgcacttcatctggccgaggtctacggcgttgaccgctttgatgccgctgccgccggcctgatccatgactgggacaaagtgctctccgacgacgagctggtcacgcgcgctctgcattacggcattaagattgccggctctccttccgccgcgacgccgcttttgcatggcccagttgccgcctatgagcttccgcagctttttcccgggctgtcgccggcggtctttcaggctgtcgaccgtcacaccgtgggagcttgcgacatgacgccgctcgatatggtggtctttgtggccgatgtcatcgagcccaaccgccacggcgactatgcgcatgcgctgcgcaagatggtgggggagtcgacgctcgatgagttgttcttctcctgttttgcgcagggtttggtctatgtgatccagtccgggcgttatctttatcccacggctattacgatttacaaccattacgcccagctacgctagctcgggtgcgtctagaaagaggtattccatggccgacgagaccatgactgacgagcagattctcaaggatgtggagcacaagagcttcgccgccacgtccgaccgcaccgccgcctcgctgtccgcgagcggtgtcgccgccgaggatgtcgcccgcgccgccgcgcaggccgcctacgacaagaagggcgaggacgttcaggtgctcgacctgactgagctttccgatgtgtgcgactactttgtccttgctaccggcaccaacaaccgccaggttgattcgatcgtcgacgagattgaggagaaggtcgccgaggcttgcggcgagcatccgttctccatcgagggccgcgagcagaagacttggatgctcatggactacggttcggttgtcgtccacgtcttcactcccgaagcccgcgacttctaccgcctcgagaaactctggggagacgccccccagctccccctcaacctcctctagtagctcatttgagacggggtttagctaccctcacgcatatcgccgggcaggtgcggtttccgcacctgcccgcctttctttttgcccaaagtagctaatttgggacggggcttttttagctactacctaccgttcgccgatagaagcgagttgcggttcattgcgtgatatttagctttccgactcgggtaacgtatttgttatctgtagaggaggagatgcgtatgactcggaccgcgcgggaaatctctgtttacggctattaccatgtcgtccaaaagggctgtggtggtcagctgatatttgaggatgccgatgatcggatatatttgattcggttgcttgcctcgaaatgccgaaaatacgacgtcaatatcattgcttggtgccttatggacaaccatattcacttgttgctagatgatgaacatgttcacctgagcgattgcatgcactctgttacgactgcatatgcgatgtatttcaacgcgaaaaccggacggaagggaccagtttttcaggatcgatttaagagcgtgccgattcttaacgatgatcagctgctcaactgtgtgagatatattcacgataatcctgcgaaagccaggattgggactgcttcactatatcgttggagcagttttagcgaatatatgggatacccgggtatttgtatgactgaatgtgtgctaggtttgctcggagattctcagagattttttgctttcagtacctcgggagaaccgaatcgatattgcttccgtgacggcgctcatgtgagcgacatagatgcactggagtttgcacaggctctccttaaaccgtatgagcctcaccaccttaaagatttgcctaaagccgtgcgcgacaactacatccgtacgctcaaaaacgagggcttttcgataaagcagatcgtgcgcctcacgggcatcggtcactgcacgattcagaaggtcaagctcgatcagtagctatttgggacagagttttgttgcggcgggcaaaccggacatccggggtagtcaatttgggacggggctattttagctaccctttggctgacggtgaatgaattaggccgaatgaatctcaaccgatatataggggtagctaaaatagccccgtcccaaattgactaccaatgccgtgtcggacggaaggcagcaacccccccccgtccaaaaaagactagttattgaagcgggattggcggccgaaggaaagggcggtgtcgccgaatttgtctcggacggcgtcgatggcgacggagaggtcgcggcggtcgctggattgggctccgcggtcatcgatctcgcagaacaggtcagtctggatgccgccttggtggtcgaagtcgctcatgccgatgcccgctaagcgaacatgcatgccatcctgccagatgttgtcgagcagttcgagtgcaaccgccacgaagatgttctcatcgtcggtcggatgaggcagccggcgctgtgccgtacgcccgctgccatacgaatacttaagcttgagcgttaccgtggcacccgtcagcccctgacggcgcaggcggcgtcccactgactctcccaacagcgcaatcgccgcctcaatatccccacgctcagtcaaatctttcgcaaaggtgcgttcattgctgaccgatttgacctcgcgctcttcatcgagactcgtgacttcggagatttcgagtccttgcgcacgctggcgcatgcgttcgccgttgacgccaaaaatagaggccaaggtggattccggtgcacgtgatagctcgccgagggtgtagatgcgcatgcggcgcagtcgctcctcggccgagcgcccgatgccactcatggcagataccggcagcgcggccaaaaagcgctgctcggttccggggcgcacgatggtcagcccaaacggcttatcccgctcgcttgcgatttttgcgaccgtcttgttgcagcccacgccaatggagcaggtcactcccagccctgccacgcggtcgcttatacgccgcgcaaccagcagcgggtcttcgggcgcaaagcgacccggtgtgatatcgataaaggcttcgtcgatggatacgcgctcgacgcgcggggtctcgtcggcgagaatcgccatgacctgcgcgctcacctcgcggtagcgatcaaagtgcccgtgcgtccaaatggctttcgggcacaagcgccgcgcttcggccgaggccatggcagagtgcacgccaaagcgacgtgcctcatacgaacacgtggacacgacgccacgcgaatcggcgtctccgcccacgatgagcggcttgccgcgccattcgggatgatcgagcatctccacgctcgcaaaaaacgcatcgaggtccatcaggcccaccgccggacccgtccagggaggcggcgtgacgcccgtggcatcctcataaccgtatgtatgttcgcgtctttccatgtcatgagtataccgcgcagctcatgtggggtgcgtgtatgtgcttgcaaatcccgaattcttgtctaagatatggatttgccctcgactacaccgaagaagttggtctcacggacttcacctgcccgcgtcgatggcgtattatgttcaactgtttgtttgtagttgcagcctaaagctgcttggttggaggagtttcctttggcagtcaagattcgccttgctcgtcacggcgctaagaagcgtccgtactaccgtgtcgtcgtcgccgattcccgcgccccgcgtgacggtcgtatcatcgaggaggttggccgctacaacccgatgaccgcccccaagaccatcaacctcgacctcgagaagatcgccgactggcagtccaagggcgctcagcttaccgacgccgtcgccgctctggtcaaggccgccaacgagggcgagaagaccgagaccgtcgtcaagaagtccaagaagcagctcgccaaagaggccgaggccgctaaggctgccgctgaggccgctgagggcgccgaggagtaaatcgtgcctgaggttgacgctgcacagctcgagggtgaggcaatgctctcagatcgcatcgccgatctcgtcgaatatctcgttgttcagatcgtcgacgacccggattccgtgagccttgaggtcatcgatggtgacgacgcctctacaattgaggtttcggtcgccgaggatgacgtcgctaaggtcatcggccgtcgtggccgtaccatcaaggccattcgcacgctcgcccgtgcactggccgctcgcctcgacactgctgtcgaggtagaggttctgggctaggaccttgaggtcccagtacaaaaacatcgcccgtgtggtcaagccgcacggaaggaagggggaggtcctcgcgcagccgctgcgggggcttccttctgtattagagccgggtatgcgcgtcgccctgacgccgccggcgctcaagcgcgaccgcttttgcacggtcgtgtccgtcaccgatacgggcgatggcgatctggtctcgtttgagggcattgacgacttgacggccgccgagggtatcacgggatgctacgtgctggcaaatcgtgacgattttgagctcgattcgctcgacgctgcctataccgacctgatgggtcgcgaggtggtcgacgagcgcttcggttcgctcggcacgatcgtcgagatcatgtcgacgctcgctaacgatgtttgggttgtcgagggcgatcggtacggcgaggtactgattcccgtgatcgagcaggtcgtgctcgatcttcccgacacaggaacaatttccgtccacgttatggacggcctgatcgatatggacaagtagggaggacaacatgctgatcgagaccctttcggtctttcccgagatgtttgagcccgtcatgtccacatcgatcttgggccgcgcccgcaaggccggcctttttgatttcaaggcgtataacctgcgcgactggacgcacgaccgccatcgtaccgtcgatgacgagccgtacggcggcgggcagggcatgctcatgaaggtcgagcctatcgcagaggccatcgaggccattggcgcagagggtcccaagcccacggttgtgttcttcaccccctgtggcgagccctttacgcagcatgtggccgagcgcctgctcaaaagtgagcgcctgctgtttgtgtgcagccgctacgagggcgtcgacgagcgcgcgtatgcgtatgccgatgagcgtctgtcgatcggcgactacgtgctcacgggcggcgagcttcccgctatggtcgttgccgatgccgtcgtacgcctgattcccggcgccctgggcgacgagatgagcaatgtggacgagtcattctcgaccgccgaggacggaggactgctcgagtacgcgcagtacacccgccccgccgagttcaacggcgagggcgtgccgccggtgcttgtgagcggcgatcacgccaaggtcgatgcctggcgtcgtaagaacgccatcgagcgcacctgccgctggcgtcccgatctgatcgagacagcgcggctcacgcccgaggagcgcgcttacgcgcaggagattttggacgcttcgtattcgcagagcgaggagtgagaatggttcctacgcaacattccgcgttgaggggtgcttttgagtggatcgcggtcatcgcgatcgcactggtcgccaccttcttgattcgctcgtttgtggtcgagccctttgtggtgcccaccggctctatggaggacacaatcgagattggcgaccagatcctggcgcaaaaggtgagcctcgagctcggtcagcccgtcaagcagggcgatatcgtggtgtttcacaaccccgatggcacctccgagcatgatgttcttgtcaagcgcgttattgccacggccggccagacggtcgacctgcaggatggcaaggtggtcgttgacggccaagcgctcgacgaggactatacgacgggcatgagctggccactttcggtccaagcgcccggcgctcaggtaagctatccctacaccgttcccgacgggtgcgtgtgggtgatgggcgacaaccgcgaaaactctgccgactcacgctactttggtcccgtcgatcgctctgatttgatcgctgtggcgcttgtgcgctactggccgctcaaccgcatcggcgctatcgactaaaaaccgctatagtacagtacctaaccgtgtaatcgtttcgacgaggggatattagaggcatgaacgcttcatcgctttccttccaagacatcatcctgcgcctccagcagtactggggcgagcagggctgcgtcattatgcagccctatgactccgaggtcggtgccggtaccttccataccgcgaccacgctgcgctcgctcggtcccgccgagtggcgcacctgctatgcgcagccctgccgccgtcccgccgacggccgctacggcgagaaccccaaccgcatgcagcactactatcagttccaggtgctcatcaagccgtcgccggtcaacgcccaggagctctacctaggttcgctggccgccattggcctggatcccaacgaccatgacgtccgctttgtcgaggacgactgggagagcccgacgctcggcgcctggggccttggctgggaggtctggctcaacggcatggaggtcacgcagtttacgtacttccagcaggtgggcggcatcgaggtcgatcccgtgcccgtcgagatcacctatggcctggagcgcattgccatgtacgctcagggcgtcaactccgtctacgacctggtgtggagctacctgcccgacggaacgcccatgacctatggcgacgtgttcctcgagaacgagcgcgagttcagtgcctataactttgaggtcgccaacgtcgagatgatgcgtcagaagtttgacgactacgaggccgagtgccactcctgcctggagcgcaagctgccgctgccggcttatgactgcgtcatgaagtgcagccacgccttcaacctgctcgatgcccgtggcgccctgtccgcggtcgagcgcgctaactacatcctgcgcgtccgcgccgtcgctaaggcgtgctgcgaggcctatatggccgaggtcgccgaagtcaacgagaatgccgatcaggaaggcgaggtggcgtaagccatggcagacgctaaggatttcctgtttgagatcggtacggaggagatgccctccgcgccgctgaacaatgccgtcaagcagcttggcaccatgatcgccaagggtctcgacgaggccggtctggcccacggcgaggtccgcgtgatctcgagcccgcgtcgcctggctgcgctcgtggctaacgtcgccaccgcgaccgatgaggttcacgaggtcaagcgtggccccgcggccaacattgccttcgacgctgacggtaacgccaccaaggccgcccagggctttgcccgcaagtgcggtgtggctgccgaggacctggtccgtcgcgaggacaccgacggtcgcgagtatgtgttcgccgagaagaatattccctccgcaccggctacgccgattctgactgctctgtgcgagaagaccatcgccggcctgcagtggcccaactaccgcagccagcgctggggccacgagcacgcgacgttcgtgcgtccggtccgttggatctgctgccttctgggcgaggatgttgtgcccgtgtcgtttgccgacgtgacgagtggcaacaccacgcgcggtcatcgcgtacttggccctggtgaccatgtggttgccagccccgccgtttacgagcaggtgctcgaggacgccggcgtgctttctgccgagcgccgtcgtgaggccatcctcgccggtatcgccgaggtcgaggccgcccgtcccggctgccatgtcgatacgcccaagaaggtcttcgaggaggttattaacctctgcgagtggccgacggtgctcgtcggtaccttcgatgaggagttcctcaaggtcccgcacgagattatctgcgagtccatgctcaccaaccagcgctacttcccgatctatgacggcgagggcaagctcacgcgtgagttcgtggtcgtttccaacagcaagcccgagaatgccgagcgcgtgattgacggcaacgagcgcgtcgtgcgcgcccgtctggacgacgccaagttcttctacgaggaggacctgaagatctccctcgacgagttccgcgagcgtctggccaaggtcgccttccaggagaagctcggtagcgtgctcgccaagtccgagcgcattgagcaactcgcgcttgccatcgctcgcgaggcccatctgggcgcccacctggccgccgacgctgctcgcgccgcgcacctgtgcaaggccgacctggtgtctaacgccgtcgtcgagttcacgagccagcagggcgtgatgggcggttactacgccatcgcgatgggggagaacgacgaggtcgctcatgctattcgcgatcactatcgtcctcgctttgccggtgacgagctgcccgagggcaccgctggctgcatcgtggcctgtgccgacaagctcgataccatcgccggtatctttgccatcggcgagcccccgaccggctcttcggacccctacgcgctgcgtcgtgccgctatcggcatcatcaacatcctgcgcgaccgcctgccgatcgaccccacgtcgctcatcgacttcgccctcgagctctatagcgagcagggcattgagttcgacgccgccgaggtcgcccagcaggttcgtgacttcttccatggccgcctggtgagcatggcccgcgacgaaaagatcccggccgataccgttgccgccgtctccgcggtgcacatcatcgctccgtccgtcttcttcgcccgctgcgccgccctcgacgaggcccgcaagaacgacgccgagacgttcgacaaccttgcgaccgcctatgctcgcgccgcgcatatctccaagcccgagctgggcgtggagtacgaccgcagactgatgggcgaggtcgagcttgcgctcgccgacgcctccgaggctgctcagaccgctgtcgatgccgcccttgctaccgaggattatccggccgcatttgctgccctcgccgccctgcgcgcgcccatcgaccgtttcttcgacgaggtcatggtcatggacaaggacgagcagctccgcgataatcgccttaagctgctcaaccgcttcgaggccgttttctccggcatcgccaacatcggtgagcttgctcgtaaaaagtaagccagcctgcgcgtaagcgcaaaaggagccccgcatggattgcccggtcaccgctcgtcccaccgttatcgttatctccgactcgctcggtgataccgcttgtgaggtggtgcttgcggcgtccgggcaatttgatgaaggggcttttcgtttgttgcgcctgcccaaggtgacctcggtggagcaggtggagtcgtttgtgggcccgcgcgtcgatgccgaccatcgcgatattgccgtgtttcacaccattgtcgatccggcgcttcgcgcccgcgtgctcgattacctgggcatgctgcatatccgttcggtcgacctgatcggtccgacgctcgccgtgctatcgtcgctcatcggtgtgccgcccaaaggcgtcgcgggcgtgattcacaggaccgatgaccgctatttccatcgtatcgaggccatggaatatttcgttgagcacgatgacgggcgcggttgcgacgatttgtcgggtgccgatatcgtgctgctgggcgtatcgcgcacgtccaagacgccgctgtcgatgtatctggcttatcagggctacaaggttgccaatgttccgttggcccatggcatggagccgccgaagtcgatttacgaggtcgacccgatgcgcctgttcggcctgatttcgaccgtcgatgtgatttccgaaattcgcgatagccgcttgggcgatgactgcgctcgtgccgttgccggctcctatgccgagcccgagagcgtgcgcagcgagcttgaggaagctcgtgccctcatgaaacgcctaggctgctttgtggtgcgtaccgacggcaaggccatcgaggaaagcgctgccgagatcattagccacttggaggaaatccaagaagcccgtgcccgccgcgccgcccgtcgcacctaatagggggtgcggacagaaagttggaccgtgaagcggtccggactggaggttcgcatgtacagcagggagaaggtcgagctcttcctcctggcgacggaggacggcatggggccgaccgccgccgcgaagttcgcgggggtctcggtgggcgcggccaagaagtgggcgacggggtgttagcgctactgtaaaaacaaccaatttcgccatcgcactttagccgattccgccggcggaatcggctaaagtgcgatggcgaaattggttgtttttacagtagcgctaacagcgccatgttcaagatgaaggaggacccccgcgtcaccaagatcggcaggttcatccgcaagcactccatcgacgagttcccgcagttcctgaacgtgttcctgggccagatgtccgtcgtgggcccgcgcccgccgctgcccaacgaagtggcggaatataccgagtacgacctgcagcgactgtccgttaagcccggcatcaccggctggtggcaggtgaccgatcgcaacgacaccgacttcgacgggatggtccgccgtgatttggagtacatcgccaagcgcggccccatcacggacttgaagattgttctcctcacggtcgttgaggtctttaccggtggaggtgcttgctaaatgactgaaccggttagggtggctcaggttgttggcaagatggttggcggcggcgtcgaagctgtcgttatgaattactatcgtcacatcgatcgcagtaaagtgcagtttgactttcttgttgattccgattcgacgcttgttccccgtgacgagatcgaatcgctcggtggcagggtctttgagataccgccctatcagcatgtagctgaataccagcgagagcttcagcgtctctttaagcaagagggctggaagattgtccatagtcacatcaacgcgctttcggtctttcctcttcgtgctgcgaagaaggcgggtgtccccgtgcgtatcgcccatagccattctacgagtggtaagggtgagtatgccaggaatgccctgaaggccgtgctgaaaacgcaatcaaaccggtatccgactcaccgttttgcatgtagtaaattcgctggtgaatggttatttggatcgagttctcaatttgtagtcatgcgtaatgctgtcgacttgtctgttttcgcgccagatgatgaggatcgcctaaggacgcggcgatcgcttggtgttgctgacggacagcttctaattgggcacattggtcgttttacagagcagaagaatcactcatatttgcttaatatattcaatcaggttttaaagattcgtaatgatgctgttttagttttggttggttctggtccgttggttgaacagataaaggaccaagctgattgtctggggattagccattctgttcgatttttgggcactagaagcgacgcagcatctttatatcgagcatttgatgttttctgcctgccgagcctgtatgaaggcctcccaatggtcggagtcgaatgccaggcatcgcatacacccattcttgcgtctgatgccgttacctctgagaccgctgttacatccatgatgcaatttgaatcactttctagctcctgtataaagtgggccgaaagacttattgagttgagcacagaggtcttcgcgcctggcgacgatgccggtttgcaggtatttgaaattaatgctgcggccagagtgttattggattgttatatgacctatttaggttctgttgattaaggggatagcttgactattacatgttctaagcgagtcgcagtcgcgtcgtgtcatgacaaaatcaactttggcagcgttcttcaggcgtacgcgacccagcgtgcccttgaggaactgggagttgaagtcaatactattgataaacgtggcctgggtcatgctatttctgaaggacgcaatgattactatcttgagcatctatttgatgtagatctttatcgtgcaaagctgggttttgtaaagcatcgcatcaagcagaagcttgatgctgactttggaaagaaaatggcaaagaggaaaagtgcattttcatctttcgagtcaacacattttagttttactcctcaagccgcttcgtttgaagaacttggggcgcttgtggctgactatgacagcgttgttgttggcagcgatcagctttggctgcctgttaacattgctggtaggtactttacactatctttcgtgcggcctcctgtccgcaaggtgtcttattccactagttttggagtatcttccctttctgaaaaatatcttcgtaaaacaaaagattttctttccgatttttcggccatttctgttcgcgaggatacgggagcggatttggtagagaaagctacgggcgtccgatgctctgttgtatgcgaccctacgatgctgctggctagagatcagtgggcaagccttgcttgttcctcttcgattgacgttcctgacgagctctatgttttctgctatttcatgggtaagaatgcatggaatcgtgaatgtgcccaagagcttgccaagcagcataatttgaagatcgtcgccattgctcatcccgatgagtatgttaaggctgatgacgattacgcggattattatccttgggaagccggtccggctgagtgggtcaacttgattgcccatgcttcgtatgtctgtactgactctttccacggaagcgttttctcaaatatttttgaagtgcccttcttctcgttccgtcgccacgagaatatgggtgctcagtctacgaactcacgtattgatacattgttgcgtgtccttggaaactccgatcgtatttgcgaatcgaaggatgctttccgtgccgcaatggcaaatgaaatcgactttgtgtcagtacgtcaacgacttaatgtgtataggaatgaatcggccaattggcttaaatcagctcttgagttgtagggaacagtatgatctccatcacggacaaaagtaaatgctgcggttgcgctgcctgtgctcaaaaatgtcccaagcagtgcatatcaatggaatatgacgccgagggctgcgagtaccccgtagtcaatgctgaccagtgtattgattgcggattatgcgaaaaggcttgcccagtgcttaatgttgataaggacgagcctaagtcccaacgagcctttctagtccagcataatgatcaaaaggtgcttgctgaaagcacttctggtggagccttcactgcccttgctcaggccgtgattgccaacggcggtattgtgtttggcgcaggttatttgcgcggtgaacagcttgtgcgagccgaaggagcccctgggcgacttaaggtcggacatttttctgtggaaagcgttgatgaactttggcgcttccgcaacagtaaatatgttcagagcgttgttggccctgcgtatcccgaggtcaaacaacaactaaaaactggacgtgaagttctctttattggtaccccttgtcaatgcgaaggcctgcttcgatttttgggcggcaagccggcaaatttacgcgtggcagacttcgtctgccgcgcgaaccccgctcgcgctgtgttcgcgcggcaggtcgaatggcttgacgcaaaggttggcgtaaaaggtgagaccgttctttttagagataaatcacggtttggctatcgctattcaaatatgtgcgagctcgaaggtgagactctgtatggtgaacggctgtacagtgaaggtgtcgaaacagatccttacctaagggccttttttgctgatctttcagatcgacccatttgttacgaatgcccgtttaaaaagcgttatcgcgttactgatttgacttgctgggatttcttcgatgtttatcgactctcgaaagagttcgacgacaatcgaggcgtcactcgagttctcatccaaagcgatgagggacaagaattgcttgatcgagcctcaagctatgcccgtatgaaggagattgatgttgaggctgcagtagaaggtgttcgtgaacttactaagtccgtgaagctgaatccgcgtcgcgatgaattcatggctgatgtggcgaatctggatggtgaggagcttatgaacaagtggttccccgattccggaaaagtaaaagccgagcgctttgctaggcatacatgcgaaaagcttggaatttatgacccgatgaagcgtctggttaaaaaaatcataaagaagtagcctattgttcgaaagggaattgatgattcctaaagttctgcactacatctggttcggtggaagtgagcttcctgaacttgaaagaaaatgcattgagtcttggtcgaagatcatgcctgattgggaaattcgtagatgggacgaaagtaatttcgatataaatcaatgtgaattttgtcgtgaggcatatgcctcaaaaaaatgggcgtttgtcagcgattatgcgcgctacagaatactgtattcagagggtggaatccttctcgatacagatgtcgaagtcctgaagcctctggacgagcttttagataatgaggcttttgcgggattcatgaagaataatttcttcttgaatcccggcctcatcatgggttctgaggccggaagccatgtcatgagcgatgtcgcaaaattatatgaatctatgagatttgagatgcgaaaaggccgcaactctatggatacctctccgagggtgctaactgattacctggaagtgagttgtgctcttaagagagatggttcatttcagcagttaaatggtttcactgcataccctgctacttattttgatcccctagacagtcatagtggcaagtttgaaattactgatgatacatattctattcaccattattcaggcacctggttgtcacccgctaagaagttccgtgttgaaatgcggaaaaagcttgcgccagtaattggacccaagctgtcttggttcatctcctctgttctgtcggtacttagatttggaaggaaggctttttaatggtttcgtctgccttagaccacaataagcctagggttttagtatctggcctttcaaatgggctgggtggaaccgaaatcgttgttggtaggtatataaaggcccttagctcatatgctacgtttgaatttcttgcaacgtctgatttatcagatgttgcattcgttcatgagatgaactccgaaatccacatttgcccggatattgataggcccattaagcgctttgagtatctagaccatctatttcaagatgaaccaaatcgttaccaggcggtttggtgtaactttaatcatcttttatatgcggatgtcttgcgagcagctcaacgggcgaatgtctctgtccgcattgctcattctcacagttctcgttttttgggcggtttgccgactcaagttataagccgttttaatcgccgtgcggcgttacgtaattctaatgttaggcttgcgtgttcaaaagaagcgggttcattcttctggggcgataattttcaggtgcttccaaatgccttaaattttaatgacatggagtacgatcctgtcagcagggtagtaattagggaagagttcggcctttcgtcaaaagattttcttattggtactgttggacgtttgactagtcaaaagaatcatatttttcttttaaagataatgaaggaactgctaacagttaaatccaactgtaaattaatgattgttggcgatggccccctacgcaagagtcttcaggaatctgcggctaagctgggtatctcatctagtgtcttgtttgcaggcgaaagaaaagatattaaagacattctgtcttcatttgactgttttgtatttccatctacgtttgagggacttggtgttgccgcaattgaagcccagcttaacggattaccttgtgtctgttcatttggcgttccagatgcggctgatatttctgataaatttttaaagtgctcctttaatgttgccgaatgggttgacgcaattatttctatgggtcgtccaaataagcttgcggggggggcgtctgtttatgacgtcaacaagcaagcaggtaaattgctgtcaatcttccttggtcgacaatcctctcgtgagcgtgattgtgccgatgtataacgctgaaaaaacgattcaaaagacattaaatagtcttcagcgtcagagtgtgagcaacattgaaataattattgttgatgatgggtcgactgatcgtggcgctgagctagttatggctattgctgagggcgacaaccggattaagctgattagtcaaaataatagtggtgtatgcgtggcgcgtaataggggtatcgatgaggcctccggtgattgggtggcatttgttgatgctgacgatatgctgcctataaatgcagttaggctgttgcttgaatcctcagatggctgtagcttggttatcggggctctactgaatgagcatggcgattattcgggcaaggctataagcatcgactggaaaacagcatgctctcttagccttgcattttgggataatgttaataaagttccgttttcgagctttactaaaggtgttgtattccgaagcgtttggggaaagatatttaagaaatcattattccggaatggttttcttaaatttgaagatggcattcgtttcggtgaagacgctttgtttatggtagatgcttatcgtctggctgaaagtgtaaaagtagtggactcggcggtctattgctatgtcaacaatagtgattcagtaacgagaaatactgatatctcggctgtcgagggtgtcgataatttattgataaaactatacgagctttgtctcgtgaatccggatttgaacgatctttacaagcaatctgcagtcagggaagtcttatctttgattcgtaatcttgcacggttggaatcgaatcagctttatatgcctgtctctaatatggtctgccagccgtatttcagctatttaatggaaggttttgactctcaccgttattcacgccgtttaatctctgaaatgaagaatcatattacgatccgccttcttcttgcaaggcgagttatggctgcaattggcttcactaagtttgtttatggggtatattaattgagtttgattaatgttgaaagatcctggactgagattaaacgggtaaatgcgggtgccgtactgttcagcttcgctttggctttattttcattttcatattatattggatcagtaaatgctgccaatgtgtttgggatttctcttgcagcgctttcgctggtttttgagttatgtgccctagcgtttctactgttgaagcttttactacaaaagacttcccatgtaaaagtacttgttgggttgctattaattataatttgcgtctggtcgctgaaatcaaataaagctcctcagattatttggttggctctgctttgtctctgtgctgaagacgtccctgaatcttacatttcaaggcctattcttttatcttccgtcttaatgctattgatggttgttggtctcaatagtatcggtgctattccttctgtattaatgtcgcgcggtagcaattttgttcgaaattcgatgggttttgcccatcctaataatttcggccagcttttgtttattgcttattctgcttctatttttgagctgaaaggcaaaagcggtcttgtgggtatcttatgctttgtaattgcttttttcgtagccgattcaaaaacttctgcagctggcattttcgtaatggccttgtattcggatatttcattcaggagtcgccgttcaaaaccatatgggtccctatttagttttttaccgctatttctggcgattgttagtatagccctgcctattatgtggtcccatggtgccaataaatggcttgtccagcttgataatttaatgaccaaccggattttttattccgcctattattttgaaaactaccctctgactgtttttggtaatgacttaacggccatagtttcgctgccgtctgcaacgggcggttatttaatccaaacaagagtcatgcttgataatgcttattgtcgattacttattcaatacggtttgatcccatttaccgcgtttgttgctttctattgcgtagcgataaataaagcgcgtatttcggcccacgtgactttcattggcttggtcttgtattccttaattgggtttgttgaatgcggaatgttatatccagcatgtaatttctttatgcttatggcgctgcccaccttttcagataaggggccttgtcaatccggggtgccatcaaaggatgttttggagatggctaaataatggctaaaattaaaactaccaaggcagacattatatggaactatgtaagtactgttctttcaatggggagcagcttcctccttcttccgtttctgcttgcttacttatctagcgctgaacttggtctctggtacacttttgttgcaataggcaatttaacgctgctatttgaatttggctttacgccaacttttgcgagaaatattgtttattgtcttagcggtgcacgtagcattagcaagagcggctacgattcatctcaagttggtgattctgtagactatgagcttcttggcaaattgattaaaacatcccggcttgtttacgcattaatttcttgcgttgtcctgatgcttaccgctacagttggaactgcctacatttcttcaatttcgagtgctattgatcccatttcttgctgggccgcatggctaattttttgttttgacgtgttttttaatctattcttttttcattacacgacctgcctgagagggttcggggatatttccgctgaaagcagggcaaagtcttatggtcgcattgggcagcttgtggtgtctgctcttttgctgtttatgggttttggcattattggcgctgccatcggttatctgtttaatgacattgtactgagatttttttgcggtcgctttctggaggttcactcagaggcgatgaaaaaagcaaatagcgcttgtgcgggtgtttctatttctgaaataaaagaaacgtttacttcagtggcttatttggcgtggagggatggcgttgttcaactttgctgctatgcttccactcagttgagttccctgctctgctcctattttcttggcgtggaggtaaactctcagtattcgttaattattcaagttggtggtgcaatttacgggtttgccagcgcctacgttcgatcttttattccgatgtttcagtctgcctatgctggtggtgaagttcagactgcacgaaaaattattgaaaaaagtctgtctctatattggattttaattgttgtatgcacaatcggtgtctggtttgtcggcttccccgttttgttcctagttaagaaaggcttctcccccgacgggcttctttatttctccttggttgtttatcttgcggtttggaaccatcattcattgtgctgtaattacattatcagtacaaatgaaatcccctatcttccggcttatatagtttcggctattgcgggttttgtattgtcgtatgtcttaatttcctttactagcatgggtgtctgggcgctcgtggttggtaatggggttgctcagcttgcatataataattggaaatggcctgtataccttgcacgtaaattttcctcccattattttgcgttgattagatctggtctcgtgcagtggtcctgtgcgttgaataaataagtgttaatcactgttttaatgtgatttatgatttcaatcgcgccggatatattgatgtaaatccgccgacggccagccgtcgaaaagaaaaaatgtcccttcctagaagtcggacggtgaggttctggggctttgaatgccccagaaccttttactttatggaacggccatgactatgtgacgttgccgcatgtacgctttgccataggcaaggaaaggatatcgacaatatgatttagacatgctgctaaagttttctaacgtcacctggtacagtcaagattctttcgcaaattgatttagccgtcctcggccctgtcctcttctagcccttcgctttcccctcagctcgtccatctcctccggcttggacatgtccaggtacctcctcttgccccactcgtgctccacaatgtacttcagcctcgccgtcactagcatgagggccgaattgccgtccgggaaggccccgacgaccctcgtcctcctcctggtctcgcggttgatgcgctcgatcccgttgttcgtcctgatccggcgccagtgctccggcgggaattccgtgtaggcaagcgtctcggcgaacccgtcgcgctccgtcctcgtgcccgccccgagccgtatcgactccaactcgtccgccacctccccggccttcctgccgcatgcctcgcgcgcttcctgcgcgtggatcgccttcaacatgcgctacggcctttcgcctggtcacgggaaccctttccagcacgttgcggtagaaatcaccgcgcagtgccggtggcgggccccggggaacacctccccgagcgcaccgagcatcctcacgcacttgtttcgaccttcccggctccaatggcgagctttctggcataccggacgctgcggtaggcctcccagcccgccttcctctcgtagcgctcggctctgacgagctcggacgcctcctcgtcgagcagcgcgttggtcgtctcctcgacggtcttcctcaccagattctttatgtccttgcgcagcgactcctcgtcggttggtacgatgatcgcagacgcgtcccgtgctcccttcgtcaatgatttgttgtttagccgctggaatccatatgacggggcgcgggccgtgttccgctatgcggttgtcaatttgcgaaagaaattatgcgtcacctctgaatccccgagatgctcggcgggaacgactggttatcagcgtcaatggaaaagctctcttccttggcatctaggtgctgctgaatgcggtcggcgtacttctctgtccattcttcggccttgccatttcgcacaaagtaattgttggacaggtcggtcgagcggtaggcgtagccgtccttctgatagtttgccgtgtggtcggagtgggcgattgccatgagctcgtcggtcaggccaaagtacagatggctctggtccagatctccgtaccagttgtcgctggtgtcgtcccaggttaggtccatctggcaccatttgccgtcgatctttacggcgttctaggtgtggccgttgccggtgatgcggccgttggcgatgcccacggcgtcaaggagcttggagtagatgcgctggtagctctcgcaggtgccctggtggcgcgtgaggccgctttcggccgagcaccagttaaggctgtggtcgtactccagctggtcgagcgtccagtcgtggagccacagcgccatgtcgtattccgagccgtttgtctgttgcctgcactgggccacggcgctgttgacgatctgcgtgacgctggggcgggcggcgtcgtttacggtcacctccgccgtggtgcgcaggtagtagatccccttgtcgttttgggggtcgtttctgtcgttgtccatgaagtagaagtagatgcggtaggtgcccgatgccgtgaagtcaaaggtaaagtcgtggcccgcggtgcccaggctgcagtagctggcccatgccgggcgcgacgggtcgcagacgctttcctggctgccgccgtcccaataggtgggcacgtccatgcgcgccttggcctgggacgagccgttggcctgggttacgtggaagatcgtcgcggtgcccgcgggggcgtcgttccacgagacggtgaaggtgaagccgttttgggttgccgtggcggagtgggcgtaggtggtttgtgacgtggtggagattgcggcgggcgtggggttggtgcgggctcggagggatggggtgggggctgtggtggccgcgccggttgcggcggcggtgccgggggtggcggtgtctgtggtgttggcgtccgcggggtcggtctggctggtgccggtagatgttgcggtgctgtcctctgcggaatctgctgtcgcatttgtgttggtgccgtcttcagccttgtctgtgccgctgctcgtggcgtcggcttgcgcctgctgctcggtggtctcttggggctgaattgcctccgcgatggctgccatgggcatcgtcgcgccgaccatggacgtgcacgcgatcgcgcagagcaggtagtaaaggggtcgtttcatagcggagcctctcggtgagcagtcaatagggtccgaaggcagctccaggcctgcactccgcacatattttattggggattattttacgggaaccccagtcaacatcagcgaactttctgggggatgttggggaggggagggatggttggttgcccggtgacgttgtgaatcgcgttgggttgactatgcctgatgcggcaaatccagcataaggccgtctcgcgcttcttcgagactcgccaccgagaccttccaggaaaagtccgcaaggctgctgcctaggtcaagttctgcgtggtcgtatttttcaattttgcagcctaggtgattctcgtctggtaaaaggcgacattcgaccggtcgcgacccgatgattcgatactccttctgatatgcgtacttgggtgttttgataacgagattgtgcgggatgccctcaaagatctcgcgtatcagttttggcccgggaacgccgtaggagatgggaccgtgggcgtagatgcttccgtcgtcggtggtgtgtctgtcggcgaggcgcgcgaagctgtcgtactgcacaatgccgatccatccgtcctcgcatccgaactcctggatcatgcgtttcgggattttcacggcgttgtcgacgatatcgttctcgcggaccgtatacatgcagtagatgggcagggaagtatatctgtagaggcgcaccccgggagccatggaagcttcgagcggatcgccctgttcgccaggcaggccatgatagtagccggccgcgttcatgtagaggcgaccgtttattaggtcgtcgatgtatgcttccttgggtgcaaacttgagtaggtatgcgatgccgtctttgagcatagaagatcctttcttgggtggaggtgccctgggtcgctttgtgcgcccgggttgtttgccgccaaggtaaggccgactggtgggatcttcgtgcgggagtggtgcgggtcgctggtgttgcccgggggctgtgatcgccctcggcgtctggggtgcatgtctgtggagcgttccggggggggggctgtttccgggcaggggagtgtcggctgctgccagctaataacgaaattgggggcgagctcacagttgaggctgtcctgcgcaacctcagcggggctacgttcttcagacgcgtgttggaagtggtgcggagtgttagggcctcgccgcgatgtcgaacggtacggttatcaaggatttgctcagcgtcaagttcgaacttccggtgtgggtgcaaagtggattgggacaggacggatgattggggccatcttcgagcttgcaggtgaaataggggcggcataggatatctaatgatattcaggtttgggatgcggaccgactcgcttcgaatcgggcttacatcaactttctcgacactatcgtatgagaggaatctggtatgaagattgatttgcattgccataccatcaaggcgaaatcgggcgatggagggcgcgatattgacccggccagcttggctgaggccttagcaggcaaccaggttggtatcgccgccattacaaaccataacctcttcgacctttcaatattcaagcaatgcgtagctgaagcgtcagccaagggaatcgatctctggccgggcatagagcttgatattcgaggcaagtctagggttgtcggccatgtaatcgttattgctgaccccgtgcatgcgaagcagttttctgatgtctgtaatggcctggttcaatgcacacatcctgatgattttgttcttgattgggataagcttgccggcgcatttgtcggacaagggttcgatttcatcgtgatatctcattaccgtcccttcaagggcaagtcttataaagataaggcactgccttacgccgataatcaagcactgaaagcgagttttccagtagaaaccccgttctttttcgagccttcaaaccttaagcgcgctggcatcatgtatgccgatggggtcgattgcctgattggctcggacgtcaaagactggagcaagtattgtgagtgctcccttcctgagattaaacttgaggtcaagagcttcagccagtttctgctcctgcttagaaagacacctgaagttctcaaatccattatggacaagaaaacgtcagagcaggttgaaatcactttgttcgatgacgatgcgaagcttaccttccccgtctacaacgacgtcaccatcgtctttggcgccaaaggcacggggaagacggcgcttctaaaaaagatagagaatcattttcgggcgaaggggtggaccgatgtctcttcgtattacgcgtcagaaaacaatgacaagtataaacaaatggtgaacgtgaatcccaaagaggaggactttgttaaactcggcgtcgacgacgcgagtgataaattcgctggcatcagagcgtggaatgaaccggcagtaactccttttagcaattacatcagctgggaagaatacagtgtcgagaaaaaggacacggctcgcttcggatttgccttggcttctgcacctgtagaaccggaccttgacgcgatgagatgtcttatcgatgactataagacattgatatctagcgctaataatattcttaacaacaagattgttgaggcttgcttgagttctaacgaattcagtgaacttagatctgctgttctgagagtatgtatgaacgcgcaatcctatgtgcgatccggtttcgttgacgcctacgcacttcatctcgagtgttttacagtcaagaaaatgaaaagttacatcactgcgcgaacggggagtcctacaaagccttccggaaccgggttttcggcttttgccttaagctacaaaaaggcgagatccattttgaattcgatttccgattcttttcaaaacgagccttatgaggaaaaagtggtactcggacgtctggctgaaaagggcgacgttgtacaacatcgaaaatacttaataaatccgtcgcagggaacgaaggtctcttatcttcgcgataaggtgaaggccaagaatctaaaatcgttggttgcggcaatcggcaatgcatcggataccgccaaaactccgtgtggggcattggcctcgaaaatagccgaggttaacaagatgacagatgagatgggaattgcctcgcttaaggactgtctgggcgttacctcctatgtgtcttgtgggggagattcgagctatgagccctctaacggggagagggcgatgattgttcttgcccatgccctgttcgacgatgatgcctccatttatatcctcgatgagcctgaggcaagtatgggcaatgaatttatcaacgaggttatcgtagatagaatcaaccagctggcgaaagcaaataaaattgtcatagtgtccacccataatgccaacattgctgttcgtactttgccctggcaatcgatttatcgcgaatacgatggcggttgctatcgtacctacgtgggtaatcccttttgcgatgagcttagggatattgctgaggtcaaaccgcctaaggtgtggacacaagtgagtatggacactcttgagggcggggaatatgcatttaccgacagggagattgtttatggaaaacttaactaacggaatcgttctgaacgccggtgccgaccaacacgtgattacggttacgttgcgtatgaactcggagggcaatgaggtccttcactttgaagacgctccggaagagttggacatcgactttgcgaaaagcgaccagacctctctacgcaagttatttcgctggctgttggatgagcagctcaagcaaagattcagcctgaaattaaagattgactcctcggttaagaatgtcacttataaaaaggtcgctgaggattacgtcaatgacctcaacgctgaaattgatcaggtctttttaaatgaagctcagaccataaaggatctacatgagaaattgggatagagcccggaaacggtaggggttctggggactcataagcctcgattagtttgaggtatctttaaagatgactcccgataacgtcttgataagggctgcttcgaatattggtagtatagttgtttgcgaatttgtgtatgagacgcttgactaatgtgtcctcgtggagtgcgatgccgtctttcgggtcgctgcgggcgcgggtatgtagagtgcttttatgcgttggcactcgtcaaccgctagggcgatgcagtacgagttggggcctcttttctgcttcacttcattaaggtgtatagtatatagcgcaatattaaagctctttgggagctttaagggtgacgctttctgtaagagagtgttgcccttttttcatgcatgtaatgtgtgacgtgttagctaaacgccatttcggcaatgggatggtcgagtatgggcggtttggcaccttgcgcctgctgtcattggtgtagcaagcacttgatttagactacttaaagtctataatcaaagaaaaactctgatatatcttttcaaaataatgaaaggaatgttgagtaccatgctttgtcagttcacctttaagaactatcggtcctatcgcgacgaggctgagctttccatgcaggcgacgccgatgaaggagtttgagcgttccctcatcgagtgctccgacgggcagagtttccttccggtggctgcggtgtacgggcccaacgctggtggtaagtctaacctgctcgaggctcttgattacgttcgttcggcggtggccagaccaattagattgctgtctgccagcgctgatgcgccagcgggtgatcgccctttgatagcccgttgttcggcgtttgaatttgatgacgtgtctgctgccgagcccaccgagttcgagctctattaccgcgcgggcgagcatgagtaccgctatgttctgtctgtacacgccgatgagatcgtgtccgaagggctgtggcggcgtaaattgggagcgtcgcgtacggcgatgctgttcgagcgcgaggatacaaaggttgaactcggccccacactgcgtaagcttgtgacggctgcgaggttcaacccgagcctgccgtacctatcgttcctttgcatcaacttcgatgcgccggtggtccaggaggcggccagctggtttctcgacgctgtgtttctcaactacaacagttcctaccttgagcggatgctcgagcaaatgctcgacgagggcgactcgcgcgaggtcacgcgttttttgcgcgccgttgatgtgcgtattgatggcttcagagtggagagggcgccggagtggcgcggccagcgcgtcttcgtgaggcacaaggtgaggggcaaggcgtacgagctgcgtttatccgaggaatctgccggtacccagaagctcatggggttggctgcgtatctgatgacagcgcttgagcgtggtggcaccgttgtggtagacgagctcgacgccaaactgcacccgaagcttcttcgctatgtgattctgctgtttaaggatcctgaggtcaataagagtggcgcgcagctcatcttctcgtcccaggatgtgtcaaccatgcgaaacgatgtgttccgccgtgacgagatatggttcgctgcacgcggcgagggggaggcgagccaactgtggtctctcgccgatatccacgaggcaaacggtaatctggtaagcaagaacgcggctttcgacaagcaatacctgtccggtcgctacggcgccgatccgtacctcacccgcatcgaggagtgggattagcatggtggtgaagaagtcgaagggctggcgtagcggcaagcgagagggccgctcgcgcatggttcagatgacgcgtcatcttgtagtgagcgagggcaaggagaccgagcctcgctactttgagggcgtgcgtgcggcgttgggcgcggcgaacgagcgcaaggttgccattgtcgttaaggggaccggcagacacacgcttgacctgcttgacttcgccgtcgaacactgtcgctatgcgcccgagacgttcgatcacgtgtggctcgtgtatgacaaggatgactttcctgcgtccgactttgatgcgatgaagcgcaaatgtgacgagctctccgatggttcgaggaccttccatgcgttgtggtcgaacccctgcttcgagctgtggccgcttttgcactttcgctacacgaccgcgcatatgtccgcgtccgactgccagcatgccctcgcgcaggagatgtcgaagaacttgggcatcgagtaccgcaagaacctggacgggatgtttggggcagtggatgataggcgaggcgaagcattggagcgtgctgggcgcctcgtcgcgtaccatagggaactgggtaacattaagccatctgcgcaaaaccctgcaactaaggtgggcgaaattttcgatgtaatcgggccgtatctggttggatagccgagttcgatcgggctcgataggtctggagattcatgaaagatgttgttttgggctgcctgccgtttttaactggattgaccttttgggaccctataggagactagggcgaatctagcggtattgacgcaaccaacctacgggcctgcgtcctacagaaaggcggttgttttccggatggccgcctttcttcattacgcctatgaagagaggctttattgaagagtattcggcgtaacagtcatatctaggtgattcgcccagttaaacgctcttacatagtatctcgagccaatcagcgcgaacggagatctaatggccgccgctaatacaaagccgtggcttacggcgtccgagcagattgaccgtctcaaatcgagaggtgtccatttcttgctgatgagcgaagacgatgccagagcttacctggaaaagaacagcatctattttcgtctgcgtgcttatcgacttgggtttcctaaagttgagaagggaaatcgcaagggagagtatgcaaatctagacttttacgcggaaacggaaacgagcgatacccgtgcctatgagcaagcactagatattgagtatattgttcatcgcgagatgcagcgctcgggcttgagtaaaagcgagctgacaaaacgtatgggcgtgagtcttcagtcgctttcgaaattgttgaattctcagcccaacatgacgctgaaaacggtcacaaagtttgagcttgcgttgggtatcaaaatcattcctcaggtcatttccggttattcgaatgaggcaccgttttttctctccaatgcgatttccatggcgtatggtcacgctaagagatatctgatggtcgttactggactttcgcccatgggggctttgacgctgccggcaattcttccttcggaattggcagtggacagcgatacgtctttccaaagtgagttagttgttttcgagttggattttgcatgccactgtgtgcaaatgtaacggggtgccgaatcggcagtttaactgattcggcacttatatttcgaagtttttagttgaagccctgcgatgcccgtgctacgacagctaaattgaccgtgacgtcctgtcttgcgacacgcatgtcgctccgcatgggtatcatggtgaaagcgatttcaatgacaggggtgctcgtggtaaagatgaaagatgtggccgagctggcgggcgtttcgagcgccgccgtctcgcgctacctcaacggtggatatatctcggcggacaaggccgagcgcattaagcatgcaatcgagctgaccggatacgtgcggtccagtcaggctcgcgcgctgcgcaccggttccaccaagctcattggcgtcatcgtacctaagatcaactccgaatccgtgagccgcattaccgccggtattggccaggtgctcggtcgtcgtggctaccagatgctccttgccaacaccgacaacgcggccgatcgtgagctcgaatacctcgatttattccaaaaccacccggtcgatggcattgtgctggtggcaaccatgatcaccgacgagcaccgtcgcgcgattgagtcgtgccgcgtgcccattgtgttgatcggccaacatgtcgagggcgcggcatgtgtctatcacgacgattacgaggctgcctttgagctgggccatgcgcttgcgggtcgcttggatggcaagattgcctacatcggagttacggatgaggaccgcgcggccggtttcgaccgtcgtcgaggttttgaggccggcttgcgcgccgcgggcaacccgctcgatgccgccttgattcgcctgggctcgtttacgctcgactcaggctatggtgcggcgcgtgagctgctttccgtcgctcccgatgtttcgtttatcgcctgcgcgaccgataccatggcggcgggcgcgctgcgtgccatcgatgaggttcgcggcatgggcgagggtatacaccgcgtgagtggttttggcgacaacgcgtttttgcgcgcgctgacgggcggcattcccaccgtgcattatggctacctgaccagtggcgtcgaggcgaccaatatgttgctcaatacgctcgatggcgaggaaggggagagcggtctcaagacgctcaaacttgggcatcagctcatgaatgtctaggccttggacgcgtctgcctgcctttgagtccccagtttttgtctcaaaactaccattcgccggctatttcgtaccgttcaccctactatgaaaacgattacacacatatgaaactgaaatcgattacagtgtaagtgtcaaagatggccgggtgcacgtgcgcccgttggaggaaggggaagtcatggactaccgcaaatcagcccaagaggtgctcgacaatatcggtggcgccgacaacgtcgtctctgccgcgcattgcgccacgcgtttgcgcctggtgattgccgataacgcgaaggttaacaaggaggccctcgagaatatcgacggcgccaagggcgtctttgaggctcagggccagctccagattatttttggcaccggcaccgtcaacaaggtctacgaagagttcattgcgctcagcggagtcgaggctgccaccaaggccgaggccaaggaggccgcggcacagcagcagaacatctttatgcgtgccattaaggtgctcggcgacgtctttgtccccatcatccccgccatcgtggcttcgggtctgctgctgggcattatgagcgccctcaactttatggcctccaacggctttatcgcgctcgacaccaataactttatctacaagattgccgacctggtctcgggtacgtcctttggcatcctgcagatcctgattggctactccgcggccaaggctttcggcgctaatccgtacctgggcgccgtcgtcggcggcgcgttcatcaactcctcgctgcagagcgcctacacggtcgcctccgagggcgtgcagaccatggtcaccgtcatccccggcgtgtacagctttgagtgggttggctatcagggccacgtcatccccatcgtcatcgcttgcgcgatccttgccttcctcgagaagcgtctgcacaagatcgttcccgagatgttcgacctctttgtaaccccgcttgtctccgtgttcgtgaccgtgctcgtgacgcttatcgccgtcggtcccgtctttgtgtgggccgagaatgccgtcctcggtctgatccaggctctgctcaccctgccctttggcatcggttcctttatcgtcggcctgttctatgcccccacggtcgtcaccggtattcaccagatgtacaccgccatcgacctgggccagcttgcccagtacggcgtgacctattggctgcccattgccagtgccgccaacatcgcccagggcggcgccgcgcttgcagttgcctttaagacccacgatgccaagatcaagggcctagcgcttccttcggctctgtccgccttcatgggtattaccgagcctgccatctttggtgtgaacctgcgcttctttaagcccttcatcgctggctgcatcggcggcggctgcggcgccctggtctgcgcgctcacctcgctcgccgcttccggtacgggcgttacgggtatcttcggtatcctgctgtgcctggcccagcccgtgcagtacgcgatcatgtttgcggtcgccgcgctggtttcctttggcgtctcgtttgtcctgtacaaggacgagcccaaggcttccgagcaggcctaagagcttttgattgaagggtgcccgcgggttgtatgctcgcgggcgtttcccgtatccggtgtcgatctctggcgccttgttactttcgatccgttaggactttgatatgtctaatgcacttggccgcgaccttgcaaagctggttgccgctgttgacgctgccgcctctgagtgcggccatggcgcgtatggccagcgcttccatattatgccgccggcgggctggctcaacgaccccaacggtctttgccaagcgggcggcgtgtttcacgcgtacttccagtatgccccgtttgatgtgaacggtggcgtaaagatgtggggccatgccacaagccgcgaccttatgaactgggaatatgttggcgccccgctgctgcccgacgagccgttcgattgccatggcgtgtattcaggctccgcgcttgccgaggacggctgcattcgcgtgctctatacgggcaacgttaagctttccgatgcggacggcacgtacgactacgtcaataccggccgtcgcgccgatactgtttatgtcgagagcgttgatggccttgccggtcgggagttcagccaaaagcgcgtggtgctggcgtccgatgattatcccgaggatttgacctgccacgtgcgtgaccccaaggtgtggcgcgatgatgacgggcgttaccacatggtgctgggcgcgcgtcgtcgcgtggatgggccgcatgtcgatagtcgattttgcgccatgcacggcgagggtgccgggcgcgatgtgggcgagatcctggtgtatggctcggccgatatgctgagttgggagctcgagagtcgtgtgtctacgcccgagcgctttggctttatgtgggagtgcccgggataccttgagcttgagccggatggcggtgtaccggcgaagtggctgtccttctctccccagggtcttgagggcggtcgttgggaccgcggcaatgtgtatgcagcgggctacatgcctgtaacgggcgacattacgggtggcaatgacgcttatgagctgggcgagttccgcctgtgggatgccggctttgatttctacgcgccgcaggagtttacgtccgaggatggtcgccacattctgatcggctggatgggcatgcccgatgagccgacctatgacaacgcaccgactctggtggcgggctggcagcactgcatgacggtgccgcgcgagcttacggccggtgacggcggcgtggtgctgcaacaaccggctcgcgagatcgagcaccattatgcctcggtgcgtgtgggggagggctcgttggaggttgcaggcgatacctgctttgacgttgttgccgacggtgtcgacggcgcgtttaccgcgaccgttgatagcgagcttaagctggcgtttattcccgccgagggcgaactgccctcgcgctttgagatgcgatttaccgatgagggtcgcgcttctgccggctgcggtcgtaccgtgcgctgggagcccgtcaacgaggttcgtaacgtgcgcattgttggcgatgtctcgtcggtcgaggtgtttgtgaacgatggcgcgctcgtgttttcgacgcgcatctatcccgagacctatggcgtgtccgttgatgctccgggtgcgagcgtgacctaccacgcgctcaacatctaggcgattcgtcgcatatcggcgctatactgcagccgttgcccacgatgcggggaacatccgtatcgtgggtttttgtttctgaagggacggtaccgtatgggcgtacagcagctagaagatacctgggctttgagagccggcgcgcgtgaggcgcgtcttgttgcggcctcgcatgtaccggcggcgctgtcgctgctgggaatcgtgcgtcccggtgaccgcctggtggcctttgcggacgactttgccgatgcgtttgctcgtggctttgatggccgcgatgttgtgctggtgggggagccatcggctgcagcgttttctgctgcgtccgagggatttgatgcttcgtttgatgctgagggaccgcacctgtggtggtttgtgaactcaatcggtggctttggcctgcgtgtgcccgatctgcgtgcgctgggtcgggcggcgcgtgaggcccatgcgctgctggttgtggacaacaccgtggctgacgtctttggctgcgatccgctgcggctgggtgctgtgctgtcccttgaggcgctcgaccgtgtgtgtgccggtgaggctccacgcaagctcgttgccgcttcggtcgcgcgctcgcagctcaagcgccatcgcgtggacgctgcggccgagtgcgcgcatgcgctgctcgagtggtgcggattggccgcgctcgacttgtcctccgatgaggccgaggttctagagcacgggctcgacacgctcgacacccgcatgcaggcacatttcgatcgcgcccgtgcgctggctgaatatttggccgcgaacgagatggtgcgcaacgtgcgctatcccgggctgacctcgcatcccgaccatgtggctgcaacgggaattctcgagcacggctttggcccggcagtagagttcgatcttatcgaacgtagcgcgggcgagctgttcgatgctttgcctggggagtttcgcacatcgcccgcaggcggcgcaacaacgcgcctttcggctccacgcagcaagcaggggggcaccatccgcctcttcgccggcaccgacaaccccctggttgtagcgtccgccctagacaatgcccttcgtaaactagctactctttaatgcttgcgatgaggtcgcttgctttggtggcgatgacgttgttgacgtcggcccgcagctcctcgtagaccgctatggctcgctcgccggcgggggtgagggtggatccgcgggcgccgtcgcgctcgatgagtttgcagcccagctgaccttcggcctcgttcacgatgcgccaggccttggaatacgccatgcccatgctcttggcggcgcggttgagcgagtgctcgcgggcgataccctgcagcagcaagacgcagccgtgtccaaacacgcccggcagatctttgtcgcacgcttgaatgaccaactttgccgtcgtcttgtactccatacgctccacgtctccccgctaaagtgtttgctgggcaaacgcaaagcctgcgtcaaaccctcgtgtgctcttcttaaatcatgcattgtagcagtcaaagtgcgttaagatacttccccagtattgggcgcccaaggttgggctgggtcctacgaggcctgcagccgaccggtcgcatggaaaaaggagaaacatggctacgttctttcccggtgagtcccacacgttttcggagtatctgctggtccctggttactcgtcctcgcagtgcatccccaacaacgtctctcttaagacgccgctaacccgctttaagcgcggtgagaagccggcaatcaccctgaacatccccatggtttccgccatcatgcagtccgtctcgggcgtcgatatgggtgtcgcgctcgctaccgagggtggcctgtccttcatttacggttcccagagcgccgagtccgaggccgctatggtcaaggccgtcaaggatcacaaggccggtttcgttcagtccgattccacgctgacccccgacatgaccatggagcaggtcatcgagctcaaggagaagaccggtcactccactatgccggtcaccgacgacggcactcccaagggtaagctcctgggcatcgtcaccagccgtgactatcgccccagccgcgatgaccaccagacgaaggtctccgagttcatgaccccgcgtgagcagctcatcgtgggtgacaagaacatcagcctcaaggttgccaacgacgttatctgggacaacaagctcaacgccctgcccatcgtcgacgataacgatcacctcatgggcattgtgttccgcaaggactacgacagtcacaagactaaccccaacgagctgctcgataacgacaagcgctacatggtcggcgccggtatcaacacccgcgactatgccgagcgcgtgccgctgctcatcgaggccggtgccgatgtcctgtgcatcgactcctccgagggcttcagcgagtggcagaagcgcaccatcgagtggatccgcgccaactacggcgaggacgtcaaggtcggtgccggtaacgttgtcgacgccgagggcttccgcttcctggccgactgcggtgccgacttcatcaaggtcggtatcggcggtggttccatctgcatcacccgcgagaccaagggcatcggtcgtggccaggccaccgcgctgatcgacgtctgccgcgcccgtgacgagtactacgaggagaccggcgtctacgtgcccgtgtgctccgacggcggtatcgtctacgactaccacatgacgcttgcccttgccatgggtgccgactttatgatgctgggccgttacttcgcccgctttgacgagagcccgactgagcgcgtcaacgtcaacggccagtacatgaaggagtactggggcgagggttctgcgcgtgctcgcaattggcagcgctacgacctgggcggcgccgcgaagctcagcttcgtcgagggcgtcgactcctacgtcccgtacgccggatccctcaaggacggcgtgggcggcacgctctacaaggttaagtccacgatgtgcaactgcggcgccctctcgatccccgagctccaggaaaaggcacgcctaacgctggtcagctccacctccatcgtcgaaggcggcgcccacgacgttgtcgtgaaggactcccagcaaagcgtcagctaccgctaagcggctttcccaagcaccgcaccttgccgttcaaaccgtcgctcgcgtaccaaagtacgcgacgctcctctttcacggcaatctgcggcacctggaaaacccgttcgtgctagaacgagtttcagacaaaggttgattcccaaccacgttatttagataaagcgagatgcctgcaagtcgcaggcatctcgcttgttgtatttgctatcatcatgcgagttaacgatgtggcggggcgttcttacctttgctcgctgcaagttccgcacgagccgaagagcacttaatgtgctcttcgtgcgagcaggactgtccgcagcagcgagcaaaggtaagaacgccccgccccaaccgagataacaaaggagctgatatgtgcgattgcacagatcataaggacgagattcctgtttacgacgcgcaggccatcgagtcccggtggatgaaggcctgggaggactccaacctctttgctgtcgacaccgacgacagcaagcccaagaagtacgtgctcgagatgttcccgtatccgtcgggcgacctgcacatgggccacgcgcgcaactataccatcggcgatgccatggcccgtcaggcccgcatgcgcggctatgacgtgctgcatcccatcggctttgacgcctttggcctgcctgccgagaacgccgccatcaagcacaacacgcaggctgccgcctggacgtataagaacatggaccaggcgctcgccacgatgaagcgcatgggcttctcctacgatctggatcgcatggtcaagacctgcagccccgattattaccgctggggccagtggatctttgagaagatgtgggaaaagggcctggtctaccgcaagaagaacccggtcaactggtgccccacctgcaagaccgttctggctaacgagcaggttaccgagggcaagtgctggcgctgcggcaccgagcctgagaagcgcgaccttgagcagtggtactacaagattaccgagtactctcaggagctgctcgacgacctggagaagctccccggctggcccgagcgcgttaagcagatgcaggccaactggatcggtcgctccgagggcgccgaggtcgactttaccctgtgcgaccaggatggcgagcccatcgagggcgatgagggcaagatcaccgtctttaccacgcgtgccgacaccctttttggcgtctccttctttgtcctggctcccgagtacgccggcctgcatgagctcgtcgagggcacggagtacgaggaggccgtcaccaagatcgtcgaggactccaagcatatctctgccgtcgagcgtgcccagggcaccctcgagaagcacggtgcctttacgggccgctatgtggtaaaccccgtcaacggcgagaaggtccccgtgtgggttgccgattatgtcgtcgccgactacggtaccggtgccgtcatggccgttccctgtggcgaccagcgcgactttgagtttgcccgtaagtacgacctgccgatcgtgccgatcatcctagacgatgacgatcgcgctgccgtcgaggccagcggcgagaccatcgataccttccatgccgagaccgtcgactgggattgcgctcacgctgccgagggcaccctcgtccagtccggcaagtacaccggcatgcgcggtggtaagcactccgagggcgaggctgcaatcgtggccgacctcgaggccatgggctgtggtcgtcgcaaggtcgagtttcgtctgcgcgactggctcatcagccgccagcgctattggggcaaccccatcccggccatccactgcgagcactgcggcatcgtgcccgtgcccgaggatcagctgccggtgacgctgcccgagaaccttgacctgggcgccggcgagacccttgccgagtgcaaggagttctacgagaccacctgcccggtgtgcggccgcccggccaagcgtgagaccgataccatggacaccttcacctgctccagctggtattacctgcgctataccgatccgcacaacaccaagctgcccttctcccgagaggccgccgaccgttggatgcccgtcgataactacattggcggcatcgagcacgccattctgcacctgctctacagtcgcttctttaccaaggcgctgcgcgacctgggcctgctgagcgtggacgagcccttcaccaacctgctgtgccagggcatggtcaaggacgagaacggcgacaccatgtccaagtccaagggcaatgtcgtgcccccgagctcggtcatcgagccctacggcgccgacaccatgcgtttggcgatcctgtttatcgctccgcccgagaaggacttcgactgggatcccaaggccgttgagggcgccaaccgcttcatcaagcgcgcctggcgtatcgtttggcagctcgtccagtccggtgacgccaacgtggccttcgacaagtccgcgctcgacgaggttgcgatgaagctctatcgcgagcgtcaccgcaccatcgccaagtgcaccgaggacttcgatcgcggccagttcaacaccgcgatctcggccgtcatggagctcgtcaacgcggcgagcgcctacctcaacgccaccgagggtaccgcccgcgacaaggcgctgtgctacggcgtggctaaggatatcgtgagcgtccttgcccccatctgcccgttctgggccgacgagctgtggcacgaggccctcggctgcgagggcaacgcctacaccgccgcctggcccgagttcgacctggccgagtccgttgaggacacggtgcagatcgtggtccaggtgctcggcaaggtccgcggccgcgtcgacgttgcccgcgatgcctccaacgaggagatgcaggctgccgccgaggccgccgtcgccaagtggctcgagggcaagacggtcgtcaaggccatctgcgtgcccggcaagctggtcaacctggtggtcaagtaagcgctgcgcgcaaagctgacatgcaataaacgagggacggtccgtttgggccgtccctcgttttgcatgtacctgccatggtgtcttcggtcaattgtcctattcttgtggagaagctgtgcgcacgctgacctgcagattcgtactgtgcttgcacgtttccgcagctattggtatagtttgcttgcaaatgaagttgtaattgaaagaagtggggtttcggccccgcttcttttttgtatggatggaggtgccgcaatggtcaagaccaagaccgagcaggcgatcatcgacgcgctcgaggccgtcgctccccagcacgatgtcgacatcgtcgacgtcgagctcgtgggtgccaccaaggccccctgcgtgcgcgtgcgtatcgagggtgccgagggtcagagcctttcgctcaacgacgtcacggccaacaccaagtgggtcggcgatgtgattgaggagctcgaccccatctcttcgagctatacgctcgaggtgtcgagcccgggtatggcgcgcccgctgcgccgcccgtgcgactttacccgctttgtgggcgagaactgcgagctcacctccaccgctaccgagggccgtcgcaagtacgccggtaagattgccgccgccaccgagacgaacgtgaccctcgagctcgagggcggcgagtccgttaccctcgatttctctgatgttaaaaagtgcaagttgaagcccacctacgacttcaagcccgcgaaggaaggaaagtaagatggcagcatccgacatgatgtccgccctgatggagctttgccaggagaagcacatcgaccagctctacctgatcgaccgcctggagcagtcgctcgccaagagctatgccgagatcctgcatcttgagtggggcgccaaggtgaccatcgaccgcaccaccggcaagatctacgtctaccgcttggagccgatcgacgattccatggacgaggagggcaacttcaccgagttcgaggagattgacgtcacccccaagaacacgagccgcatcgctgcccagcacgccaaggccgagatcaacgccatcgtgcgcaactccgcccgcgagcagatctacgaggagttctccggccgcatcggtgacctcatcagcggtaccgtgctgcagtccacacccgacttcacgattgtcaagatccgcgagggcgtcgaggccgagctgccgcacttcgaccagcgccgttacgagaacgagcgcaacgagcgtccgatgggcgagcgctacctgcacaaccagcacatcaaggccgtgatcatcgacgttcgcgaccccaactccaacctgcagccggttcgtggcgagcacagccgtccgccgattgtcatctcccgtacccaccccgagctcatgcgtcgtctgtttgagcaggaggtgcccgagatctatgagggcaccgtccagatcaagtcgatcgcccgcgagcccggccagcgctccaaggtcgccgtccactcgctcgacgaccgtctggatcccgtgggcgcctgcgtcggccccaagggcagccgtgttcgcgctgtcgtgggcgagctccgtggcgagcgcgtcgacgtcatcctgtgggatgccgatcctgccgtctacgttgccaacgccctttcgcccgctaaggtcacccgcgtcctcatcgacgaggagaaggcctacgccggcgtcatcgtgcccgacgaccagctgtccctcgccatcggcaaggagggccagaacgcccgcctcgccgcgcgcctgaccggctggcacatcgacatcaagtccgagacgcttgccgccgacatcctcaagaacgttcccgttcacgaggagcccgccgccgacctgatcggtgacgaggaggacgaggacgtccgccgctgcgagtacgtgtccgaggacggtatccagtgccgcaaccaggctcgtcccggctcccgtttctgcggtgtccacgacaccgacgccttcgatgatgcggaggacctgatctagcgcgcgttcgcgccgggcgggtcccggcgcgtcttccacgctcgttcagtctctaggcacccaaggtgccagaaagggtaggtgaagtcatatggcaaaagtccgtgtgtccaccctggccaaagagttcggcatgacctccaaggaactgatgggtcatcttgccgaaatgaagattcccgctaagtccgcttcctccgccctggaggacgcttacgtcgccatggtccgcaagcagctcgcctcggtgatcgaggcccgcgccaaggaagtcgaggccgtcaagcaggccgaggaggaggcagccgccgccgaggaggcagcgcgcgctgccgaggccgagcgtgagcgcatcgccgccgagaaggcacgcgaggaggagcgccgccagttcgccgccgcccaggctgccgaggaggccgcccgtgccgaggccgaggccaagaagaaggctgagcaggagcgccttgcccgcgagaaggaggaggctgcccgcgaggcccagcgccgcgccgtccccgcttccgactccggttcgcgcttccgctcgctgctcgaccagatcgccgcacaggagaccgtgctcaaggagaagaaggacgccgaggagaaggccaaggccgagcgcgcctctgagcgcggcaaccgtcgtagcggcaacaacgaccgtcgcggtggccgtcgtaacgatcgcaacgcctccgacaacaactccgatcgcaatgcctccgagagccgtccgcacagccatcgcaccaacgccagcaacaacgtcgctgccggcatggacttccccaaccccgataagcagggtaagggcaagaagcgcaagggcggtcacggcaacgatgaggaccactacagccgcatggctcgtgaggccgaggagtacagccgcgagaaggtgctcgaggaggcccgcgccgccgtcgaggaggcctctcgcgagtccaccggtcgccgcaagaagcgcaaggagaagcgcgagcgcgaggctgctaaggctcaggaggagcgcaagattgaggaggcgctggcccagggcgtgaaccccgaggagctcgacgccatcaaggtctcccagggagttaccgtccaggagctcgccgaggcgctcgacgttccggccaacgacatcatcaagcgcctgttcctgctgggcacgccgcttacgatgacgcagtccatgtccgacgacctcgtcgagctcgttgccgacgacctgggccgtcagatcaagatcatcacccccgaggaggagaacaccttctcgttctacgacgatcccgccgaccttaagccgcgcgccccggtcgtcaccgtcatgggtcacgtcgaccacggcaagacgtcgctgctcgacgccatccgtcacaccggcgttgctgccggcgaggcgggcggcattacgcaggccatcggcgcttcgcaggtcatgatcaacgaccgcaagatcaccttcatcgataccccgggtcacgctacctttacggccatgcgtgcccgtggcgccaaggtgaccgacatcgtcatcctgatcgttgctgccgacgacggcgtcatgcctcagaccatcgagtcgatcaaccacgccaaggccgccggcgtacccatcgtcgtcgccgtcaacaagatcgataagccgggcgccaaccccgaccgcgtgcgccaggagctcaccgagtacggcatcatccccgaggagtggggcggacagaacatgttcgtcaacatctcggccaagcagaagatcggtatcgacgacctgctcgagaccgtgctgctccaggccgacgttctcgaactcaaggccaaccccgacacctttgcctccggtaacgtcctcgaggccaagctcgacaagggccgcggctcggttgccacggtgctcgtgacccgcggtaccctgcacgtgggcgatacgctggtcgccggtcttacctacggccgcgtccgcgccatgctcgatcccaagggcaacgccgtcaccgaggccggcccctccgacgccgtcgagatcctgggcctgcagtccgtgcccaacgccggcgacgagttccgtgtgttcgaggacgagcgcgaggctcgcgccctggccgatgagcgttcgctcaaggcccgtatcgaggagcagagccgcgtgaagcacgtcacgctcgagaacctcttcgagaccatcgccgacgccgaggtcaaggagctcaacctgatcatcaaggccgacgtccagggctccatcgaggcccttcaggactctcttgacaagatggatcagtctgaggtgcgcatcaacacgatccactccgccgttggtgccatcaacgagaccgacgtcgtcctggccgacgcctccaacgccatcatcatcggctttggcgtccgtcccgacggcaaggcccgctccgctgccgagcgcgagggcgtcgagatccgttgctacgacgtcatctacaagtgcctcgaggacctcgacgctgcccgcatcggtatgctcaagcccaccgaggtcgaggtctccacgggtactgcgaccgttctggacaccttcaaggtgcccaaggtcggtatcgccgccggtgtccgcgtcgaagagggcgagatcgccgcgaccgattccgtacgcctggtgcgcgacggcatcgtggtcttcaacggcaagatcgcctcgatgcgccactacaaggacgaggccaagagcctcaagagcggctccgagggcggtattggcctggagaacttccaggacatcaagcctggcgacaccattgagggctaccgcattgaccaggttgcccgtaccgagtagggggtagcgctatgaagcaaacgcaggcaacccgccgtttgggcgagcagcttcgcgagaagctcggttatatcctgctctttgaggtttccgatccgcgtctcgacctggtcactctgaccgcggtcgaggtcgcggtggaccgttcgttcgcgcgcgtgtacgtgtcgtgcgacgcgagccgctacgatgaggtcatggaggcgctcgccagcgccaagggccgcattcgtagcctgttggcccgctcgctcgattggcgcgtcacgcccgagctcgattttcgcatcgatcgctcgaccgatgaggccgagcgcatcacgcgtgcgctggaaaacgttcccgccacgcttgcgatcgaaaaggacgaggacggctatcccatagcggatgccgcccaggaggcagctttagatgagtaattccgccgacctcgcatcgtgcgagtctgcagatattcagcgacgcatcctcgagctcatcgaggatgcgtcctccattgcgatttcgggacatacgtctcccgatggtgacgccctgggctccgtgctgggtctgggcttatcgcttatgaagtttttccccaacaaggacattgccctgctgctggcagacgatgacccggttccgcgcatctaccgctttatggagggtgccgaccgtctggtgccggcatctgcgtataccggcaatccggacctgttcatctcggtggacgtgccggtcgtcgagcgtctgaacaactcagccgaggtgctccgccgctcgtcgcatgtggtgtgcttcgatcaccatccggcgcgcgaggaatttgccgagctgagcctgaggtgcgtcggcgccgcagcctgcgccatgatcatcgaccgctttttggacaattgcggcattgtcgcacgtgatggcgttgcgacctgcctgctgtgtggcttggtgaccgacaccggtcgtttccagtaccagaacgccgatgctgccgcgttccatgctgcttcgcgcctggtggcgcatggcgccaatccggctcgtgtcgcactcgaggtctatcagagcatgcgcgtcgagtttttgcacctcaagtccattgtcatgggccgtatcaagacggtcgcgcacgggcgcgtggcgtatagctatgccttccagagcgaccttgaggcctgcggcgtcacctcggatgaatgtgacggtctggtcgatgtggtgcgttcggtgatgggcgtcgaggtctgcctgttcttaaagggcatcgacggcgataccaaggtgcgcggcaacctgcgctccaagggtgacctcgatgtgtccgagatcgctgccaactttggcggtggcgggcatcatgccgccgccggcttttccaacaacggaacgattcgcgagacgctcgccgtggcacttcccatgctggccgagctggtgggggaggatcccgcttcggtgaccgtcgagctctaacattttggatggtacatggctcgtcgtacgccttctcaattgaatatgctgctcgccgtcgataagccggtgggctgcacgtcccacgacgtggtttcgcaatgccgacgcgccctccatgagcggcgcgtcggtcatgccggaacgctcgaccccatggcatcgggcgtcatggtggtgggcgtgggtcaggccacacgtctgctgggcatgcttacgcttgataccaaaagctacgttgccgatatctcgtttggcgtcgagaccaataccgatgatgcggagggcgaggcggtccgcacggtggctgttgccgacgagctccgcgatcctgcctatgcgcgtgagcgcttggtcgccatgctgggtccgcagatgcaggtgccgccggcgttttctgctatctcggtcaatagcgttcgcgcctacaagtctgctcgcgagggcaatgcggtggacctacctccgcgccccgtcgaggtctatgccgccgacctgatcgccgtgggcggcgagggcgatacgtgcgtctggaccgtggcgttttcggtaagcaaaggcacctacattcgcgcgctcgctcgcgatctgggtcgtgcctgcgattgtgctgcacatatttccgcgctgcgccgtacggcctccggcgtggtttccattggcgcctgtcatgcggtagaggagctctctgccgagaccgctgccggtttcgctctggatcccatcgccgccctaggtgccacgcgtgtcgatttgccgggtaatcttgcagacgacctgctttgtggccgccgcgttcccgttgaacgcgcgcttgcggacttcgatacggcgaaggcgccgttcgcgctcgtactcgatgggggattgaaggcgcttgctcgtatcgagggcggccgctttgtgatggagcacgtttttccgcaggcgatcggcggtgttcgatgatgctgacgccccacgagctcgcgcgtatctttttcgcgggtgagttggatgaggcccgtatcgtttctgccgatgcttttgatgggtgcgagttcttgggtgccgcgtcgatcgctattggcgtgtttgatggcgtgcatcgtgggcaccaagagctgatcgaagcggttattcgcgatgcacatgatcacggcagcaaagcggtcgtggtcaccttcgatcctgatccggacgtcgtggtgagtccgtcgcccgcccaaaaattgatgacgacggccgaccgcctgcatgccctggctcaaaccggggtcgatgcggtggtggccgttccctttacgcccgccgtggcggcactcgaccatgtcgggtttctggcgctgttgtcgcgcgttgtcgatattcgctccattcgtgtaggcagcgactttaggctcggctgcggcggcgcttcgggcgttgccgagatgcgcgcctggggcactgagcgtggggttgacgtttacggtcacgacctgctctgcgttaacgggcagaccatctgcgccacgcgcatccgccatgagctgggtcagggtcatgtggagctggctgccgagcttctcggccgtccctatatgctgcgcggcgttgtggcggctggccgtcacgagggctccgatatgggctttcccacggcaaacatccaggtgcccgacggcatccaagtgcctgccgatggcgtctatgagggtctggtgctggtcgacgataccgtatggcctgctgccgttaacgtcggcctgccgccgacctatgccgatgatgccgcctcggcgcatctcgaggccaacttgattggctatgcgggcgacttgtatggcgcctccgtgtcgttggcgtttacgcgctggctgcgtccgtctcgcgtgttcgattcgctggacgagcttatcgcgaccgtcgagggtaatatcgacgatattcgtcataacttgggtgagcagggggtgagcatccgtgattagcgatgaggaaaaagatcaggtacgcgcggcgtcggacttggttgccatcgtgcaggaaacggttgagctcaagccccgcggccatgagttttggggctgctgcccgtttcatggcgaaaagaccccatcgtttcacattatccctgctacgcaggtgtggcactgttttggctgcggcgagggcggcgacgtcttcacctatatcatgaagcgcgagaacctgagctttcccgagtcgatccgctatttggccgaccgtgccggcattgagctgcacgataccggtgcgcagcgcgatcgcggcaccaagcgtgcccgcatctatgacctgtgcgccgagacggctcagttctaccacaccatgcttatgcgcggtaaggacagccgtccgcgcgagtactttgccagtcgtggcatgggcggagatgtctgtcgccgctactgcctgggctttgcgccgggtcgcaacgcgctggtgtcgcatctgtcgcaggcgggctttaccccgcaggagatgatcgacgccaacgtggccgtgagccgtggacgtggacagcttgccgaccgtttttacgaccgcgtgatgtttcccatctttgatgagcagggtcacaatatcgcctttggcgggcgcatcatgggcgatggtcagcccaagtacctcaacacggccgagacgagtgtgtttcataaaaagcgaaacctctatggctttaactgggccaaggagtttatcgtcgcgcaggataccgccatcgtggtggagggctataccgactgcatcgcctgctgggaggcagggatcaaaaacgtcgtcgccacgctgggcacagcgctgacggaacatcacgttaagacgctcacccgttttgccaagcgcattgtatatatgttcgatggcgacgccgccggtcaaaaggccgctcgccgcgcgattcagtttatcgagcaggattcgatggatcttcgctgcgtggtgctgcccgatggcaacgaccccatggagttcatcacggcgcatggcggcgaggcgctgcaggcgcgcatcgatgccgccgagcccctcatggactttgtctaccgttcgctgcaggagtcgagcgacattaccacaccgggcggtcgtgccaaggcgctcgaggatgcgctgacgctcatctatccgctgcgtgacagctatatgatcgacacgtactttatccagattgccgacctgttgggtttggacctggagaccgtgcgcgcgagttcgggccgcgtgtttcgcgatgtcgccaagcgtgaggatgccgagcgccggcgtgagcagaactacgagcgtcaacgcgcgcaagctgagcgcgcgggcatcgcgggcggtcgggcgtctggttcgcaggggacgtctcgcggtgcctgggccgcgggtgcgacgccgccggtgtccgcaccggtcgaggaggacccgtacgactacgttccgcttgatgcctatggggccgcgccggtggaggtcgacgaggatctgccgccaatcgatgtgccagcggggatggaaagcgctgcgcccgttgccgatagctcaagcgtggcggcagctccgtcgatgccgatcgttttgaccgatctggagcggaaatccctggcgggggagcgcgagctgctgacgatgctcacgagctaccccgatctgttccgcacgtatgccgatcgcatttgttctatcgagtgggttgacccgcgtcacgagtccattgcgtgggccgtgctggcaacgccgccgggaaccgatcctgcggcatgtatggatgcggcgcgggcggtgtgtcccgaggcggcgtcgcttgtcagcgccgggcgcatctcggcgacgagcaagcacccgaccgagacgaacatcgtctttatgctcgatacgctcgagctctacaccatcaaacgtcgcatgcgagccgcgcaggccaagttgcgtcaggaccgttcactcgacgatgaggctcgtcgcgtgctgacgatgcaggcggtgcaagattcacagcgccagcgcgagctccaaaagtcgatcggtggcgtggccgacccgttccgtttgatcggtttggagaccgcaggtgccgatcaggcctagatgttgtggtcaaccagcgtattctcgcctatatcatgtctttattttgggtatagaggtctacgtgtgtgctaaagtattgagtcctgtggactacgaagggagaatctgtgccaaaaaagactgagagcacgggtactgggctggaatcctacgttgcaaagctcatgggcaacggctcaaacaggacttcggtaaccgaggacgagattcaggtcgccctgaaggatatcgatgttactgatgagcagctcaacgcggtgtattccgcgctgcgcaacagcggcatccagattatctccgcgagcggaaacgacgacgccccgatggacgtcgacgatgacgataacgataccgacgatttcgatgatgacaagcacgattccggctcgcttgacgatcacgagcttaagatggcccgccaggccgatgccgagatgggctcttccaagagcaagaagaagcgcaccgtgcgcacgtcccgttcgcgttcgcgcgtgcgcggcatcgatgcctccacggtgatgctgaccggcgacccggttcgtatgtacctcaaggagatcggtaaggtcgacctgctgaccgcatctgaagaggtcgatctggccatgaagattgaggccggtctcgaggctaccgagaagctcgaggctgccgatgcaggcgagattgaactcacacgctccgagatgcgtcgacttacgcgtattgagaatgttggtcttgaggccaagcaggcgctcatcagcgcaaacctgcgtctggtcgtctccatcgccaagcgctatgtcggccgtggcatgctgttcctggatctgattcaggagggcaacctcggtctgatccgcgccgtcgagaagttcgactaccagaagggctttaagttctccacgtacgccacgtggtggatccgtcaggccattacgcgcgctattgccgaccaggcccgtaccatccgtattcccgtgcacatggtcgagaccatcaacaagctcgtccgcgtgcaacgccagctcctccaggatctgggtcgcgacccgactcctgaggagatcggtgctgagatggacatgagcgccgaccgcgtccgcgagatccagaagatttcgcaggagcctgtgtcgctcgagaccccgatcggtgaggaagaggattcccagctgggcgacttcatcgaggactcccaggctatcgttccgcccgatgccgccagcttctccatgctgcaggagcagctcacccaggtgctcgattcgcttgccgatcgtgagcgcaaggttatcgagctgcgctttggtctcgttgacggacatccccgcacgctcgaggaagtcggtcgcgagtttggcgtcacgcgcgagcgtatccgccagatcgagtccaagaccctggccaagctccgccacccgagccgctcgagcaagctgaaggactacatcgaaagctagtcaagcaagaggcgccctcaagcacatccgcttgagggcgctttatgtagtcgttgggtgttcctatagttttgtcaaccgtcggggctactcccggtagggcacccggtcgcgcatcacggcgtatatcgccctgagccgcttcctcgcgacggccttgagcgcccgcccgtgccccatgccccgcgccctgcaggcccggtagtactcgccgtagcgccccgaggacctcaccaggctgttgcacgagaagatcagcagggacttgagcctcgcgtcgccgcgcctggacgccctgaccgacctcaccgacgtgccggagctcctcaccctcggggctatgccgcagtacgaggccaggtggtcgtggtccgggaacctcccgatgtcgaccgacaccgcgagctgcgccgcggtcctcgggccgatgccgggcacggtgagcaggcacacgtaggtctcgtcgccctcgagcagcgccgccgtctcggcctcgagggccccggcctcgtcgagggcctccgatatccgggcggccaggaacctgacctgcctgttctcggcctcgacgagcgccggcgggggcgcggtggaggcggccgcggcctccccggcggcctcggcccgcgggccctcggccccggagcgggcgatcccccacgccccgccgaacccggcgatggattggcaacacctatttggacgattccgggagggacagccccgcctccctgacgtagcgggtggtttaaagctggccgctgcgcggccagcggactaaagtcttgaatttggtggctcggcaaagccgagcccttatatggggaggccggagctaaagctccggcctcactaactttcctattagattaagtgagcgatcgaggaatcgcactcccctcctctgccgagttaccgcagggcctgccctgaagttacttttcagaacactccgcaggacgcaagaaacccccgccgcacgaagtgcgcagcgggggtttcttgcatgtccgaggacgttctgaaaagtaacttcagggcgggcccggacgataacaaccggctacaagtcgatgtgcgattccttgatcgggaacggctccgcgaagtggcaggcgcagcagtggcccggtgcgacttccttaaactcgggaagcttctcagagcagatgccctgcgcgatcgggcagcgcgtgtggaaacggcagccggtcggcggatccagcggcgacggcgggtcgccagcgaggatgatgcgcttgcgggtcttctggatatcaggatcgggaaccggcacggcagacagcagcgactgcgtgtacggatggtgaggctcgctgtagagcgtcttccagtccgaaacctcgaccatcttacccagatacataacggcaacgcgatcggagatgtgctgcacgacggacaagtcgtgggcgataaacagatatgcggtaccgaacttgtcctggagctccttcagtaggttcagaacctgggcctgaatggacacatccagagcggaaaccggctcgtcgcagataatcagcttgggcttcagcgcaaaagcgcgggcaatgccgacacgctgacgctgaccgccggagaactcatgcggatagcggttgatgtgctcggggttcagtccaacgacgtcgagaagctcgcggacgcgctcaatgcgctcctccttggtacccacgccatgaatggtcatgggctcggagacgatctcgccgatggtcatgcggggattcagcgaagcatagggatcctggaagataaactgcatctcgcgacgcatgtccttgatctcatgcttgctcatctcggcaacatctttaccctggaagaacaccttaccggcggtcggcttggtcaggcgcatgatggtacggcccgtggtggacttaccgcaaccagactcgccaactaggccaaaggtctcgccaggataaatctcaaaagagatgtcgtttacagcagagacgacgcgcttggaaaaacgcttggcgaacatgccggactcagcggggaactccttagagaggtgctcgaccttcagcagcggagtacgctcgttggtatctgccattacgcctcgcctcccttcttggaatccatgcgcgtacgggacgtctcaggagcgttcttgaggaactcggggtcaccggaatagtggcacgcagaatagtgaccggactcggtgacaacacgctcggggcgctgcttgcggcacttatcggttgcataagggcaacgaggcgagaacacgcagccctcgggcaggttcattagcgaaggcggattgccgtgaatcggcgtaagcggcttcttctcatcgatggcctgctccgggatggagcggataaggccccaggtgtaggggtggcggctctcgtagaagatttcctcggcagtaccgaactcgacgggacggccggcgtacataaccatgatcttgtcggccatatcagcgacaacacccaggtcatgggtaatcatgatgatggcgttgccgttcttctcctgcatttcctgcataagctcaataatctgagcctggatggtaacgtccagggcagtcgtgggctcatcggcaatcagaatatcgggatcgcaggcaagagccatggcaatcatgacgcgctgacgcataccgccagagaactggtgcggatactcattgacgcgcttctcgggttcaggaatgccaacgaggtccaaaagctcggtggcgcgcttgagcgcctcctgcttggagtaaccgcgatgcagacgaaggccctcgcccacctgcttgccgatcttatagaccgggttcaaggaggtcataggatcctggaagatcatcgcgatatcgttaccgcgaatgtgctgcatctcttcctcggtcatctcaaggatagaacgaccgcgatagcgaacgtcgccgccctcaatctttcccggaggcatcgagataagacccatgatggtcatggcggtcacggacttgccagagccggactcgccgacgacgcccagggtctcgccgcgatcgagcgtgtaggagacaccgtcgacagcgcgaacaatgccatcctcggtgtggaaatacatcttaaggtcatcgacctcgagcagatgctggccctcgggaaccggctggtccttcaggtccacatagttcttgttcttcttcatccttatgcgtccttcatcttgacgtcgagggcgtcgcgcagaccgtcacccagcagggtgaaggcgagcaccgtcgagagaattgccagaccgggcatgatcatcatccagggagcggtcagaagatactgctgaccgtcctgaatcatggagccccacgaaggcgtaggcggaataacgcccatgccgaggaaggacagagcggactcggtcagaatggcgccaccaatgttcatggtcgcgtagaccacgatggaggcgacggagttcgggaagatgtgacgcacgacgatacgagcatcggatgcacccatcgcgcgtgcagcgtcaacatagtcgttttccttgaccgtcaagattgcagagcggaagacgcgcgcaatcgaaggccagccgagaataccgatggcgataaagacgttctgaagaccacggccgataacggcgatcatggcgacaacgaacagcacgtacgggaacgccaggaagatgtccgcacagcgcatgatgatcgtatcccagatgccgccgtagaaacccgccagagcacccatgaccagaccgatcagcgtggagatcgcggtggccataatgccgacggacagcgaaacacgtgcaccgtagataacgcggacgagaatgtcacgacctagggcgtcggtgccaaacgggtgctcggcacacggagccagcagcgacgtctgagccatggtggtcgagtcggaagccgtcggcgaaccgagccagggcttagcccacagatctgcggtcagggcaaccacaacgacgatgatgatccagcagacaccgataacggcgagcttgttcttacggagacgcttaaaagcgtcgccccacagcgtgcgggacttggcgggagcagatgcggccttggtggcggtagcctgctcctgagactgagaatcagtttcctgcatgagacgtacctcccttaggccttatccgacggaccgccaaggcggatgcgcgggtcgaggaatgcatagctaatgtcgacgagcaggttgatcaccatgacgacgacgacgatgagcgtaacgccgcccataacgatgggccagtcacgcatgctaatggcgcgatagacctcatagccgataccgggccagttaaagaccgtctcggtcaggatggcgcccgaaagcatgccgccaaagtcgacaccaatataggtaacgacggggatgagtgcattcttaagcgcatgcttgatgatgatcgcgcgattggagagacccttggcctttgccgtacggatgtaatcctggttcatgacgtcaagcagctgcgaacgcataatgcgggcggcataagcggtcgaaaccgaagccagcgtaatggtcggaagcacatagtgcatccaatcctgatactgagagctggaaccgccggcacccgagatcggcatggagaatgcaccgcccgtggcgtccttgagaatgacgccaaagaacagctgcagcaacataccgagccagaaagccgggacggcaacgagaatcgacgtggtgagcgttaccaaaatatcccagaaggaataacgcttaaccgccgaaatgatacccgcaccgatacccatgattgcctcgagcacgatggcgcacgcggcaagtttgaccgtatacggatacttctgggcaaagatttccgtaaccggcagcttgcgctgatacgaattgcccagatcgccatgaagcaggccgttcatgtaatacaagtaacggtccacgagcgacgtttgaacggggtcgccgttctcgtcaaggatcgcgttgccgtcctcgtccgactggaccaggtgatagcggacgcgaagctgaagctccacctcgggggacagagccttgtctccaccgatcagcttgatcggatctcccggcacgatattctggagggcgaacagaatcagcgtaacgcccaaaaacaccgggatgaactgaagcacacgtttaacgatgtacttacccataccactcccctatctagggattaacctaaatgggatgccgatcgccagaccggcatcccaaaattaccatcagccagtttaccccaggttagggagaactgtatgtttcccatgaggtctacgtaaatacttgaccctcacggaagctgcaaactcttaggcgagctcagcggtacccagctcggcatgcttctgcggatcgacatagaggtgcttgatgcgatcggagccgacgatggtgtgcgtgtagaacataatcgggatgaccgggcagtcggcagcgaccattgcgtcggcctcctgcatcttagcgacgcgctcctcgtcgtcaacaatagtacgagcctcgtcgaccttggcgtcgaactcggggttgttgtaaccggagcggttatcgccaccgagggagtcggagtggaacagcggatacaggaagttgtccatgatcgggtagtcggcaatccaacccagacgaccgaactgatagttaaagttctgatactgctcgagcagggcagaccactcaggggtatcggagacagcggtaacgccaaccttggcgaggtcgccgatgatggactccatgatctccttgtgaccgccgtcctggttgtaggaaagggtcacgctaatgccacgatccccgttagcgccagcgggagcaaccttgtcgaggtactcgttagccttgtcgacatcgtaggcgcagaactcccatgcgccctccttgtagccatcgatgcccggaggaacaatgccgtcggcaggggtacgggtacccttatagatggtcttgcagatggcctcacggttgatggccagggagatgcccctgcgcaggtcggcgttgttgaacggctcggccgtggtgttgcaggtcagatagtacgtggaaggctcggcgccgagcagcatgcgctcgccgtcacccatggtgtagccgtccttggacacgccgcgatccttcttggcggcatcgatctgagcgacgggaacgtcgcagacatcgaggttaccggcctggaactccttgtaagcagtctccatgtccttgatgacctggaagtggatgccatcgatcttggccttgtcgccatagtaatcgtcgaacttcttgaggttgatctcctgaccatcctcccacttgccgtccatcatgaacgggccgttaccgaccggtgcaagatagaagctcttgacatcggactcggcgcactcgggaaccggggccagagccgggtgagaggcgacgaaggggaagtcggcgtaagcggaagacagcttgacgacgagggtctcatcgtcggggcaagtaacaccgctgagctcggtagcgttaccggcaagcaggtcgtcatagccctcgaccatagaaaggtgataggagacctcggaagggccgtactcggtagcgatggccgacttggtgttgaccagacgctcccaaccgagcttgaaggacttggaggtaacgtcgtcaccgttgtggaacttggccttcttgatcttgaaggtgaactcggtggcgtcgtcgttggcctcaaaggactcgcaagccagcggaacgatctcgcccttctcggcgtcataagaggtcagagcatcaaagagctggtactcgacctgagtgccctggtcctcctggacgttataggggtcgatgcagaccgggttgttgatgtagaagttcagcgtcgaaccggactcagaaccggaagcgtcgccgcccttcttgccgcatgcggcaagaaaagccatggagctcgcagcaagggtaccgccgacaaaggcgcgacgacccataacgggctggtggaacatagaatcagccatgccatcctccttatgagataggacaaagtaagttcggtcgggcaacgtcaagacagcccaatcgaaccattcaaacgcggtccgccgttttggctggttatacaaagcggaccaacgtattgcaatacagtagcgcattttatgcacgatttggggctaattccggttaacggtcgagattttctttagttgggcgaagtatatgaggatattttgactctgttacaaatatgtaaacaaaatgggtcccgcacttgcgggacccttttcaagtatttatgcggttcgtgattagtagcccacgatgccctgcgggaagaagaacatgcacagcacgacgcacacggcaaacacgacagccatgatgacggtcaggcggtcaaggttctgctccataacgcccgtggcagagctggagttatacagcgagctggcaatcatatccgaaacgccggtacccttaccggaatgcatcaggacgagaatcgtcagcgccacggcagaaacagcccaaacgacaaacagaagaatctggaacggacccatagataagctccttaatagaacagttcaaactccagtactgtaccacaatcccccgctctcccctacctgccactcaaggacggggtggaaatggcagaaataccaaaaagggggttgtccggttgtggacaacccccttgctagaaaacggtatttgttttctcttaggcctcggtggcgagcacgcggcccgtcatctcggcggaaggctccagaccagccatggtgagcatagtcggggcgatatcggaaagacgaccgtcctcgataccggtgagctgtgccttctcatcaacgatgatgaacggcacgcggttggtggtgtgagccgtaaacggatgcttggaaccgtcggaagcaacgtcaaacatgtgatcggcgttgccgtggtcggcggtaatcagcgcaaagccgcccttggcgagaatcgccgggacaaccttggacagggcatcgtcaacagcctcgacagccttaacggcagcgtcgaagacaccggtgtggccaaccatgtcgcagttcgcgaagttcacgatgtagaaatcagcgcgatcctcgttgatggcggcgacgagcttctcggtaacctcgggagcgctcatctcgggctgcagatcgtaggtagcaaccttgggggaagcgacgagcacgcgctcctcgccctccttgggctcctcgatgccgccgttgaggaagaacgtcacgtgggcgtacttctcggtctcggcagtgtgcagctgcttcaggccattggcggcgataacgtcggccaggacgttctcggggaatgtcttggggaaggcgacctcgacgtcaaacgtcggatcgtactcagtcatcgtcacaaagtgcgagagcttgatctgctcgcgctcaaagccgtcgaactccttgtccgtgaacacgcgggtcatctgacgggcgcggtcgggacggaagttgaagaagatggccgcgtcgccctcgtggatgccctcattgtgggcagcgaagggctcgacgaactcgtcgccgcgcggatccttctcgtagtaggccttgatgccggcaacggggtcggtatcggcatcggacgcattgaccatgacgtcgtaggcacgctggatgcgctcccaacggttgtcgcggtccatcgcccaataacgacccgagacggtggcaacgcgagcgtcgcaaccggtctcctcggaaatcttggccaggaaggcgcagaactcgctcatgtagccagcaccggactgcgggtcgacgtcgcggccatccatgaaggcgtggacacgaacggtcttgacgccatgctcggcagccatcttgaccagagcctcaacgtggttcatatgagaatgaacaccgccagggctcataaggcccatgaggtggagagtcttgccgtcagccttgacatcgtccatagccttgacaaaaacctcgttcttggcgatggagccgtccttgatggcattgttgatgcgcgaaagctcctggaacacgatgcggccggcaccgatgttgaggtgacccacctcggagttgcccatctggccgtcgggaaggcccacgtcctcgcccgaagcgccgagcgtggtgtgggggtacttctcgtacaggctatcaaggaagggcgtcttggcagcggcgacggcgttctcgccatcggccggagcaaggccgcaaccatccatgatgatcaggagtgcaggaagatgacgttgtgccatatgtcctactcgcctgccttgacgaccatagaggcgaagtcggcagccttgagcgaagcgccgcccacgagggcgccgtcaacgtcgggcttggcgacgagctcggcgatgttgccgggcttggcggaaccgccatacagcacgcggatgccgttggcgagctcctcgccgaacatctccttgagggtctcacggatagcgccgcagacctcctgagcgtcctcggcggtagcggtcttgcctgtgccgatggcccagatgggctcgtaggcgacgacgacctgcttggggcaggtgatctcaaggccagcaaggccagccttgacctggttcacgacgtgctcgacataggtgccagcctcgcggacctcgagggactcgccgcagcagaagacgggaacaagaccggcggaaacgagagccttagccttcttgttctgatcctcgtcggtctcgtggaagtagtcgcgacgctcggagtgaccgatgatgcagtaggtgcagccagcggacttgagcatgtcgcaagaagactcaccggtgaaggcacccttggcctcccagtacacgttctgtgcaccgagggcgatgggggcagcctgaatgcggtcatgaaccgtggtgatgtcgatggtcggagggcagacgagcacctcgacgccagccggaacctcgggcagagcctgagccagctcgtcggcgagcttggcggcctcggcgacgtcgttgttcatcttccagttaccagcgataagaagggtgcgattaggcatcgagaagcgcctccactccgggcagggccttaccctcgacgagctccatggaagcgccaccaccggtggagatccagctcatcttgtcggccaggttgaacttgttgacagctgcgacagagtcaccaccgccgatgatcgaggtgcagtcagcctcggcgagagcctcggcgatagcctgggtgccgtgagcaaagttgtcaaactcgaagacgcccatggggccgttccagaacacggtcttggcgcccttgacagcctcggcatagagctcctcggtcttgggaccgatgtccataccctcacgatcgtcggggatagcgtcggaagcaacaacctcggggacagcgtcctcgccaaagtgatcggcaacacggttgtcgatggggagtaggatcttgacacccttctcctcggccttcttgagcatctcgccggcgcgctcgacccagtcctcttccttgagggactgaccaacggacaggccctgagccaggaagaaggtgtaggccataccgccaccgatgatcagggtgtcagcggagtcgatgaggtgatcgagaacgccgatcttggaggaaaccttggaaccgccgacgatggcgacgaaggggcgctcgggctcggcgaagatgccggtcagcgtgtcgacctccttctcgagcaagaagccggcgacggcaggcaggtaagcggcggggcccacgacggaaccctgggcgcggtgagcggtgccgaaggcatcgagaacgaagacgtcaccataggaagcgagcttcttggcgatctcgggatcgttcttcttctcacgcttgtcaaaacggacgttctcgagaacgaggaccttacccggctcgacggcggcgacagcctcagcagccttctcgccgtaggtgtcagcgacaaaggcaacgtcgagaccagagagctcagcgagcttcttggcgacgggctcgagggacagctcgggctggaagccggtgccctcgggacggccgaggtggctcatgaggatgacgcgagcgttgtgctcaacgaggtagttgatggtgggcagggcagccttgatacgggtggtgtcgccaacgacgccatccttgataggcacgttaaagtcaacgcggacgagaacgcgctttccgtcgacatcgatgtcgcggacggtcttcttggtaaaggccatgtttgcttctacctttcgtacgtgtctgcctcccattacggcagacgatttcttataaaaagggcgcgaccctagggtgtaagccctataaggccgcgcccttctttagacgctcaacgagctattcgctaaaagctaaattaagcaacgaacttctcgaagtacttgatggtgcggaccatctgagaggtgtaggagttctcgttgtcgtaccaagaggtgacctgaacgagggtctggccgttgccgaggtcagagcacatggtctgagtggcgtcgaagatggagccgtgggtctcgccgacgatgtcgcgggagacgatctggtcctcgttgtaggcgaaggtctcggggatggtctcagcgtaggccttcatggcagcgttgacctcgtcgacggtgaccttcttgtcaacgacggcgtagaggttggtcagcgagccggtcggcgtcgggacgcgctgggcggcaccgatgagcttgccgttgagctcggggagaaccaggccgatggccttggcagcgcccgtggtgttcgggacgatgttctcggagcaggcgcgggagcgacggaagttgcccttgcgctgcgggccgtcgagcggcatctggtcgccggtgaaggcgtggatggtggtcatgatgccggacacgatgggagcgaagtcgttcagacccttggccatcggggcgaggcagttggtggtgcaggaagcagcggagatgatgttgtcctcagcggtcagcgtctcatggttgacgttgtacacgatggtgggcagatcgctgccggccggagcggagatgacgaccttcttggcgccagcgttgatgtgggcctgagccttagccttgctggtgtagaagccggtgcactcgagaacgacgtcgacgtcaaggtcgccccaaggcaggttgttagcgtcggcctccttgtagatcttgatctccttgccgtcaacggtgatggaatcctcgccagcaacgacctcgtgatcgcgagcgtagttgccctgcgtggagtcgtacttcagcaggtaagcgagcatatcgggagaggtgaggtcgttgatagcgacgatctcggagccctcatgaccgaacatctgacggaaagccagacgaccgatgcgaccgaagccgttaatagcaacctttactgccattgtgtctcctttcgtaaggcccccgcgagctacagcgcccgccgttgaggcccacaaactaaccactcgcctaatataccttttttttgacttgaatttcacgagaatgctcgaaattgaaaatcaaatttacgttaaaacgttttaaagaataaaatagcagctaaatccgtatataagtcgatacttcaaactacctgtttgcttcaatgagcttttcaagcctcaaaacgcgatggtacagggcagacttcgacaagggagggtcagccatctcgcccagatcgcgcagcgacagatcgggatagcgctcgcgcaggtcgcaaaagactgccaaggcgtccggaagcgtgtcgcgcaaaccccgctgttcgagctcatcgatcaacgcaagctgatgctgggcggcacccgcacttctggtctgattggccagttcggcattcacgcgacggtttacgtcgttcttaaccaatttgaccgcgcgcgcctcctcaatctcggcaacgctgcgcttggcaccaatcagctttaggagctgctcgatctcctcggcgctcttaatgtagacagcaaaggatccgcgccgcgcgttaacgcgcgcatggaccccaatctgctccaatagatcgcaaagtccccgagcatactgctcgccctgcaccgcgatctccaaatgaaagtcgccgcggggatcggccacgaaaccgccggcgatgagcgcgccgcggatgtaggcaagcctgcagcagggacgggcaacgatgtgccggggaacaccagcgacgagccctcccctgcggtcgagaatgcccagcagcaccagagccttgtccaggtcgggctgatcgggcagggtaatgagatagttacggaccttatgcaagaccgatttacgaacggtgaattccgttttgagcttaaggatgcgatgcgtcagtgtgatcatcgtgcgcgcgacggcacccgtctcggtcgcgaccgtcaaacgataccgcccggagccggccagcgaaagtgtaccgctcacacgcgtcagggcggcaagcgtcgacaaatcgcagtattcacattcgggttcgcagcgcgcgagctcgtcacgcacctcggcggtaaacgacatgcaggcctatgctttcgtgttggcgcgcgacaggtcgcgatgggaaatgctcacgtgatattgggcgccttccaaataacgtgccgtggcctcggcgatggcaacgctgcggtgttgaccgcccgtacagccgatggcgatagaaagctgcggcttgccctccgcgatatagcccggcatcaccgtatcgagcagctgcgtccaggccttccagaactcctgggtcttgggatggtccaaaacaaaatcggagacctttttatcgagaccggtcatggtgcgcatctcgggatcgtagaacggattgggcaggaagcggacgtcgatcataatgtccgcctcgacgggcatgccgtgcttaaagccaaacgagaacacgtgaacgtccatgagctgctggtcggacaactcggagaacgccatgcgcaatttattgcgcagagcagaagtgcgcaagcggctcgtatcgataatcatgtcagctcggtcgcgaacgccctgcagctgcaggcgctcgcgctgaatcgcatcggccgtagtctcccccggcttggcaatgggatggcggcggcggttttcgctataacgacggatcagcacctcgtcagaggcctcgagaaacacgatgtcacagctcatctcgcgctcctcgagcgcggcaacggcatcgagcagctcatcgaacaagccctggctgcgcaggtcgcaggtgacggcaagatgcctgcccacgcccgtattgatgccgacgagttcggcaagctgggcgatcagacgcggaggcaagttgtcgatgcaaaaatagcccatgtcctcgaacacatgcatggcctgcgttcggcccgatccggacattccggtgatgatgacgatatcggggatgcgctccgagcgctccgccgcatccatggcatctcccttttgcatgtgtgcctcctaaaacaagcgcgggacccggccagcggatcccgcgcgatcaattgcctttattgagtataccgccccaagcggatacgaggcctgtcttacgcctcaagcgcagccttgaaccaacttgtaatactcgtggggtgcgtgatggcggtgccgacgacaacggcccaggcgcccgcatcaatcgcggcgcgggcctcctcgggcgtgtgcacgcggccctcgcagatgatgggaagaccggggaattcctcggtcgcctgacgcagaagcggcagatcggggccatcggccatggtgcagtcgatagcggcaacaccatgagaaagcgtggtggacaccaggtcgaagcccatgtcgacagcacgacgaatatcctcgatggtggcacagtcggccatcaggagcacgccctcctcgtgcagcgggcggaaggtatcctcgaccgacttgccatcgggacgtgggcgatcggtggcgtcaatcgccacgatatcggcacccgcagcaacgcaggcgcgagcgtggcgcagcgtcggcgtgatgtaaacgccctcgtgcccatccttccacaggccgataacaggaacctcacagcgacccttaatggcggcaatgtcggcaaggccctggcagcgaatggcggcggcaccgccgagctcgcaagcgcgagacatttgagccatggtctcgggcgtacgaagcggctcgcccatatacgcctgaacgctcacgacgagcttgcccttcagggattgaatcaaaggatctacggtcatgttcgactcaacctttctaaaaacagccttctgagacaccgcaccttgacgttcaaaccgtcgctcacgtaccgaagtacgcttcgctcctctttcacgtcaatctgcggcacctcagaaggcgcacttggtagttatgtttacttcaacgatgcaagaaggtgttcggcggcaccgatgagtggagcatcaccctccagagaaccgataaggatcggcgtgtcctgaagcggatcgagcgcctggctggcatagccctcgtgcaccgaatccttccacgtctgcgaacgccaatcgggaccttggtgaatcacgccgcccgaaagcacgatgacctcagggtccagaatgttagcgagcgagcccaagctggcacccagcgcaaagccggcgtcatggatgacctcggtcgcctttgcgtcgcccgcacggcacaggtcgttcacgtcgcgaccgaccgaaggacggctggggtcgacgcgaccgaagcgctcatcgtacatacgaccaatggaagtgcccgaagcaaccgactccagatggccagaacgtccgcaggcgcagggaatgccagcggcagccgagcactcgatgtggcccatatgaccggcagcaccatggaagccctgcatcacgcggccgttctcgacatatgcgccgccgatgcccgtaccgatgcccagacacaagacggagaacttgcccttgccgacgccccagtgggcctcgcccagagcatgagcctgcacgtcgcccaccacggcaacgggaagaccaaggtcttcgcgcagacgcggccccaactgaacgccggaccagccgggcatgatctcgttggcatacgcgatggcgcccgtcttgggatcgacgacgcctgcggcaccgataccgacaccgaggacctcgacatcgggattcgcctcaagagcggccttgatggacgcctcgatacgttggaagacggcctcgccgccctcctgggcctcggtaggaacctcggcctcaaatacgggatggggcgcactgccgtcagccgggtactccatgatggcggtcgcgatcttagttccgccgatatcgacagagcagacgtacttgttctccatgtcgttctccttcggagacaaaacaactacaggaaatgaaggcggtgttatcgccgcagcatgataaaggtttcccaggtgcccgaggttggggtgaaagtggtcgggcgttgacctaatgggtcacgcccgaccacttgagccccaagatcgagtgcctggggaagctttacaggagaccgttgtcctggaggaccttcttaatcgcctcgacgttctcgccagtcatggccttcaccgggcgcggcatggtcgggctgtcgaagatacccatgaggttcatagcggtcttgaaggcgccgacgccaccggcatagccctggacgcccgaggtgacatcccagatgtgggaaatctcgttgaggcgatcctgctcggccttgacggtagcccagtcgccggcctgagcggccttccactgacgcacgtagccctcgggctcaacgttggcgagacccgggacggaaccgtcggcgccgccgaggtaagcaccgtcgacgacgacctcgtgaccggtgaggatgctcatcgggtggccgttcttctcgttctcctgaacgaggtagcggaacgagatgtcatcacccgaggaatccttgacgccggccaggacgccctcggcgccgagcttggcaaggagcttccaagggagcttggtgtggacgcacacggggatgtcgtaggcgaagatgggcaggtcgagttcctcgtgcaggatgcggaagtgctcctcgacctcggtcatgccctgcagggcatagaacgggcaggtggcgacaagcgcatcggcgcccagctcctgagcgaccttgccgtgctcgatcatgcgctcggtctcggtgtcgatgatgccgaccagaacaggcacacggtgatcaacgatgcgcacggcctcggcgacaatctggcgacggcgctcgtcggtggagaagacgacctcgcccgaggatcccaggaagaacaggccatcgacgccggcatcgatcatacggttgatgctgcgctcaaaggaggcaacatcaagctggtggtcttcggtatcgggaacaacgacgggagggataacgccggtgaatttctgagttgccacaagaatctccttagttgtctggcgggcggccctatgccacccactcttgttggcagtgtccaggccgtctaggccaaagaaaacgggtagaacgtttggttaaagaagtcgacgacttcgttttcgaacgcattgatgcgctcgtgagcgtatttggcataaatgatatgccttcggtcacactcaagaccgttgaatacggcaaactgacccttgggatcgctcacggcgtccataagcgatgtgcccatgagcaccgatccgtgcacccgagacgacagagcctcgaggccaccggggattggattggcaaccgccgtgcaggcaaggcctcgctcgtccaaggcggaaaccgccagcgcaacaccgccgccaaggccctcgccccacgcaaaaatgcgatcggggtccacgccatcaagattacgcgcgaccttcgccaacgcgcagccccaacgaacgcgcctgacaaaagcaggcgaggtaatcccctgctgcagatcgctgagtccaatcgcctcatcgtccagtgcaagcacggcatatcccatggcggcaaatctcgtcatgtgatgccagccgcgcacaggccgatcgatgtcgtggaacatcaggcacagcggcacgcgctcagatactcgggcacgaccaacaggctcaatcaaacgagcgtggaccgcatcgtcaccgagcttaaaggaaacctccgagtaacgggcgcaggggttaacaaagtcaattgccgtaatggccaggccttgaatctcaagattcgaagcgcatgtctctaaatcagaaacatctgcttggacatcaccgtgccagtcccgatattctgcgagccttgacgaaaccgttccaggaattcccacgagcccggggactatcagctcgtcaacattgctctcgcacttagacatgagcctcccctccctcacagaaaaacggaatgatcagatcgtcaaaatcctgaatctcctcgtggccaaagccttcaaagaactcatgacgcttgtcgcaggacaggttgttgtacaccgcaaactgcgttgccggcggacagacgatatcggccgtgcccgtgccaaacagcacggggcacttgaccatgggggcaaaattcttggaatcgaagtacgccagcttggcataggcttcctcgatacgagtcgagtcctcgtcaaaccaacgcgaccaatagcgcagaccctcgtaggcaatatcgtcggcgtccagatcccaaaccaggcggaagtccgacaggaagggatagaggatggcggcgcgattgataagctcgctgttaagcgcgcaggtcgcaatgcccaaaccgccgccctgcgatgcgccgttcacatacacgcgggtaagatcgatgccctcgagctcgcgaacgatacggcacagaatgcggatatcctgatgtaggcggacatagtagaggttggccgggtcgccgtcgataccggcgacgatatggcccgcgaccgtcgtgccctcaaatccaccaatgtcctcggaggggcctccttggccaggacaatcgagagcaatgagcaccatgcccatgcccgcaaacgacgcctgctcaaaccagctgcggctcgcacccggatatccatggaactgaagtaccaatggcacgggctcgtccgagacgggtttaaggcacttggcatgcaggcgcgcgccacacatgccggtataccagaggtcgaaaaaccgacaggttgcggaatccgcaaccgaagccgcctcaatcgcgtagtcgagctcaacggcgtcggcctcggccatgcggtccttccaaaagagatcgaaatccgatggacggggcatagcgcctcgatattcaccaaattgctgttgtagctcctgagcacttggcatggctcgtgaacccaacctttcgaaatcgcaacggaggtgcgcccggcaagggaaccgggcgcacgggagggaaagcgaggctactcgccgagcttgggatgcagcagcgacggcgcagcgccgagcagcatcttggtgtaggggtcctgaggttgctggaagacctgcttggcctcgccctgctcgacgatcttgccgccattcataacgatgatgtcgtcagagatatagcggaccgtctggatgtcatggctgatgaacaccatggccaggccgagctccttcttaaggtcggtcagcaggttcagaatctgcgcgcggaccgaaacgtccagagccgaggtgggctcgtcggcgatgatggcatcggggttcagcgacagggcacgggcaattgcgacgcgctggcgctggccgcccgaaagctggccgggaagaacctcggcggcggagctgggcagaccggtgagctccaagagctccttgacgcgcttctcctgctcggcctcggtacccaggttgtggacgcgcatggggtcgagcagttgctcgcgaacgaccatgcgggggttgagcgccgtggctgggttctggaacacgaccgagatgacgcggcccatgtggcgacggtcctcggcggtacgcttggtaacgtccttgcccttaaagtagaccttgccgctcgtgggggcctgcaggccgcacatgacgttagcggtggtggactttccgcaaccggactcgccgacgatgccgatggtctgtccgggcatgagcttaatcgttacaccctggacggcgtgaaccaggttggggtgcagaatcgagccggtacgggtcctaaaggtgacgtggacgtcatcaaggaagatgatcggctcgacgccgttgactgcggtctcgctcatctacatcacctccgcgtgaggggtcaaaccatttgccttgagcacctcgtcggggagctcggaatagaagtgctcggtgccgggcacgcgcttgaagaccggacgggtgtccaggccaatgcgcggatggctcgagcggggcgcgaagcgatcgcccttggggaaatcgcgcgggctcggaacggcgccgggcacctggtgcaggcggcccgaaccgctctcgatggacaggacggaacccagaaggccgcgggtgtactcgtgaatcgggttggtgagcagctccttggtgggcgcctgctcgataacctgaccggcgtacataaccgtgatgttatgggcaacctcggcgaccagcgccaggtcatgcgaaacgaagatcatggcaaagccgagcttggcctgaaggtcgttaagcagcttgatgacctgcttctggacggtaacgtccagagcggtcgtgggctcgtcgcagatgaccagcttggggtcgcgggtaagggccatagcgatcagaacgcgctgacgctgaccaccggaaagctcatgcggatagctctcgagcgtacgcttggggtcgaggcccacgagctccaggagctcctcggcgctacgggtgccgccacgcttggtgagctgcttcatctgggcggaaatgagcatggaggggttgagcgaggacagggcgtcctgatagaccatggcgatatcggtaccgcgcaggccgaaccactccttcttgctcatcttgagcaggtcgcggccctcccagagaacctcaccggaaagatgctcgtcatcgtcggtcaggcccatgatggccagcgtggtgatggacttaccgcagccggactcgcctaccaggcccatggtctggccgggacggacgtcaaagttaacgtggtcgacgacgttgatgtcaccgtggtgctcaaactggatgcagaaatcgcggaccgaaaggatcggctcaacggactcatcgggcacatggcggtcgttacgcttgagttcgacatcacgcagggcgccaagacgggcggacagggactgagcctgctccttgtaggcgcgaacggggtcggagaccagcaggtcggcctcgcggcgctttgaggagtcggtcggatccagggcggcggagggagcagcggccatggcgtcggtaatgccctcggagaggatgttgagtgccaggcaggtgatcatgatggccaggcccgggaacagcgcctgccaccaacggccagcgagcacgccaccgcgagcgtcggcgaggatgttgccccaggtagcggtgggctcctggataccagcgccgatgaaggtcagcgaggcctcgaagatgatggcgtcggcgaccagggtaacggtgaaaaccatgatcggggcgatgcagttgcgcaggacgtgcttgatcaaaatccacggagccttggcgccggaaacgatgaccgcgcggacatagtcctcgccgtactcggacacgatgttggcgcgcacgatacgggcaatctgcggagtgtacataaagccgatggcgaagatgatcgacggcacggaattgcccaggatggagacgaagacggcagcgagggcaatgcccgggatggacatgatgatgtccaggatgcgcatgatcgcctcggaaacggacttgcgcgaaaccgccgcgagggcgcccacgaccgagccgcagaccagagccatggcagtggcgccaaagccgatgatcagcgagtaacggccaccgtagagcatacgcgacagaatgtcgcggcccttatcgtcggtaccgaagataaatccattgccgggagcctggcgagccgtaaagatctcgaccgggctatagggggcaagaaggggcgccagaatcgcggtcaaggcgaccagcaccagcacaacggcggcaatcttagaagacagcgtcatcttcttccagccaccgagcttgagccccttggaggcagctttctcgagctgctcggtttgcttctctcgaatctttaccataatctacaccgtcctgatgcgcgggttgatgagcaggtagagcatgtcaaccacgatgttgatgatgatgaaggcaagagcaacgacgatgacgacgccctgaaccaggttcgcctcgttgccctgaacgccctgcaggatcgcagtacccatgccggggaggttgaagatgacctcgatgacgacagcaccgcccataaggtaaccgatcttaagaccgagggtggtgaccggggtgatcagcgcgttgcgcaagacgttgatgccgacgacgaccttctcgggaacgccggcgccgcgagccatacggacatagtccttatcgagctcctcgaccatggccgtacgcacgatacgagtcatctgacctgtcagcgggaatgccagagcgatagcgggcatgatcatacgtcccagatagccagccgggttggtggtgaagtgaggtagagcaccggacgccggaagcaccttaaggtaggaagagaacagcagaatcaacagaacggcaagccagaacgacggggttgccaagccggcgatggagaagacgcggatcacttggtccggccatttatcgcgatacagtgccgcgatgacgccgagcaaaaacgagacgaccgcgccgatggcaagaccgatgaaggtcagctgcatcgtgacgggcagggccgtggaaatgcgcttggcaacggagttgcgagcagcaccataggtgcccatgtcaccatggatcagatcgcccatgtagcgcacgtagcgcacgggccaggggtcgtccagaccatacttctcatggtactcggcaaccgcctcgggcgaggcaccgtcacccaacgccgtataggcggggtcggtcttggagaacgacataaggaagaacaccaggacggtgacgcccaatgccatgatcggcagcgccacgagacgccttccaatcaaacgtagaaagttgttcacgttctctcccctttcttttgtcggtaggaccaactggtatatgagtatggatactcattacaagacccgagcgacatcgaggccgcccgggtctttgtttcaactatgaggacgttgccttacgaccgacgccctacatatgactcaagcgagtcttaggccttgacggtcgcgacgcccctgaaggacatgctcgtcgtgccgatgcccttgaagccatcgagggcctcgccgttgggcgcggtggacggatcgtcccaggaagcggagacggtcttgacgtggacaacggggtacagaacagcgttgtcggcgatgatgtcgaagcactcgttccacttcttctgctgctcgtcgccctcggcggcaagagcctcgtccatgagaccgtggagcttctcccactcagcggactccttccacgggcaacgggtctgcatccagacgttgtcgccgtaccaccagttgagcagcaggtcggggtcagcgccgaagcaggacggatcgccaggggcaaggaggatatcgtaggcctcgccgccgtcgatggcagcgtaggtggccggcgaggtatcggtctggatggtcacatcgaagccgagagcgtcgaggtcgttcttgacctgagcggccatgcccttgatctgctcgttgtcggtagtgcgcagggtgatggcgcccggggtgatgccagactcctcaatgagcttcttggccttcttggcgtcagtcttgtacaccgtggaagcctcatgatagttggtgaagctcttgggcaggtagcagctggcagcggtggcaaggccggcgaaggtgttggtgatcatcttctcggtgtcgagcgcgtacatgacggcctgacggaccttgacgttgttccaaggctccttggcgacgttgaacatgatgaagcgggtgccaaagccctggacgttatcgatcttgcagccggcgctctcgagctggtcgacggcgtcagcggtgacgagctccataacgagcgtggagccctcctgctgagcggtaacgcgagcggtggggtcggtcaggatgctgtactggatcttcttatcctcggcagcatactcaccgttgtactcggggttgggaaccagggtgatctcggtatcggagatagagtcgtacatccaggggcccgaaccgatcggctgcttggcgcgatcctcctcggactgggtagccggggtaacgcggatgatggccagacgatccttgagcagggagaagttggggaccttggtcttgaccgttacggtgctggcgtccttggcctcgatggactcgaagggctggaagaacggagcataggtagcggaagcagcgcaagcggtgtaggaggcaacaacgtcgtcagcagtgacctcggtaccatcggagaacttggcgcccttgcggatggtgacctcgaaagtggtgtcgtccacagacttgggatcgtcggtggcgagctcgttgaaggtgctgtagtcgtggtaatcgatgccgtagaggccctcgacgacgtgccagttagcacccaggcccacagcggagccggtgctggcgggatcgaagctggacggagcgtaagcggaaccagcggtgatcacgccgccgccacggttggcggaatcggtggagccggaagcggaaccctcgtcgctagagctgccaccgcagccagtgagaccaaggccggcgacagcagcgacgctgccggtgaggccgaggaacgaacgcctggacatacccttgttgatgatggccatgtcttctcctatcaatagagaatcttactcgggagcacctagacttgcccccgcgcaacttgcggacgatatataccttacctaccgacgaacccaactgaggtgccgcgctcggcgaccgatacatacatacgcttgaacggtatttactaccgttcaccgaattcattgacaaatgattcgccagacagtatgtatcgacgaggtgagatatcagtcttcgtcaacccgcaggatagcagggttgttcaccatgactagtcaaacgttttagcgttaataaaacccgaaaccagcatgcaatcatggcgaaataaatggttgaaaatcacgcaatcatgtatatcagtagtttaggctcgtgtttagctatcggaatggccagccgccgcctcggcgcgctcggcattccacgcaacgagcgcctcgtggaccgccttggcaacatcggcaggtatgccgcgaacttccgcgatctcttgctcgctcgccgcgcgcaaacgcttcatcgaaccaaaatggcgcataagggcacgttttctggtgggtcccacgcctggaacgtcatcgagtaccgaaactgtcatggctttatcgcgcaactcacgatggaatgtgattgcaaaacggtgcgattcatcgcgcacctgtttaattagatagagcgaagcagacccggtcggcagcacgacgggagtctcgtcccaaggcacaaaaacttcctcatcggcctttgccaagccacaaactggtatatcgagcccaagagcctcaagttgcttgatcgcagcggtcaattgcggcttaccgccatcgacaacgagcaaatcggggcgcgagccaaagcgctcgtcggccatgcgctcgggagcatagcgtcgtcccaaaacctcggacatcgacacgaagtcgtttgcctcgtccaattcggcctgaattttaaaacgacggtactggctcttgtcggcgcgtccgttggtaaacaccaccatcgaggcgacggtaaaggttccatgcagcgtcgagatatcgaagcactcgatacgcatcggcggcgccggcagcgccagcgcgctttcgagctccaggagcgcttgattggtgcggtcgtcagcgtaccccgttcgcatcatgtagcgcatgagggcatggcgcgcatttttggatgccatatcgagcaaacggtgcttttcgccacgctgcggcctatggagatggcaggaacgctcgcgcttgcctgcaagccactcccccagcgcctccgcatcctcaagctcgacagagaggtttatctcagctggaatatcggccgtctcgtcgtaatagcgcttaagaaagcccgactggagctcttcctcgtcaacatcaagacccttgtcaagaatgaactcgcaggttcgaaccgttcgaccctcacgcacgacaaagacgcaagcggcggagatggtctcctcgcgatagaaaccgatgacatcgatatcgacactggagggaaaaacgacttgctgacggtcgtccagacccctgatgacctccaaacgacgtttgacgcgtgccgcgcgctcaaagtcgagcgcctcggcggcatccgtcatctcggaggtcagctcatcgacgacatccttgcgatggcccgacaaaaaacgttcgacacgtttgacgttcttggcatagtccgtaggagaaatcgcgccgacacacgcacccgggccgcgcccgacatggtagtcaaagcagggacgcccgttttgcgcgcaaatcatattgacgatgtcttcctcgcccctgtgggactcgacgatacgacgacaacgacgccactccgcacaggatgcggagcagatggggataaccttgcgcagcgtatctatcgtctcacgtgccgcacggctatcggtatagggaccaaaataacgcgttcccggcttatgacgctcgcgcgtatatttgatagcgggatacaggtcgccctttgtaatggcgataaaggggtagctcttgtcatccttgaggtcgacgttaaagtacggatggtactgaccaatcaaattgcgctcgagcaccaacgcctcgtgctcggtctccaccacgatatagtcaaagctcgccaccagctgcatcatcagcgggatcttttgacgctcatcctgcagtgtcacgtactggcgcatacgggaacgcaagttttttgccttgcccacgtagatgacatcgcccttggcatccttccaaaggtagcatccgggctgtgtgggaacgcgcgaaacctgctcggcaagcgttggaatgttgtcgtgaccggccacacgcacctacttgcgacgaagcagcgccgagacctcaggcatcttaaggacgacggcaaggccaaaggtaacagcaagcgagacgacacccgcaacgcaaacgtagccaagagtaatcagaatcgagccgccaagtgccccgacaaagtgttcaagcacccacatgacgccggcgcctgcggcagcacctagaccaccgagcaaaaggccaaagaaaccgccatgcaggatagatttgacctgaaggccacgcaggcgacgacgcagccaccacagcgaacagccgaccaagatcacgtagtcgacaacatacgaaagcgcgattgccggcataccgaagcccagcacaacgccaaacagcagaaccgagccggcctggccgatggcagaatacaggcaatagcggctatagggcttcatgtcgagcaaggcagagaagctcttctgcatcaacacgaccacgccgtagagcggcagcgagagcgctaggtagacaaggtactcggacaccagcgccactccggattcatcgaacttgccagcacagtagatcatgttgagcggacgtgcgaagacaatcaggtacagtgcgaacggaatcaggaagaacagcatctgggcgacgccacgcgaaatgcccgtgcgtacgctgtcgtaatccttctcctgtgcgtcgtgagagagctcggtatagagcgccgtcgaaagcgaggcggcaatcagcgcgtagggcagcgtgtaccacaggcgcgcataggcgatgacggaaggaccagtctcgggctggaccaccagcgcggcagcgttggtgatagaagtcgagacaaacatgcacaccgtggcgagcagcgtcgggataccgagcgcaatcgtctggcgcagcgcggggtccttaaagtcgatatggatatggggatgcacgccgtgcttgctaagcgcgggaatctgacatgccatctgaacaaagacaccgagggtcgtaccggccgcaatcaagatgatgccggcacgttcgccaaactgtgcggacacgggcgcaaaacccataaagctcgcaatgacgatcacattgttgaggaccggggcaaacgtcgaccagaagtagtcgcggtgtgcgttgagaacgcccgagaacaccgagcccaaaccataaaacagaatctggatggcaaagaaacggaacatgaacgcagcggtatccatgctgccgccgtcacccgaaaggaacgattgcgtccagataaagcccggggcgaacacggtccccagcaacgaaatgccacccagcaccaaaagcagaatgccgagcaggttgcccacgtactcgttcgaggcctcgcgaccctgctcacgcctcacgcccatgtacacgggcaaaaacgccgtcacgagcatgccgcccatcacgagttcgtagagcatattgggcaggttgttggcgacctgataggaggacgaaagtagcgacatgccgatagcggccgccattgcccacgtgcggataaaaccggtgacgcgagacacaatggtcaggatggtcataagcccggcggaacgaccaaccgtggagtagtccgacgagcccatgtcgtcagtgtcatctcgcgacgaagaagcttcggatgagggtgtctgaggcgcagattcttttgcaaaatgagctccgcgcttcaattcttcctgcgccatcgctcagtcctctctcgtgatcggggcaaccgtcgccccgcaaaatgcaactaagtcatcgggagcaagctcaagctgatagccgcgcttgccacccgagataaaaatggtatcccaaaggacgcatgtctcatcgatcagcgtccggaagcgttttttcataccgaccgggctgcaaccgccacggacataccccgtcgcggcaagcaaatctttgacatgcatcatggtcagtgacttttcgcctgcggcgcgcgcggcggccttgaggtcgagctcgtcggcaacaggaatgcagcacacgacatggtcgttggacggcgtcgtgcagaccagggtcttaaatccctgaccgggctcctcgccaagctgctcggaaatcgcgacgcccagacctgacgattcatcgccatcgtcttcgtacgtatggagaacataggagatgccggcgctttccagctcgcgcatcgcattggtttttggcgtcttaacagcctttgccatggcacatcctttccctcgcagagcgacgcaaggattaagtatagggccaattccgccgcatatgccatctcgacacacagaagcgccaccgaatcaaaaggaatcggtggcgcgtcggtactacaacgtctctttactgcgcgtcgagctgcgcctggcgctcacggtcacgcttgagcagcggcgccaagaacttgcccgtgtagctctgcgaacatgccgcgacttgctccggcgtgcctgagaccacgacggctccgccgccattgccgccctcggggcccatatcgatcaggcggtcggcaaccttgatgacatcaaggttgtgctcgatcaccagaaccgtgttgcccgcatcgaccaggcgctgcaacacgtcgagtagctggcgaacatcctcaaaatgaaggccggttgtgggctcgtccaaaatgtagaacgtcttgcctgtctgacgacgatgaagctccttggcgagcttcacgcgctgcgcctcgccgcccgaaagcgtcgtagcgggctggcccaagctcacgtagcccagacccacgtcatatagggtctgcagtttgcgcttaatctgcgggatattcccaaagaaagccagtgcttcggtaacactcatgtcgagcacgtccgagattgtcttgccgcggtaggtaacctcgagtgtctcgcggttataacgcttgccgccacatacctcacaggggacatagatatcgggaaggaagtgcatctcgatcttgatctggccatcgcccttgcacgcctcgcagcgaccgccgcttacgttaaaggagaaacgtcccggcgagtacccgcgcgccttcgactccggcgtgcttgcaaatagcgcacgcagatcatcccacaggccaatataggtcgcagggttcgaacgcggcgtgcgaccgatcggcgactggtcgatatcgattaccttatcgatgcactcgatgccctcaatcttcttgtacggccccacgggacgcgtcgaacgatgaatggcattcgtaagcgcgggcgcaatcgtatcggtgaccagggagctcttgcccgatcccgaaacaccggtaacaaccgtgagcgtaccgaactcaatcttggcggtaacgtttttgaggttgttagcgcgggcacccgtgatcttaagacagccgcggccgggcttgcggcgctcatcaggcacgcgaatcatccgtttgccggtcaaataggcacccgtcatggaatcggggcacgccatgatatcagcaggcgttcctgcggcgaccacgtgtccgccgttaacgcccgcgccgggacccatatcgatcacgtagtcggcagcgcgaatagtatcttcgtcgtgctcgacgacgataacggtattaccgatatcgcgcaagcgctcgagcgtcttgatcaggcgctcgttgtcgcgttgatgaaggccgatcgacggctcgtccagaatgtacagaacgcccatgaggccggcgccgatctgcgttgccaggcgaatgcgctgtgcctcaccgccggaaagcgtcgccgaggcgcgatcgagcgtcagatagtcgagtccgacatcgaccagaaaacgcaggcgctccaggatttccttgacgatgcgaccgccgataaactgctgacgctcggtaagctccaggccctcaaaaaactcgagcgactcacgacacgacaggcagcagacgtcgtaaatggacttgccgcccacggtgacggcaagcatctcgggacgcagacgagcaccatgacagctcgagcatggctcttcgcgaatgtatttctccaagcgagtcctggtgttctcgttcgtcgtctcgttgtagcgctcgtacaggatgttgcgcacacccgagaacttagtgtcccactggctgcgacgcccatcgagcttttgatagtcgaccgagatcttcgcgtcgcccatgccatccaaaaacgcacgacgcacccgcgggggcaggtcctcccatggcgtatcggcactcaccttaaagtgtttgcagaccgcggcaaaaatctgcggataatagttggaattgccgaacaggctgccaaagactccgtcggcaatcgactttgaggggtcttcaatcagtgcctcggcatcgactgtctttttaaagcccaggccgtcgcactcgggacatgcaccatagggcgcgttgaacgagaaatcgcgcggctgcaggtcgtcgatggaatgcccgtgctccgggcacgccagcgccagcgaatactccagcagctcgccctcggttccctcgggagcgtcgcggtcgggcagcatgtacacgctcacgttaccgtgcgccagtgccgtcgcctgctcaacggactcggcaatgcgacccagggagttctctcgaatcacgatacggtcaaccacgacctcaatgtcgtgtttgaacttcttgtccaggtcgatagggtcgtcaagcgagcgcacctcgccgtcgacgcgcacacggctaaagccctccgcacgcaggtcctcaaacagcttggcgtattcgcccttgcgtccacgaaccaccggcgccaacacaaacgcgcggcggccctcccccgccgccagcaccttgtcggcgacctgatcggtcgtctgacgctcaatgacacgaccgcactcaggacagtgcggcgttcccacgcgagcaaacagcagacgcagatagtcataaatctcggttacggtgcccaccgtcgagcgtgggtttttggacgtcgtcttctgatcgatcgacacagccggcgacagaccgtcaatcgagtccagatcgggcttgtccatctggcccaaaaactgacgcgcatagctcgaaaggctctcgacgtaacggcgctggccctcggcatagatggtatcgaacgccagtgagctcttgcccgatccggaaagaccggttatgaccacgagctggtcacgcggaatggaaacatcgatatcgcgcaggttatgctcgcgcgcgccgcgaataacgatagaagaatcagacatggaagctccttgcctcctacaacttcaaatcacactgacgatgagtttagcgcactcgacgcgcacagatgttcgtaatacaagattcgcagacgttttgctttgcgtatcgggtgctttgtttctcgaaatgccgggaaaaggttacagtaatctaatactgaacttaatttgctgtaacagaggaacgtccatgaccgaagatatcccccttgaaatcacttcgagtgacatggccaatctgcccatattcatcgccgtccttatcgtggccgctgtcatcgcacgcatatgcgtttcagtcaaacgaaaggaacagccgcctgtttttcgcgccctttggtgcgcgacgctcctcatcccgctcggcatggtagctgcatggattacgaatcaattgctcgtaaatgaggacagttccctatgggtcctttcttattcggcactcggtgctgccgccgtcatacttcttgtcgagcccttggtttcgggacttatcgaccaaaccgatcttgcgacgggaacggttgcctgtatttgccgtgacatccttgtcatcgccgctgtttcagcgctctcgttcgtttcactcgaaattgcctgcaacgaaacgttctatcgcattcccgccaactcattcgggttttccgtcgggctgctcgcgacggttctactctccctttatttgctgggacagcgtcatggaggcgtcatgaccctcgtgcccatcatctgttgcatccttggcattgccgagcacttcgtcataacgtttaaaggcgaagccatcctgccaagcgatatcttggcccttggcaccgcaatggaggtgagcgagggatacgagtttacctttaccgccggaatcgtaacctctctcgccctgctggagatttccctggggcttctttcgcttatccgaccgcgaaagctccgtacgtccacccatgtcttccccgcaatcgccgctaacctctgcgcttttctgctagtgaccgttgtggggctctcgggcttttccagcatcgacttggagcaggcgctggattttggatttgaccgttggcagcccatcaccacatatgcgtctcagggttttatcacttcgttcaccgaaatggtcaacgagttgcccattgagaagcccgaagactatacgcccgatgaggcgcagagcatcgagcaggagctcgccgccgcctacgacagcacgtatggctcgagcgagcagcgcgcggctgccgttgcccagttcaatgaaatcaagccaacgattgttgccgtcatgaacgagagttttagcgacctttcgtgctttgagcagctccaggcggccgggtacaccggccccgcattctacaactcgcttcccgacacacttgttcgcggcaccatgctcgcttcggtcaccggtggcggaacggcaaactccgaattcgaatttttgaccggagcgtcaacggcctttgtcggattaggcaagatcccctatcagctgtatcagatgaatggcgtcaacagcctggcaaaggaccttaaagagcttgggtataccgctaccgctatgcacccgcaaaaccccgtcaactaccatcgagataaaatctatcagcagttgggctttggagactttctttcaatcggcgatttcgaaggtgcgccctgttaccatgccggcgtatgcgactacgccacctacgacaagatactcgacctgcttagaaccgacgaagcgccgcagttcatctttgacgtcacgatgcaaaatcacggcggctacgactatggcaccgttcccgccgaagagctgacaaactattgggtcgagggagccagtgagggcgccaatagcgcgctcaacacctatctcacctgcatcaacgcatccgaccgggacctcgagtactttatcaacgagctccgcaatatcggcagatcggttgttcttgtcttttttggcgaccatcagccgagcgccacaacgactctcaacgacgagctgtaccctcaggaagacacggcaagccacgctttccgtgtctatcagtcgacctatttcgtctgggctaactatgaaatcgccggcaataccgagctcaacgtctacgacaccgtcggggcaaacgagattgcagccattaccctaaataagatcggcgccccgctcaccgactatcaaaaggccctgcttgcaacaaggtcagatgtgcccaccatcaatgtcgccggctatctcggtgccgacgggctgcgctacgacttggaatctgaagacagcccctacacctcgacgatcgataagctgcagcgcatgcaatacctcgagttcgccagcaaagttcagtaagcccgcccattcgcttgggtccatcgtattgcaagcacgctcggcccaaatgcatcgcaaatgactcccgctcgcaaacgagggtacaatgacgctcgtgtcacaccgcggggctccggccccaacatatacaaaggagtcaaacatgggttgcgagcacgcacaggcagccggcgggcaaacgtcgccgtcgcaatttgaggaaaatacgctgtccgaggtcaagcgcgttatcgccgtgctttccggcaagggcggcgtcggcaagtcattcgtcaccggcgccatcgccacggaactttcccgccacggtcacaaggtcggcgtcctcgatgccgatattaccggcccctctatccctaagatgttcggcatgagcggacgtcacgtccatgccctcggcaaccttatgctgcccgaaatctccgagcacggcgtcaaggttatgagctctaacctgctgctccaaaacgaaaccgaccccgtcctctggcgcggtccggttatcgcgggtgccatcaggcagttctggagcgaaacctcatggggccccatcgactacctgctggtcgacatgcctccgggaacgggcgacgtcgccctcacggtcttccagtcgctgcccgtcgatggcatcgtcatcgttacgagcccgcaggatctggtctcgatgatcgtcgccaaggcggtcaacatggccgagaagatgaacgtccccattctgggaatcgtcgaaaacatgagctatatcgagtgccccaattgcggcaagaagatcgaagtctttggcaagagcaagctccccgaggtcgccgagcgttacaacctcgagatcctagggcagcttcccatcaatccggcactcgccgaggcctgcgataagggcgaggttgaaaccgcactgcccgcacgtatgctgccccaggccgtctctgccgtcgaggccattgccccgcacgaaaccgccgaggcctaagtgaacgcaaacgcctcctatgacgtcttggtaatcggcggcggggcctcgggtctcgccgccgccattacggccgcacgcgcaggcaaaagcacctgcatcgttgagcgcgatgttgcctgcggccttaaactccttgcgaccggcaacggccgctgcaacctttccaacgaatcaattgatttccagcggtacaaccaccccgcattcgtcgaatccgtcatgggcccccagcctgagcaagagctcggcagtttcttctcctcgctgggcatcatgacgacctccgaggagggccggctgtatccgcgctcccttcgtgccgaatcggtgcgcgacgcacttctcaacgcttgcaatcacctgggtatcaccttgatctgtggagcaaacgtcgcctcggcattcaaagcccccgagggctggacactccaaatagatcgtcccgcgcgagcactcaaggcaaaaaagcacgacgaccgaaaatcggaactccgctcgcttcggaaggcgctcgccgacacctctcgcaggaacgagacgctgcaggcaaaggccgtaattatcgctacgggcggcagccccgccgacatcgcgaagacgttcaatctttccctcacaccgcagcaccccgtcctctgccccgtgtcggcatcggtcttcggcgaccagactgcgctcaagacactggatggcctgcgcgtccgcgcccgtttgacgctcacccgcaatcacgaggagctctggcgcgaagacggcgaagtgctcttccgaacctttggcatctcgggcgttgccgcctttaacctctcccgtcgcgtccagcgcggcgacacgattctgctcgacgttttccccgacctctccaaagacgagttgctcgatatgctcaaccagcgagttgagttgctcggcggcttttcgccccgcgacccccgctggctcgacggcatgctcgccccgcagttctcacacgttgtctgcgccgcattcgaacagtgccaccccgggtcgcacgaccccatccatctagtctcaatcctcaagcactttaagttgctcgtcgagggaacgacagaggagcgttcggcccaggtcacgcgtggcggcgtgcccatcgagagcgtctcagctcccaacctctgcgtgagcaacgcagcaggcgccccgctttacatctgtggcgaggcgctcgacatcgatgccgattgcggcggtttcaaccttgcgtgggcttggatctcgggcattcgcgctgcaagcagcctatagccgcgcagtctataatctaaacgcattcgggccgtctgggacaccgggcggcctctttcttgcatctaaggagacctcgatgatcgaaatcacccaagtccacgcgtcactcgatgaggccggcgacgaaactgcctgccttgctattggtagacgtgccgtcaaacgagccctgcgatgcgaggattcccagattaaagccattgagctccatcgcaagtcaatcgacgcccgtaaaaagcgagatgtccattttattttgagctttcgagttgagctgacaagctctcgactcgagcaggaggtggtcgaccgcgtcgccgagcgcgaccgctcgcgcatccgcatagtagacggcgaggctccttcattccccaaccctgtcccgaatgcacccaaggggcgtcccgtcgttgtcggcgccggttgcgccggtctcttcgccgccctcacccttgccgcagcgggccttaaacccctgctcatcgagcgaggcgaccccgcacttcgccgctcggaagcgattgatctctttcttaaggagcgtatcctcgaccccgaaagcaatatccaatttggcctgggcggcgcagggaccttctcggacggcaagctcaacacgggaaccaagaatcctgcccatcggctgattcttgagaccttcgtcgaagcgggctcacctcgcgacatcctgtgggacgccaagccgcacattggctccgacatcctccccaccgtcgtcaccaacatttctcagcgcatcgagcagctcggtggaaccgtccgttatcgaacaaagctcgtcaatattcgaaccgatggatctggcgccatcaccggcgttgatgtcaaaccgccgcaagaaaccacaagcgaaacaatcgccacaaagcacctcattctcgcctgcggccattccgcccgcgacgtattcgagcttctcaaagaacataacgttaccctcgcgcaaaagacctttgccatgggtgtgcgcatcgagcatccacagcgcgacatcgaccgcgcccaatatggcccttcggcggggcacccgtcactcggagcagccccctacaagcttgtcgcccatctccccaacggccgcagtgtgttctcgttttgcatgtgccccggcggacaggttgtcgcggcctcttccgagcagggccatctgtgcgtcaacggcgccagcctcaatgcccgcaacgggcgcaacgcgaatgccgccctactcgttaacgtcacacctgacgaccttcccgacgatgatccgctcgcaggcattgaactccagcgcgcctgcgagcgagccgcctatcgcctgggtggctccaactggaacgcgccggcacagctcgtcggggatttccttgcgggacgcgccagcacggcacccagagaggtaaaaccgacctatccacttggcgtgacctggacggcgatcgacgatgccctcccgcagcatatcgtcgaatcgcttcgtttgggaatccccctgctcggtaagaaactgcgtggctatgaccgccccgatgcggtcctcactggcgtggagacgcgttcgagctccccggtcaccgtcatccgcgatcgaacatgccacgccgcgtcgactccgggcctttacccttgcggcgagggtgccggatatgccggcggcatcatgagtgccgccaccgacggcatccgttgcgctaaggcgctgatagcagacatctagtgcacgaactcccgcgtccgaacgacacaggccccaagctccacagggaactcggggcctgttcactacttcctgaatcgtgcaccctggcgttttctgcccgaagcaaaggtagagcccttgcgagcctgcgaacgcaaacgctcgatcgtttcgtcctcagatgcgccctcaagcatcgcccgaatctgaacgacagcatcgcgcagacgtgccgcctcctcaaagtccatggcggcggaagcgttacgcatgtcttcctccatggtctcgacgatccgcacgagctcgtcatgcggcagcccttccagctgctcggcaagcgtctgctcgggcgccaccgtctccggcgcggcgccctcgccgttttcgtcgggcgtatagaacgcaccgtgacccagcgaatcgcctctcgagcgccccttcgagcccacagtcttttcggcctcggcaataaagctcgaaatgtcgttaatggccttgcggactgtcttgggcacaatgccatgctcttcgttatatgccatctgaatctcgcgacggcgctgcgtctcctcgatggcttctttcatcgaatcggtcacaacatctgcatacatgatgacctcgccgtcggcattacgggccgcacggccaatcgtctgaatcaacgaacggcgattgcgcaagaaaccttccttgtcggcgtcgagaattgccaccagcgagacctcgggaaggtccagaccctcgcggagcaggttgatgccgacgagaacatcaatctttccctcgcgcagcgttcgcaggatctcgacacggtccatcgtcgctgtatcggagtgcatgtaattgaccttaatgccggcatcaagcagatggtcggtcaggtcctcggccatgcgcttggtgagcgtggtcaccagcacgcgctccttgcgggcaacgcgctcgcgaatctcgtcctcaagatcgtcaatctgtccacgaaccggacgcacatcgatcttggggtcgagcagaccggtcggacgaataatctgctcaacgtcgttctggctaacccgcagctcatagtcgcccggcgtagccgagacgtagatgaactggggaatcctcgcctcaaactcatcgaaacgaagcgggcggttatcgagtgccgaaggcagacgaaaaccgtgctccaccagcgtcaccttacgcgagcggtcaccttcgtgcatgccgcggatctgcggcaccgtcacatggctctcatcgatgatgcagagcatgtccttaggaaagtaatcgatcagggtaaacggtggctcgcccggttttcgaccgtccagatgacgcgagtagttctcgatgccgttgcaaaagcccatcgtctcgagcatctcgagatcatagtcggtgcgctgctgcagacgctgtgcctcgagcagcttatcagtcgccttgagctcggccacacgcttctcgcactcttcactgattgatttcagagccgctttgaccttaggcttctcagtcacgtagtgcgatgccggccacacgggaatggcctcgtactcacgtagcatctcgccggtgacctcgtcgatctcggcaatcagctcaacctcgtcgccaaagaactcaaaccgcaacggatgctcggcatagggtggatacacgtcgacgacatcgccgcgcacacggaaggtgccacgtgccaaatcatagtcattgcgatcgtactggatatcgataagcgcatggataaagtcatcgcgctcgagcggcaccttcttgtcgacgttcggagctaggcccgcatagtcctcgggagagccaatgccatagatacacgagaccgatgcgacgacgatcacatcgcgtcgagatagcagcgatgcggtcgcctgatgtcgcagcatctcaacttcttcgttaatcgaggaatccttctcgatatacgtatcgctttgcggcacatacgcttcgggttgatagtaatcgtagtacgacacaaaatagaccacggcgttgtcagggaagaattccttgagctcgctcgcaagctgagcggcaagcgttttattgggagccataaccagcgtcggcttccccagggcctcaatagtcttagccatcgtgaaggtcttgcccgaaccagtcacgcccagcaaaacctgatagcgatctccgtccctcacgccctgcacaagcgactcaatggccttaggctgggagccagcgggctcgtatggagacacgaccttaaacggtacctcagagccctcaacgccaaaacgtttaagctctcctccaacacgctcaacttcaaattccgccatggatactcctaactcatatatctgcagtatacgcaggcggcaggcatagtcctatacgaaccgatcgggatagagggtcttgtagcgaacccaggcattattgacacgaatcagatacgcctgcgtctcgggaaaagtgattgcattatgaagcgacgtgctctgctgcgcccatccgtcgacattgcccatgccggcgttataggcggcaatggcactgtcagtcgacccgttaaaatacgttagaagatacgaaagatacgcacagccaaactcgatgttcgtagcgggatcgttaaggtcgccggctgaatactcgctgccatcgacaagacccttggcaatcatatcctgggcagtctcgggcatcagctgcatcaatccccgtgcgccttgattcgactcagcctcgggatcccaattcgattccgactttatgacagcgcacaccagatacggatcaagattgtgcgaaatgctcgattgctttacgtacgcctcatagtcaattggatacaaaggcttaaagaaggcggcaggggcatacgagtagacgagcgaaataaggccgaagacaaacataacggcaagtggcgccacgcgataccacgtaaagaaacgtgtcttaggcatcggcctcctccctatccactacatccccgaagccatggcgcgcaagccatgcgtccagttgttcaaagagcgagttatcgcctgccgcattatcgatgaccgtcgtagcgagattgcaaagcgaagcctcatcagattggcatgcagagcgcgcatcaaaatcagaggactccataccacgatgaatggcacgctcacgacgaactgctaaaggagcgctgataaccagaatttcatcagccaggccaaaagcatcctcaaaaccagtcggggcagaaacctcgacaaccgcaaagggataacggggggacgaaaccgtgcaacaaaccggatcaagaatcctcagtgacagctgttcgatgagaaccggatgaacgatgccattgagccgcgcgactgtatcaggagaggcgaaagctcgagcagcgaggacattgcggcgaatgccgccctccccgtccagaatgtcccaaccgaattcttccgcgagggcattgacgatatcggagcctggcacatacagcgatttggcaagctcatccagatcgataagcatggcgccatgagattcgagatagcggcaggcagtcgacttacccgaagcaatattgcccaagacaaaaacggtaaacatcaagtcctccctaacgccaatgggagttattatcgcgcaaatacaaaagaaggactcaaaatacagccaaacagtaagagaagctaaacgaaggcgagttcgtgtattacaaccctctattaaacgcaaaaaagggggaggccgcgcggcctcccccttcttcaagtcatgcgacggctcggtgccgtccaccggtcagcggcgccctggcctcccacgggctgacccgggtcagcccgtgggaggccagggcgccgctgaccggtggacggcaccgagccgtacgcttgaacttagaagggggaggcctcgcggcctcccccttttttgcgtttaccgggcgtaaatgactcatttacaccagacgatcttatcgtttttggtattgagcttttatttaaagaaaataaatcgaataacaagggcaactgctatgaccgcaatgatcaaaagcaggattgtcagtcgatgctgcttgcgtcgtttacttgtcgaaacgaagattgattttccctgttttggcgtttcgagatagcgagccgaatgcgtcaaggtttgctttggtcgaggacctctttgtcgatgagtggcggatgctttcatcggctcatcactagctgcgctgtttttagataatggtgcgtctttcagatatacagggtctcccgaggcgacgcccatatgcttacgtcccgtttgggcatcctcgagcgtttgatatcgatttctcgtcacatattcgggctctgcatcattaatgggctcttgcgagatgtgggggcgacggaaccgtggcggctgcgtggaaatatcttccccctgcgtcggcataaacatattgttctggttttggtcgtccatgatgccctttagctcgttaccaacaacgtgtacgcgctcattgtaagccccttgttatttgtagctgtggacatactcgttatttaagctctggttcaaagaaccttaaccttccaaaaacctgagtcttactcacttagatatgcttatagtactggactcaaaaaactttatagtcggtgtatatatgagcaccgggtgggcatatataagaacgtcaaaagaagtcccagtcacctagaagatgactcggcagtcctataaaggagtggtaaacatggcaagcatggttccttatcgttcggtttttggcgttcgtccctctgctagctcgctgttcgatctgtttgatgatatgagtgacctggcgaacagctctattgcctccaaggcgtttcccgttgacgttgaggataagggcgatggctatgaggtcaaggcttatctgaccggcgtcgccaaggacgatatcgatgtcgagcttaatgagggccgtctgtccattagcgtgaatgtcgaggaagacgaggagaacgagggcaagaacttcctgcagaaggagttcagctcgtacagcgcgacgcgtggcgtatatctgaaggacgcttcgagcgagggtctctctgctaagtatgctgacggcatcctgaccgttacggttcccaagatcgtcgagaagaagaacgttacgaagatctccatcgactaacgtttccgatggtcagagcttttgagccaagataaaggggctgggatttgattcccggccccttttgttttattgagcggtctatacaatggttgtcggttgatactgacttgcagggcgtatcgagagttttcgcgatccttggagaagggttgcggagctgccaacctcgtcatccagggttgcggccagagctttggcatagcttttgacggtaaggctcggacgattgttatcttggctgatatgcatggcaatgagctgttcggtgcgatcggtaacaagttcgcgcgcggcttcggcggcttggccattggagaggtgtccccttgcagacaggatgcgctcctgaagaaagcggggatattctccctcgcgcagcatggtcacatcgtggttgctttcgagcgcgaggactcgacaatctttgagggtgttcatggcttggctcgatagctctccggtgtcggtggcaaagccgatggaatcatcgagggcgtcgaatcgatagccgactggattgatgacatcgtgtgatgttgagtaggtttgcacgtggatgccggcaatggatagggcgtcgccgggatcgaattcctcgacagacagatgcgaaagattttctttgttcgaaagagtgcccctgctggcaaagagggggccgtgccagtgcttgcaccagacatcgaggcccttgatgtgatcgctatgctcatgagtaatgagaagagccgagacgttgtctgccgagagccccagttctgccatgcgttttaatgtctcgcggcgagacagtccgtcatcgaccataatgagcccctgcgggccctcgataagtgcgcagttgcctttagagccactgccgaggatatgaaggtgcagacgagacataagattccaaaggatacaatgggtgcggacgaatagaggaggaagcaaatgccaacggtatctcagcattatggacaccatgctgcatcgtgggctgatgataaagccttggcaacgcggcggacggctgcccccgtggtgctcatggtatcaggtggtgcggactcgacggctttgctccttatggcgtgcacatcaaagttggatattctggatgggcgtggtgtggcccccatcgcgcgcgagcgactgcacgtgctgcatgtgaaccatcatctgcgcggcaaggcgtccgatggcgacgaggcctttgtgcgtgagctctgcgcacaatatggtttaccgctgtgtgtcgagcatgcatattttgatgatgaatcgggcaatatcgaggcggctgcccgcgaggtgcgctatgccgcggcgcgaaggtatgttcgcgagctctgcgcccagacgggggcaccgcgaacggcggctcgtatctgcaccgcgcacacgtcttcggatcgcgcggaaacgtttttgatgaacgcgattaagggttcggggcccgctggcctatcgagcattcctcgccggaggaatatcgtggtgcgtcccttgctcgacctgactcacggcgagctggtgggctatctgcaggtacatggtcagccgtggcgtgaagacgagagcaatgaggacatctcgtatctacgaaactacgtgcgccatcgagtgatgccggtggtggcgcagcgcaacgcgagcgtctgcaagacgattggcgccgcctgcgagatcttaggcgatgaggacgcgtttttgtctcagctttcggcacaggcgtttcgaagctgtttgcgcaaagaggcagcgggcgcgctggtgctcgatgccaggcgccttgctgcagccgaggtggtaatcgcgcggcgcatcgtgcgactggcgattaagcgcatcgatccggacgcccgtccagggatgcgacatgtggagcgagtcctttcctgcgttgccgagggtgccggctcggtcacgcttccggcggggattgacgcacgcattgagtttggcatgctggcgtttaaggcgccggcggctcgcgagggcctggtcgcggactgggttaccgtgcccggccgtttgccgttgggcgggggacgcatgctggtcacagaaccgatggccgttgagccgggatgcgatatcgtgcgccgagcccgtgagcttgcggctgccggggaagtgacagctttggtagacgcggctgccctgggttttgccgacagcgatagtgagcggatcctggcgggctcgcgtggcgagatccctgccgaggcgcgattggcgcgcctgtgggtggacggtccagcaccgggagacgtgatgtgcccgttagggatgagtggccgaagcaagaaagtatccgacttgctaggtgaggctcgcattcccgtttccgagcgcgccggcgtgcccatggtgaggacggcgccggggggtgccgtggtgtgggtcgccggagttcgcgcggacgagcgttttaagtgcacggccgcaacgcgcgtggcatatctgctccgcgtggtcgatgcggaatagcgtcccacgcctgctattctgtgcgacgttgacggtattcccgcgctgatggcgcacgggctggtaaatttaccccgtgcgctgctagaatgtgaagttcgcgtccatacggcggtgtgtgggcgataagcacaagaaagggttgtcatggcttctcaacatccggatatcgagaaggttctgtttacgcaggaggatatcgacggtatcgtctctcgcttgggcgaggagattactcgcgactacgcgggtaaggatctggtgctgattgcggtcctgcgcggcgccgtggtctttatgggcgacctgatgcgtaagatcgagctgccgaccaacatcgatttcatggctgtttcgagctacggcgacggtgtgaagtcctcgggtatcgtgcgtatcattaaggacctggatatcgacatccgcggtcgcgacgtgctgatcgtcgaggacattctggactcgggcctgacgctcaagtatctgatgaagaacctcgagagccgcaagcccgcttctctggaggtcgccgccttcctgtggaaggacgttgaggaccgcgtctcggccatcacgcccaagtatgttggaacccattgccccgatgcctttgtggtgggctacggcctcgactatgccgagcgctatcgtaaccttccgtatctgggcattttgaaaccggaggtttattcgtaagatgcccgacgaccgtaacgataacaattcccagactccccgggagcctaagatcccggggatgcccggaggcaagaagcccacgcgtacgggctggctgtatttcattttggcttgcgcgcttctgggctacgccttctttaacatgggctctggctttgccaattccagcaataccgtaaagctcgcgacgagcgagatggtcaacgccattaagcaggatcgcgtcgaagatctgacctatacggttcaagacggaagcgtgacgggtcattactggaagacgaagaaggacaagggcgatacgagcgagctcaagagtttctcctcgacctatgtcggctccgattcgcttgccgagctcatggcggagcaccccgataccaagtacatcgtcaacaccaacgaccccgatttttggggcgacttggcgatgagtgtgcttccgacgatcgcccttatcgccatcatgttctactttatgcgccagatgatgggcgccaacaacaggaacatgcagtttggcaagaccaacgctaagaccaacgaggccacacgccccaaggtcaagttcgaggacgttgccggcgtggacgaggcagtcgaggagctcgaggagatccgtgactttttgagtgatccggatcgctatcgcaagctgggcgccaagatcccgcgtggcgtgttgctggttggccctccgggcaccggtaaaacgctgctggccaaggccgttgccggcgaggcgggcgtgccgttctttagcatctcgggttccgactttgtcgagatgttcgtaggtgtcggcgccagccgtgtgcgtgacctctttaaggaggccaagtcccaggccccgtcgatcatcttcatcgatgagatcgatgccgtgggacgtcagcgcggagctgggttgggcggcggtcacgacgagcgcgagcagacgctcaaccagctgctggtcgagatggacggttttgaggagagcgagtcggtcatcctgatcgccgccaccaaccgccccgacattctggatccggcgctgctgcgtcccggccgttttgaccgtcaggttacggtcgaccgtccggacgtgaagggccgcgagcagatcttgcgcgtgcacgctgagaacaagccgatggacgaggacgttaagtttgagaagctcgcccagatgactgttggctttactggtgccgatttggcgaacctgctcaacgagtctgcgctgctggccgctcgccgtcatcgttccgtgatctcgatggacgaggtcgaggaatcgatggagcgcgtgattgccggaccgcagcgcaagggtcgcgtgatgaccgaggccgagcgcaccacgattgcctaccacgagagcggtcacgccctggtgggccacatccttgagcactccgatccggtccacaagatctcgatcgtcagccgcggtcaggctctgggttacacgctgcagcttccgcaggaggaccacttcctcaagaccaagaacgagatactcgacgagctcgccgtgttcttgggcggtcgcgttgccgaggagctcatgtgcgatgacattacgtcgggcgcgagcaacgatctggagcgcgcaaccaagatggcgcgcgagatggtcacacgtctgggcatgagcgaggagctgggcactcaggtctttggcgaggcgcagcatcaggtattcctgggccgcgactatgccgatcatcaggattactccgaggagacggcgcgccgcattgatatcgaggttcagcgcatcatgcgcgaggcccatcgtcgtgctgtcgagatcttggatgcccgtcgcgatcagctcgatctgatggcgaaggtgctgcttgagcgcgagactgtcgagggcgatgccgtgaatgccctgctcgataacgagtgggacgcctaccttgagcgcgagggcgatatcctggcggccaaggaggagcgcaatgccaaggcggccggcatgccgaccaagaagcgcgcgcctcgtatgagcgaggaggagctggcggctgatgccgcggcctttgcgcaggcggccatgcaggaggatgccgaagtcgcatccgatgatgccggcgatgactgtgccgttaatgccggtgccgacaccgacgacgacaaatagtctttgtggtgaaagcctccgcggggaaacctgcggaggcttttttgagcgatattgggccatctgttgattggggacagacttaaatgagcgttttcacgcatttaagtctgtccccaatcaacattgctgcggcactttgctcggctaaagcgtacaatagcgcctatgcgaaaggggaacagatgatcaacgaaactatgtatgctcacggtgcggaaagctccatcatccgcgagatttttagctatggtcttgagcgcaaggcgcagatcggtgcggaaaacgtattcgatttttcgttgggcaatccgagcgttccggcgcccgatgccgtggcggagtcgattaagaaggccctggagctgccgagtgaccagctgcacggctacacccccgcaccgggcctgccgcaatgtcgtgccgctgtggccgaatcgctcaaccgccgctttggcacgagctatgagggcaaagacgtctttatgaccgtgggcgcggcggcttcgctcacttgtacgctcaacgccgttacgaatccgggcgacgaggttattgttatcgctccgtactttccggagtatcgcgtttggattgagaaggccggctgtacgtgtgtcgaggcgctcgccgatgaagatacgttccagctgagcgtggacaacgtgctcaaggcgattaccgataagacgactgccgtcatcatcgactcgccgaataacccgaccggtgccgtatatacacgcgacacgctgacgcgactggccaatgttctgcgcgaggccaacgctcaacgcgatcccgagaatcagattatgctcatctcggatgagccgtaccgcgagatcgtgtacggtgccgaggtgccttgggtgccctcgatctacgagaacaccgtggtgtgctactcgtattctaagtcgctttcgctgccgggcgagcgcgtgggatggatccttgttcccaatacgaatcctcaggcagatcgtctaatgcccgccgttgccggtgccgcccgtacgctgggcttcgtgtgcgcgccggcgctctttcagcgcgtaattatcgactgcatcgatgagccgagtgacgttgaggcctatgcacgcaaccgcaccgcgcttaccgacgcactagcggagtatggctacacctatgttgagccggatggcgcgttctacctatgggtgaaagcgttggagcccgatgcgaatgcgttttgcgagcgcgcaaagaagtatgagttgcttgcggttccctcggacagctttggtatgccgggttggttccgcctgggctattgcgtgagttacgaaacgattgtcaattcgctacccgcttggaaacagttggcggacgagtatcgttaaaagtaaagcgctctgcctacaatgttttacgtgaaacggggtttggtgttaagccggaccccgttgtcatggacgttgtgtctttgggatggagcggttttacgactatcgaaggctatgcgtacaatgaatataagcgacggccgtgccagataaggagacctgatgccctacctgctttcttgtgacattcatacccatacgatgttctctgcgcatgcatattcgaccattgaggagaatgtgtactgggcggcagagcgtggcctgcaggtgctcggatctgccgaccatctgagctctatggttacggcttgccccaatgacctgcgcagttaccaattctttatcaaccaggatatctggccgcgcatttggagcggcgtgctggtgctgcgtggtgccgaggccgatatcgtttcgctggacggaagcctgtttggcgaggacactcctgtcacgctcgatattgccggcgattcgtacagccgtcagcattcactgttcgatttggttacgcgtaatttggattatttggttgcaagcgtgcataatccgcagattgctgagggcgcgacgctggcccaaacgaccgagatgtatgtcaatgccttggaacaccccaaggtgttcatgctgggccacgcgggtcgctcgggcgtgccgttcgatatcgacgaggtactgttggcagctaaggccaagcacaagattatcgagatcaacaaccatagtcttgaacacggtgtcgacactgagcattgggccgtatgccgcaagatcgccgagcgctgcgccgagctgggcgtgggcattggcgtgtcgaccgatgcccacattggcatggccattggcaagctcgatcacgcgcgcaagatgctcgacgagattcacttcccgctggatttgatcgtgacgcgcgaccgcgagacgctgctgcgcgagatggcggcagccggcgtgtgcgatctgcgcaatgggatgtagcggagtttataaaccaagcgaagggggcggcccaggcgggtcgccacctttcttgtcccaaaaatatactgaggttggttagcggcgttcgaggaccgctacggtttcggtgtggtcggtgtgagggaacatgtcgacgggcgtgatcttgagcaggcgatagcctccgtcgaggagctgatgcaggtcgcgctcttgagtcacggggttgcagctgatataggtgatgcggcgcggcttaagtgcgcaggcagcttcgaggaactcgggggtggatccggcacgcggcgggtcgatggaaaggacatcgatccgctcgttgttgtcggcggcatctaggatgtaatcggtggcatcgtcggccataaaccaagcgctgcgggtgaggccgttgagctcggcattgcggcgtgcgtcggcaatgcccgccgggttgcgctccacaccgagcagcatgatgccgatccccttgttctgggcatctttagctgcgcaaagaccgatggtgccgctgccgcagtaagcatccataagcacatcgccctggtgcagatccatgccgtcgatagcgagctgatagagcagctcggtctgctgcggattggtctgatagaacgcggtaggggagatatcgaattcgcaaccgagcagctggtcgcgcatgcactcggcgccatatacaatgcgggttgcctcgccgaggatggcgttgccgggacgtccgttgatgttttgggcgacggtgacgatgtgcggattgagtgcggcgacagcctcaaagaactcctgcgcatgcggcaagtcgcgctgagcggtcacgagcgtgaccatgacctggtcggtacgccagccgcagcgaacgacggcatagcgaagcaagcccagatgcttgtcctcgttaaaggcgggaatgcgcaggcgctcagcctcacgcgcgatgccgttgagaatctgacgggcacccggcgcctcgacaggacactcgggtacggcaacgatcctgtgcgtgccgcgctcaaagaaaccgcaacggacagtgccctccctaccgggagcaaagggagtggcagccttatgacgaaagccacgcggcgcaggatatttacccggatcgcccagggtcacgcccataccgcgaatagaatcaacggcgataccctcacgctcacagagcgaagcaaaaagctcctccatagcagcctgcttggcggcgagctgcttcttgtaaggaagattgagcgccgtgcacccaccgcaagctttcatgatcgaacagggggacttggggtccacagccttacgcgcagacgaaacccgatctttatgcgagcgcttggagcgagtctgagatgccttatcctcgttccgacgagagccgggacgcttggccttagccttgcccttggccgacttacccttcgcgtcctgagacgacttggatttctgagaagattttttctcctctgacccctcagccgcctcgatcaaagcacgacgagccttacgctccgcacgagattctgccatgaattaaccccactaatttacaaattgaaagctgaaagcattgtaccgtgccaagctagcggacgatatacaagcgcctatttcatgtcagtgataagtccaacgatgtttgcccggcgtgggcggggagcggcgcgtaattaagtttatcgcgagttccgcacgcaaaggaaagcacttaatgtgctttccgtcttgcgcaggactgtagagcaggaaacttaattacgcgccgctccccgcccacgctgggcaaaccctcccttgtactccatctcactaaagtgtatgattctggacgttacacgaatcactttacttaactaaagtgccatcaaggggggataccatgaacaccgatatgtctcgtcgtcagtttgttggtctagccggctcgctcgccacggtgcttggccttggtcttgtcggttgcggcggtggtgccggcaagggctccgctgctggctctgccgcggccaaggatgtgaagggtgctgcggagtccaagaagctcgtggtgggcttcgataagtcctatcctccgtacggctttgtgggcgacgatggcgagtacaccggctttgatctcgatctggccaaggctgttgccgataagcaggactgggaggtcaaatacgaggccatcgactgggacgccaaggatacgctgcttaactcgggcgccatcaactgcatctggaacggctttaccatggagggtcgcgaggacgactacacgttctccgagccgtacatgctcaacgagcaggtgctggtggtcaagaaggatgcgggcatcaagagctgggacgatcttgccggcaagactgtgattacccagactgattccgctgcgcaggacgtgcttgagggtgatcagaaggacctggcagcgacgtttgccacgctcgacacgatcggcgagtacaacacggcctttatgcagctcgagagcggcgcggtcgatgccgtggcgtgcgatctttcgattgcccagtatcagcttgccgccaagcccgatgcctatacgcagcttgatgagccgctgtccagcgagcactacgccgttggctttaagaagggcgacaccaagtcggccgatgctgtagccgagtcgctcaaggcgctctacgaggacggcacggtcaaggacctgtgcgacaagtattcaagctatggtctatctttcgataattgggtgctcaagtaatgtctattcaggtcatgatgcagatgcttggccagggattcttggtcagtttgcagttgtttgtgctgacactgctggggtcgattccgctgggaatccccgtggcgtttatgcgcatgagcaaaatcgcgccgcttcgctggattgcgcgcatctacatttcggtcatgcgcggtacgccgctcatgctgcagatgtttgccatctactttgccccgtactacgtgtttggcatttcgctcacgcccgattccaagtggacggcgtgcgtcgtggcgttcatcatcaactacgccggttactttgccgagatctatcgctcgggcttgcagtccattccgcgcggtcaatacgaggctgccgaggtgctgggctattcgcgcgtgcagacgtttctgtatatcgtgatgccgcaggtcgccaagcgtattctgccggcgatgggcaacgagatcatcacgctggtcaaggacacgtcgctggcgtttgccattggcgtgggtgagatgttctcgacggccaaggcgctggtcgcctcgcaggtgagcatggtgccgtttgcgatcgcggcgctaatctactgggtctttaacttcgtcgtcgagatgctgctgggcgctgccgaaaagaagctggactattaccatgactaactcagtgatgaaaatcgaaagcgcgcgcaaggcgtttggcggcaatgaggtgctcaaggatatctcgctcgaggtcaagcgtggcgaggtcgtggcgattatcgggccttcgggtggcggcaagtccacgctgctgcggtgtgccacgctgctcgagacactcgacggaggctcactctcgtttggtgaccttgccgttgcgacggatgcgggttcgggcgcggtctatgcgaagggcgatgtgcccaagcgggcacgctcgcgattcggcctggtgttccaaaattacaacctgttcccgcactataccgtgatgaaaaacatcatcgatgctccgattcgcgtgctcaagcgcccgcgcgagcaggctgaagcacgtgcgcgtgagttgatcgcgcagatggggcttacgggcaacgagaacaaggtgccatgtgagctttcgggcggtcaacaacagcgtgtgagtatcgcccgcgccttggcgctcgatccggagatcctgttctttgatgagccgacttcggcgctcgatcccgagctgacggccgaggtgctgcgtgtcattaaagaccttgccgcgcagaatatgacgatggtgatcgtgacccatgcgatgcagtttgcgcgcgatgttgccgaccgcgtgatctttatggacggcggtcgcattgtcgaggagggtcctgccgagcaggttatcgaccatccgcgtgagcagcgcacccgtgagttcttgagccgtatcgagggataggctcaggtatttactcaactattaattgaggcgaagccgccgcaggtcttacggtctgtggcggctttttgtttgcatcgacggggttcaataatcgcctcacaagcttgtctcttcctctcgccgcctgtattcatacgtgcgccgaaaggtatgcatggacagccgcccgtgagggtagggtggtggcataggacatttggagggtgagtcggctcggctgccgaccatgctgctcccgggatggcaccgaccgcgaactctccccgttggcgtcgcgcattgcgcgcggccctgcaaggaggtcatcatgggtgctcccaagaccggtaacgtaaggaacgtggtgctcgtaggccaaggcggggtgggcaagacctcactcgccgaggccatgctccacctttctggcaagactgcccgcctgggcggccacgacggcaccaagcccacgctcgactatgaccccgaagaggtcaagcgtgcgttttccatctcgacgaccattgcgccgatcgactggaagggcgcgcgcatcaatgtgctcgatgccccgtgctatcccgattttatcggcgacgcctttgccgcgatgagcgtctgcgagacggctctgtttgtggtcgacgccgaggccggcccgcagcctacgacggttaagctctggtatgccgccgaggacctgcgcctggcgcgtgcggtgttcgtaaaccgcctgtcgcgctccgaggccagctttacgaccacaatggacctgctgcaggagcgctttggcacgcgcctgggcgccgtgacccttccctggggcgagggcgaggactttgacggcatcatcgacctagtgcgcatgaaggcgcgccattgcaacggcaccgaagccgttgagtcggagattcccgaggagtatcgtacccaggccgaggaggcccatgaccatctgtgcgagctggtggccgaggctgatgacgaactgatgatgaagtacttggaaggcgaggagacgctgacgcaggaggagcttgaaggtctgctgtcgaaggcgatcgccgagcgcatctttgtgccggtctttgcgggcgattgcattaaggagcagggcgtcaactcgctgatggacgacatcgccacgtacttcccggcgccgacggactacggcgagatgccactcatcgacggcgattcgcttaagatctcgagtgacgatgaccgtccggtggcatttgtgtttaagaccctggccgatccgcagcagggccgcatcagctttatcaaggtgctgacgggcacgcttgagccgggccttgagctgatcaacgcgcgtacccgcaagagcgatcgtctggctcacctgtatgtgatgtgcggccgcgacatgaccgaggtcggtcacgcctatgccggcgacattatcgtggcgcccaagttggcggcagagacgggtgacacgctctccattaccggtaaggtcgaggcagcggcgtttaagtttcccaactcgcagtatcgcattgccatcgaggccgagaaccgcggcgacgaagagaagctctacacgtttatcgaaaaggcctgcaaggccgatccgaccatgagcatcgaccgcgacgaggagaccggccagactatcatctccgccgtgggtgaggcacaggtttcggtgctgctcaaccgtttggaggatcgcaccaaggtcgtggccaaaagcgtgccgatccgcattccgtatcgcgagaccatccgccgcacggcgagtgcccagggccgccacaagaagcagactggcggtgccggtcagtatggcgactgctggctgcgcgttgagccgctcattgggcccgacggcacgagcgatggctatgagtttgtggacgaggtcgtaggcggccgtattccgcgctcgctgatccccgctgtggacaagggtgtccaggagaccatgaaggacggcatcattgccggctacccgctcacgggcattcgcgtggctgtgtacgacggctcgtatcacagcgtcgactccaacgagatggcgttccgcgcggcggctcgcatcggcctgcgcaaggcatgcgccgatgccgacccggtggtgctggagcccatcgaggaaatcacggtgactatccccgagagctacgccggcgccgtgatgggcgacatctcggcctcgcgcggtcgcgtgacaggcatggagaccgatgagcgcggcgacaccgtggtcatcgctcaagccccgctggctgagctgacggattactcgacgcgcctgcgctctatcacgcgcggcacgggtgactttaccatgaagcccgccggctacgagcaggttccctatgacgttcaggccaagctggtcgagcgctatgaggagggtcgcgccaagtagcgtgtgattttgcctgcaatgtagatgctgacgaaagggccgccttgggtaaccgcggcggccctttttggtcccttggggacggaggaaaacggatcattttaggttttggggcagcttggtcggtcctagtctcccgaggtctggttgcggccggtggcgtagtcgatttgcacgtgcggctgcaggttgtagcaatatacgtggaagcagagggtcttgccgtggtcctcgaccgattgcgcctcaaggcgcacaccgcggcagacaagttcctcttcgctatacatgggcgtgacgcggtagagcacatggttgcccgtgtcgcggatgtagccgagaatctgctcctcaaacggcagcatgcccgtttcgttgagatagcgcgtgccggtgaggagattcttgcggttggcgttttcgccgcagagcgaccaggcgataaggtggcagcggttgtagaggctctggcccggaataaagtcgtagcgctgctggcgccatccagcgggatggatacgcgagatatcgccgcgctcgccttgaccgagtgattcggggcccacgcaggcgagcgctttgcgggtgcggcccaggctgtcgagcttggagaacttcttaaagcagccctcttctgtagcgcgctcgtattcatcgagcgtgaatgatggtgtgccgagcgggtgcgtgctgtcggcgcgcagggcaacataggggttgcccgcgtagtcgggaatgctgctgaggtatacgccgcgggcgcggttgaggtcggggttttcgacctcgtcgatgggggtggcggcgctgtccgcggaagcgccgtcgccggtgtcggttgcggcggaatcggagccatcgccagggtcctggccgttttgagggtccgaggagctcgccgttcccgattcgagccgagcgaccaggtccgcctcgtcgtcggtgcggctgggactttcgttttgtttctcggccagagctaccgcctgctcatcgctttgcggcgacagcaacttgggcgctccgtcgagcgatcccgtaaacagcgcaaacccgagcaccacggcggtgccgatggaaagtacttgcttgtaggcgggcttgcgcgacattgaggctcctggatggacggttgggaatctaccagtctagcaggagccggcaggggccgttctgtcgaacaaatactcaagatttgggatagacgctactgattcatttgtcccgcgttctagatcgaggtggagtcgagccagttgagcttgcactcgagaatgcgctgctcgccgggttcgctgcttccgtcaagtagggcgagcagcatctcggctgcttcgcgaccttcttggtcgacgggctcgatgatggtggagacggtcggtgtggtgagattagtccagtcttcgcagttgagtcccaaaaggccgatttgctgcggaagcagatgggccattggctggagggccttgtagacacggggaagtgcccactgattttgcacgaagataagggttcgcttggcgggattgaacttgaatttaaagtattcggtgagctcgttgattgacggcttgttgtgatcgatgggaatcgctttgtagagctgcccgttcgctgccagcgcctcggcatacccctgaaaacgctccatgcgggtgcgcatttcggtcatgttggcggcaatggaaaagaaatcttcgtagccggcgtcgaggagtgcctgtgtggcgttgtacacgccgtcgtaaaggttggttttgatccagctggtacctgggctatagatggccgcatcgaaaaagacgaccggcttgccggcgcgtctaatgcggtcatgcacggctttgaagtttgccgtgggctggatgataaagccatcgacgcccagcgagagcatcttgtcgacgtacatgagctcggtctcggggttaaagttgctcgtgcaaacgaccgtctggtagcccgcggggagcatgacctgctccatgccattgagaacgagccccgcccatttgttggtgttatccaaaatgatgatggcaatgacgtgggtttgcttgccggtgagcgtctgcgcttgggcgttgggaacgtatccgagttccttaatgacgcgcgcgattttgttctgcgtcttctcgctaagcttttctcgtttgtcgttgaggtaatacgagacgcttgccgtcgaggttcccgcctctcgagcgacgtctgcgatcgtaacgcgctgttttgccacagcgactccttccgacagatgagcattttccaacatgatgactttgagtcttggtgaaggatacgcttcggtgagcggctttttcctttcatatgagtatgcaacaaatgcggcatacgggtggggtcgaaatttgtgaccggcatgcgcatctgccgtctaccgagaaaatcaaatacttcttgacttttgaaatcgagggcaaaatcgcaggattcatttttggttaaacgcataactaaatcgcataaccaacgctctgacctgcgcgtttaccgaaataaactggcattaagaaaaacgagcacctatattgttcttgtcgaaaagacagcaagtccaaacggcaggggatgctccggaggcctccgcaaacggtgtcttgcgcacgcaactctatgaaaagagggaagcaatgaagatcgtaggcgttgccgcctgtactgttggtattgcccacacgtatatggcccagaaggcgattcaggatgaatgcgccgcccgtggcatcgagtgcaaggtcgaggctcagggtggcctgggtatcgagaatgagctcacgcaggaagacgtggactccgccgacctggtcctggagtccgtcgacgtgggtgtcgagaacgaggaccgttttgagcagaagatggccgagggcaagttcctcaaggtcggtacttccgatgtgatcgccgatccggtcaagatcatcgaccaggctgttgagattatcaaggcgacgggcggtaccgttgacgcgcccaaggccgaggccaaggcagagaagaaggccgtctccgctgccccgcaggccccgacaccggcgtccaagcagtctatctttgccgatccgggtaagacgctgctcaatgcattcaataccggcgtttcctattttatccccatcgtcgttatcggcggcgtgttcctcgccttctcgctggcatccggtaccgccggcgccaacggcatggaggttacgaacccgctgatggtgagtcttaacaccatcggcatggccggcatctccatgatgatcccggtgcttgcggcatacatcgcctactcgatggctggcaagcccgcgctcgcccccggttttgtcctgggctacctggtcaacaacgcagtcgttacccctaacggcaacagcgtttcgaccggcttcttgggcgccatgatcatggcggtcatctgcggctactttgtccgctggatgaagacctggaaggtcaacaacaccatccagaccatcatgcccatcctgatcatcccgattctgacctcgcttgtcctgggcatggcctatatctacatcctggccacgccgcttggctttgtgatggactggctcaccggcgtgctcggcagcctgcagggcggttccgcagttgtcctgggtctggtcattggcgttatgaccgccttcgatatgggcggccccatcaacaagaccgcttcgacctttaccatggccatcatggcctccggcatctatggccccaacggcatgttccgcgtcgccgtcgccattcccccgattgcctgcggccttgctgcgctcatcgccaagaacaagttcgatgacgccgatcgccagatgggtatctccgcactgttcatgggctgcatcggcattaccgagggcgctatccccttcgcggtcaaggaccttggccacaccctgcccggcatctgcatcggctctgccgtgggcgcggcgctcgccgccttccagggtatcgactgctacgtcccgcacggtggctttatcgtcgcccttgccaccaacaacgtcgcgctgttctgcctggacatcgtgattggcgccgtggtcgccgctgcaatcctgattgccatgaagcccacgctcgacaagcaggccaagtaaacctttaaggactccggttgtgcggagggatggatttgactccgcacaaccgcccctacacaacaaaatccatccgtactgatagggcccacatctgggtcccagggaacttttgtcaaaaatcctctggagaaggagaacaaaatgtccaacctcaccatccgccaggccgttcagggcatgctcaaactgcaggatagcggcgatcacgcaaccatggtcggcattggccccatgagccccaacctgattcaggccgtgttcgagcttgccaaggacgaggatttcccgcccatgtttatcgccagccgcaaccaggtcgatatggacgagatgggcgccggctacgtcaacggttgggaccagacgcgctttgccgccgacatcaagaaggtcgccgacgaggtgggttacaccggtccgtactacctgtgccgagatcacggcggtccgtggcagcgcgacgaggagcgtaacgctcacctgcccgaggacgaggccatggagctcgcccgcaagtccttcgtcgccgacatggaggcaggctttgacctgctgatggtcgaccccaccaaggatccctatcagatcggcaaggttattccgctcgacgtggtgcttcgccgcacgatcgatcttatcgactaccttgagcagtaccgtcgcgagcataacctgcccgaggtcgcctatgaggtcggtaccgaggagaccaatggcggcttgacctctaccgataagtacgaggagttcatttctcagctgcagcccgagctcgagaagcgcggctgccccatgcccacctttatcgtcggccagaccggcacccttacccgctggacggagcaggtcggtcactacaacttcaagaacgcccgcgagcttgccgatatggccaagcgctatggcgtgggcctgaaggagcacaacgccgactatctggacgacgcgacgctgctcgagcacatcccggcacacgtgaccgcctccaacgtcgctccgcagtatggcaccgaggagacccgcgcctacctcaagctctgcgccaccgagcagatcctggtcgacaacggtctgtgcgatgacccctctgacctgtatcacacgctgctggtcaaggctatcaagaccgagcgctggcgcaagtggatgactggcgacgacgtcaacctgcaggtcgatgacatccttgccgacgatgagctcagcctgaagatcctggatgtctccggccactatgcgttcaacgatcccgaggtcaaggagcaggtcgagaagctctatcgcaacctcgctgcccaagacatcgacggcaagcgctttgtgatcgagcacatcaagcgcccgatcaagcagtacgtcgtcggtcttaacctcaagggcgtcacgagccgcatcgaggccgctcttgccgagtaagtagcttttcctacgcgacgccgggcctggggcatgtcccagctgcaggcccggcacatgggacaaaggggcagtccctttgtcccattcttttgagttttagcttcctttgaaggggttcaccatgaagttctttatcgataccgccaatctggacgagattgccgaggccaagagctggggctgcctggccggtgttaccaccaacccgtccctgtacgccaagaccggcggcaagcttgccgactttgagccgcatatgctcaagattgccgagctctgcgagggcctgcccgtttccgccgagtctaccgctaccactgccgagggtatgatcgaggagggcaagcgccttgccgccctcgcccccaacatcgtggtcaagcttcccgtgtgcgaggccggccttgccgcctgccgtgcgctggccgatgctggcgtgcgcgtcaacatgacgctcgtcttctcgccgacgcaggcccttatggccgccaatgccggtgctcgctacatcagcccgtttgtggggcgcttcgatgacatcgccgaggacggtatctcgcagctcgacaatgttgtgacttgcatcaagaactatgactggaccggcaagaacgtcgacgacaccgttgagatcatcaccgcttcggtccgcacgcccaaccatgtgacccaggcggcgctgcttggtgccgacattgcgaccgtccccatggccgctcttaagaaatgcttgcatcacccgctgaccgaccagggccttgcctcttttgaggctgattggcagaaggtcgtcgctcaggcttaacgagtggattgccccggcatcgcgtcatccggtgccggggttgttctcaagagaggaattcgtatgaccaaccaggagctggcgaaggtcgccaatgaggtcaggaagggtgtcgtgactgcggttcacgcggccaagtcgggacatccgggtggatcgctcggtgctgccgacatcatgacgtatctgtactttgaggaaatgaatatcgatcctgctgaccctcacaaggccgatcgcgatcgctttgtgctctccaagggtcacgcggcgccgggcctgtattcggtgttggcaaatcgcggctattttcccgtcgaagagctcgagacgctccgccatattggcagccgactgcagggccatcccaacatgaacgacaccccgggcatcgatatgtccaccggatcgctcggtcagggtatctccgccgcggttggaatggcactcgccgcaaagcactggggtgacagctaccgcgtctacacgttgctgggcgacggcgagtgcgaggagggccaggtgtgggaggcggccatgtttgccggcaaccatgcgctcgacaatcttgttgccgtcgtcgaccacaacggcttgcagattgacggcacgatcgatgaggtcaactcggccatgccgctcgctgacaagttccgcgcctttaagtggcatgtgatcgagctagccgatggcaacgacatgacacagattgaggcggctttcgccgaggctcgtgaggtgaccggcgtgcccgtcgctatcatcgccgagacggtgaagggcaaaggcgtctcctttatggagaaccaggttggctggcatggcaaggcgcccaacgatgaacagtttgagcaggccatggccgagcttgcggcagcaggagaggagctctaatggcagaggtcaaaaaagtcgccacgcgcgtaagctacggcgaggcgctcgtcgagctgggcaatgagcacgatgactttgtagtgctcgatgccgacctggctgccgctacgcagacgggtaagtttaaggctgcgcaccctgagcgcttctacgatgccggcattgccgagagcaacttgatggggctcgccgccggcattgcgaccacgggccacgtcgcctttgcgagcacctttgccatgttcgccgccggccgcgcgtacgaacaagtgcgtaattccattggctatccgcacctcaacgtcaaaatcggtgccacgcatgcgggtatctcggtcggtgaagacggcgccacgcatcagtgctgcgaggacatcgcgctcatgcgcacgatcccgggtatgacggtaatcgttcccgccgatgacatcgaggctcgcgcttgcgtgcgcgccgcctatgagtttgagggaccggtctacatgcgcttcggacgcctggcaacgccggtcattaacgatcacgaggactatgagttcaagattggtcgcggcgtggtcgtgcgcgaggggtccgatgtgaccatcatcgcttgtggccttatggtcgccgaggcgcttgaggctgccgaggcgctcgctgccgatggtatcgatgccgaggtcatcaatatgcacacgatcaagccgcttgatgagcgcctggtggttgccagcgccaagaagaccggtcgtgtggtcactgccgaggagcattcgattatcggtggtcttggcgaggccgtggcctcggtgctcgcggagcagcatccggtgccgatgcgtcgcgtcggcgtgcgcgatgtgtatggcgagtccggccctgcggtcgatttgctgcacaagtacggtttggacgccgacggcatcgaagctgcggtcaggtccgtgttgtaaggaaggtttccatgggatttgtatctgccaaccaagtgacaatcgggtataccgccgcctcgcgcgaggacgccctacattatttgtccgagcaggccatcgagctcggctttgccgatgacgcatctgccgtagaggccgccttcattgctcgcgagaacgaggccgagaccggccttgtcgccggttttgccgttccgcatgccaaaagcgacgcgatccacacgccgggcgttgccgtgcttaaactgaccgagcccgttgaatggccgagcttcgatggggtgcccgtcgatgttgcgctcgcgctgtacgtgcctgccggcgaggctggaaccacgcatctgcgcctgctctccaaggctgccgtaatgctgatggacgccggcttccgcgacaaggtgcgcgcgagcaccgatcccgttgagattgcggagctcatcaatagcggactcgaagactagaacggttatcccgttcaatcaatcgatccttctccaaggaaaagggccgcgacgccatataggtgtcgcggccctgtttgcgtttccccagataaaacctgccaaaataaacctatccctttttggcaggctaatcgtgagttatttcaccgcaacttagggcacggttaggaagtgtgcaccttaaagagtggagcccttgattagagaggtcgcgctcatctctctaaatgtttctctaaagagaaggttggttagagagatagcattaggcaatctagcagcgaattcgatacatctctcttaatgtctctctaaaacaaggcgcttatctctctaaagttagagagataagcgccttgttttagagagacggaatgccaaaattcgtccgtcagctaccatctgccaaaaatgacggataaagggctcatcgaagtaatgggttcatcgacgagccgcaaccgccgctatcggaagaagtagatgcagccgaattgcccctctatcgtctctcgaagtttgatgggtgctagaggggcgactgcctcgcgatattttcccaagataaaacctgccaaaacaaacctgtcccttattgacaggtcagttaacgcagtccaggttgagcatatgtgcccggagcccgcgcagcgccgagcagttacgccgtttgtaaaacggcgtaatctaaaggttcatgttgccgtggatgtagggggtgacctcgggggagatatggtcgcagcccagctcgcgcagcgcggactcgataacggcgggcagcggggtcttgcccttgtcgtcgacggcggcaccgccgagggcggcaatcttggcgacatctgcgggtgcggcctcgatatgcatgcagccgccgaccaggcgtgcgcggacctgagccaagtcaagatcgtgcaggtaatcctcgcaggcgcggattaaatcgaccttctcgcgcgtaagctcctcgcccgtggggacgcgcgtggcaagacatgctcccgccggcaggttccaaacaggatagccccatgcgcgcagcagctcgcgctcttcgtccttggtaaagccgacctccatgagaggggagcgtacgccgagctcttctgccgcgcgcatgccagggcggtagtcaccgcgatcgcttgcattgctgccatcgatgacggtgggaaagccgagcgacttggcgtggttgacgatggcggtaaagccggcgtgcttgcagtggtagcagcgattagcatcgttgcaggctacttgggggagctgcagctgatccaccgaaagattgagcacggggagcttaaaatgcggcccctcattggcctgtccatcaacggactgctcaaacgaagtctgttcgggcgtgccgatgagcggcgtggtgagatggacgaggagggtattggtaggcatgatgcgggcacagaccgcggccaaaaagctgctgtcgacaccaccggaaaagccgatggcgacgcgtccgtatgccaaaagcagctgctcgagtgctgcgagtttgtcctgaagctcctctgtgggtgcggcggtgtctgaaagcatgaaagttccttacagtaattaaagctcggatgaaactataatcccaccgagctgcttgtcataagacttccagctatgtaacgaaagtgcaatatgctatatacgttatatacaagcttgtaaagtgcggtagagtggcagtaatgcaatccggcgagggggaccgatatgatcaaggctgttatttttgacatggatggaacgctggtcgataccgagcgtttggggattaaggcctggaaggtaggcgccgctgagctggggctcgcgattgatgaagcgctgatccatcagtttatcggccgcacgctgcccgatgttatggacatcctcgataagcattatggcagccacgaaaccaccgaggcgatctatcgtcgccacaaggagattcgcgacgagatggtcaagaccgaactggaacttaaggccggcgccgccgagtgcctagacgagctgctggctgcgggctatcacgttggtctagcgacgtcgtcgcgcctcgttacggccgagcgcaaccttaagatggttggcctctttgacaagtttgaaacggtaacgtgtggcgaggacgtcgtgcacggcaagcccgaccccgagatgtatctgctcgcctgcgagcgcgcgggctttgctcccgaggaatgtgccgtggtcgaggattcgcgcaacggttgcgtctcgggcattacggccggctgccatgtctttgccgtccccgatatcgtgccgctgccgcaggacgtggtggatggctgcgaggccgtgctcgatacgttgttcgacctggcggcggcggtcaaggccgtgcgctagacaattgcggcgttgaaacgagcaattgcttacgtttgcgcttaaacaaaaggggtccggcaatggtcgggccccttttgcttaagcggcgacttagcatactcgcgggcgtgctatagatacgcaccgaggttgatggccgtggcgtcggtctggctgcttgcctgggtgctggcgcgttccagtaggaacggacgtaccagttcttggcggttgatatcctcggcggcgactgcggtgacggtacgcgctgcggagccgacacggatatgcttgatctttgccggggccttgttctcgatttgctccatcagcagttggacacccttgcggccaatctcgtagcccgggggcgctaccgtagtgagcgggaccgatccgctccaagcgagcgggttgccgtcgcatccggccacgcgtacttgcccggggacagagatgcccttgtcgaccagtgccgaaacgacacccgaggccaacacatcggtcaggccgacgacaaaatcgggacgttcgtccgcggggcgctcggcgatttgggcaccgatgccgtagccgtcggcagcggtattccattcgccggcgtcgatgacttcgatcttgatatcggggtgcagggcgagcgccttatgaatgccaaggacgcgcagggtgagttgcataaatgctgctcggccgacgacgacaatatggtgcgcgccgcgggcgatagcaagttcggcaatgatgcgaccctgggcctcgttgtcggccgctacgtagtagccgggctcggagcaatggatgtccagatggacgatcggcacgggcatcttggtcatggcggggtgccagtcgggggatgccatgggctgaaccatgacgccggacatctgggtgcccataaagtagcgcaggtaatggtcctcgagaatatcgtcgttatcggcgttggcgatgagcaagtcgtagccgtgcttgcgggcctcgttgtgggcgccgctggcgatttggagcgaaaaaccgtgatcgagacgggggagcaccaggccaaaggacttggtagcgccgcccgcgagctgacgggcgctttggttgggcaggtagccaaggcgattgatggtctcgttgatgagcttgagggtctcggggtgcagcttttcggggtggttgagcgcgttggaaaccgtgcccaacgaaaccccggcctcgcgcgcgacgtcgctgatttttacctttgccatagcggcccctttgatgcgtttcaagtacaagccagattgtagcatcccaaaccttccaaaaagggacaggtttattttggcaggttttatctgggcaaacgctattgccagcgcgaccaccacgaagggggcaggcacctttgtggtggtttggaccggctggacgtgtgtgcatcgagtggtatctaagttgagataccacttctggtatatcagcttgcgtttgcgtgagtacaatactcgaacgttatacgtctcagcgccccttgtgcgtggacgtcttgcagtcacgcgaacgaagggatttatcttatgtgcggaatcgtcggctacaccggctctgatattgcaaagaacatcctggtcacgggcctcaagcgtatggagtatcgcggctatgactcctcgggtgtcgcgctcgaggtgggcgagggcgccgcggcgcacctcgatgtcatccgccgcgtgggcaaggtcgcgggcttggagagcgagctttccaacattgacagcgacgctacctgcggtatcggccacacccgttgggccacccacggcaagccctccgtcgttaacgctcacccccacaccagctgcgacggccgtatcgccatcgtccacaacggcatcatcgagaacttcgccgagctgcgcgaagagctggagggtcgcggccaccactttaagagcgagaccgataccgaggtcttcgcgcatctgatcgaagaggcttatgccgagacgcacgacctgatggcctccgtgcgcgaggcttgcacccacgtggtcggtgcctatggtctggccgccgtgtgcgctgacgagcccggcgtgatcgccgtggcccgcaaggattccccgatcgtggtcggcgcgggcgagaccggcgcctatgtcgcctccgacgtcatcgcgctcatcgacgccacccgcgatgtcgtggtgctcgaggacggtcagtttgccaagctcacgcccgcaggcgtcgagtacaccgacgaggccggcaacgttatcgagcccaaggtcacccacatcgattgggacctggacatggcagaaaagggcggttatcccgactttatgctcaaggagattcacgagcagccgcgcgtcgtgcgcgacacgctggttggtcgtatgacgccggccggcgagctcgacatcgacgagctgggcctttcgctcgaggagctcaacgacatcgaccgcgtctacgtgatcgcttgcggcaccagctatcacgctggcctcattgccaagaatctcattgagggctgggctcgcatccccaccgaggtggaggcggccagcgagttccgttatcgcaaccccatcattacgccgacgacgcttgtcgttgccgtgtcccagtcgggcgagacggccgatacccttgccgccattcgcgatgcgcgcatcaagggtgccaaggtcttcggcatcaccaacgtggtgggcagccccgtggcgcgtgagagcgacggcgtcatctacaccaaggccaacaaggagatcgcggtcgcctcgaccaagagcttcatcggccaggtcgtgagccttacgcttttggctctgctgctggcgcaggtcaagtaccgcttgaccaccaagcaggcgcgcatgctgttccgcgagctttccgatacggccgagcagatccagtggattttggatacccaaaccgaggccgtgcatgaggccgccctgctgtgcaaggacgcgcagtcggcgctgttcgtgggccgtggcatgggtgccgctatttcctacgagggcgcgctcaagctcaaagaggtcagctacctgcacgccgaggcctacgccgccggtgagatgaagcacggccccatcgcgctgatcgacccgggcttccctgtcatcgccgtggccaccaagagtgccatctacgacaagaccgtgtcgaacctcatggagtgcaaggcgcgcggcgccaaggtcatcgtcgttgccaccgagggcgacgaggagatcaacaagatcgccgactgcattatccgcgtgccagcagtccgcgacgtgttcagccccatcacggcgagcgtcccgctgcagctgctcgcccgcgaggtcgccatcctgcgcggctgcgacgtcgaccaaccccgaaacctggcgaaaagcgtcacggtcgagtagttggttccgccgttctagcgactaaggcccggctccgcatcaagacggagccgggccttgttgcatttgctcggataaaacctgccaaaataaacctgtccctatttggcaggttagcggagcttgctggtctcgaagtactcggggaactggtccagaacctcggtttgattgcggaacatcatgtgcaggtgcttgctgaccaaaaagctcgcttcgatggggtcgcgaccggcgatagcgcggcgaatctgcttgtgctcgttcacgatgtcctgattgtcgagaacctgcgtggcggcgcgcagccagcggaagcgctccaggtcggcattggtctcttcgagccacgaccacacggtgctgcgacatgcgatgctaaaaatcatgtgatgcatgaggttgtcgctcaaaaagaagccgatgcgatcctcctcggccatggccttttcctgcagcacgatggcgcggtcgagctgctcgatgccggccgacgtggcgcgcgcacagcactccacaatcacctgcttttccagatgctcgcggatgtaacaggcactctcggcaagggtgaggttgatgggcgagacgtaggtgccgctctggggcacggtgcgcaccaggccttcctgcgccaagcgaaccaaagcctcgcgcacgggcgtgcgacccatgtccaggtcatcgcaaagctgcttgacgcccagcttttcgcccggcttgtagtccaggtagacgattttgcgtcgaatggtgtggtaggactggtcctgtaggctcgtttcctgctcgccgacgtgcatcgattcttccatagcgcctcgcaactgttctatcaaactcatatgtcagttgttaattatgccgcgaatcagctctccgcggtgggtaattcggctgttgcctgagaactatcgcggcatcttagtctgtgtttgcgcaaggctgtgctcaatgttgccgtatcataagccgtcgcaaacgtgaaatagaaagaaggaatcccatatgcaactggcaaatatcgtacgcgagcgctggaaaggcgtcttgttctgcctgatcatcgccattcccgcgacgttgctcggcaaacaggttgaggtggtcggcggtccggtattcgccatcctctttggcatggtcctggcgctcgtctttcccaagaatcgtcgcgaacagctcgccgccggcgtcacctatacgtccaaaaaagtcttgcagtacgcggttatcctgcttggctttggcatgaacctctcccagattctgtccaagggcgcccagtcgctgccgattatcgtggcgacaatctcgacctcgcttgtcatcgcctttgtgctctgccgcgttatgaacgtgccgggtaagatcgcgacgcttgtgggtgtgggttcgtcgatttgtggcggttctgccatcgccgcgaccgcacccgtcatcgatgccgacgatcgcgagattgcccaggctatttcggtcatcttcctgtttaacgttatcgcggcgctcgtgtttccgacgctcggcggcatgctcgggctgaccaacgagggctttggcctgtttgccggtaccgccattaacgacacctcgtccgtaacggctgcggcgagcgcttgggacagcatgcatcccggcgccaatgtgctcgagagcgccgcggtggtcaagctcaccaggacgctggccattattcctatcacgctggtcctcgcatgctggcagatgcatctggcgcgcaaggccggcggcgacgccaagagcacgttctcgtttaagcgcgcatttcccatgttcgtgctgttctttgtgctggcgagcgtgatcaccacggtgtttcagcttcccgcgtcctttacggcgcccatcaaggagctgtcgaaattctttattgtgatggccatggcggctattggctttaataccgatatcgtcgagctggtcaaaaagggcggcaagcccatcgcattgggcttttgctgctggattggcattgcgtgcatgagtttgggaatgcaacacgtactgggaatctggtagagaagtagcttgtttgcgtgctggttgctggtgagcgcattctcacggtggagcgataggagctcttgcgggtatggcttgtccgcaggtttataagtcccgaagagctcttatcgccccgccaggatggcgatgcggggcaacacctatactcgcaggacggcgctttctgccctatagtgtttggtgagcaatatcgttcaattttgaaacactcggtcgtgcgaccgtcggcggctgcatgtcgccgcggacaggggcaaatcatggatagcgatgccaagctgaacatcttgaccgaggccctggctgctgccggggcctcggcattggcaatcgatgcgcgtggggacgtcgcgatctcgaccatgaatgacgcggcgctcgagcgggatgtggcggcttttgtcgctgagcgcctcgaccgtataggagacggcgcgcgtctggttatgggacgtgcgggtgcgcgcctgagcctgaccgttcgccccaccgacaaagagggcgggggcctttgggtcgtcgtggtccgcgaggtgcgcggtgccgcggcgcatgcgggtatcgagtggctcaacgccgacgaagttgaggctcgctacgaatcgagcgcgtacggcatcgttgagggggcggcctcggtggctgcgccggttgcagagagttacgcgcgcggtgtgccccttatgctcgagggcgagctgggagcgggtcaggtcgagatcgccaagcgcctctatctggacggtccttttgccggtcagccctttgtttccgtcgcgctcgatgaactcaccgatcgcggttggcgccatgtgctcaaaagcgccgaatcgccgctgttccaaacggggctgaccctttgcattgaggactggaatgcggttggtccccaacgccttcgcgagctcgtttccacgatggccgacaccgcgttggcgacgcgctgccatgtggtgctgacggcgaatgacatgccgggcggcagcgaaagtgatcaagccgcttttgtgaccgagcgcttcgcctgtgcggtgagcgtggcgccggcaatcgccgagcagggagccgcgtcgaagaaggttgcgcgctatttggaatatctcgctgacgcatttgggacgtcagcgcccacgctgtctgccgcggcggcgaagacgctcgatgcttaccgctggccgcgcaattatctgcagctccgcgaggtctcggaacgactgtatatattggtgggggcgggcacggtggaccgcactgtggcggaggaagtgctcgcccaagaggacgtgattaagaccgcaacctttggcgccccgacactcgaaagtgacctgtatatcctgcgaccgctggccgataccgagcgagatatcgcgcatttggttgtagatcatctccacggcaaccgaacccgtgcggcggaggtgctgggcataagccgtacaacgctgtggcgcttgctgaaggacgatgaccgttgagcgaggcgcccgtgaccgcacgcgacgcgtgtgctacagtccaaagcgttattgtttcgatttggttacggcgtgcgagggcatatggctgagacttcaaaaccgagccgcagaaggcggagtgccgcgccggtcaaccgacgcacaacatcggtgacgtggggcaaacacgcctcggggtttgatggctcgttcaagcgcactaaatacggctatccttcggcaagcgcccgcttggcaatgcaggcagagtcctcgctgtggggccgcaaacgcgtggtgggctcaaagctcaagcacgacggaacgctcggctacatcagccgcggggcggctcgccgcagcgggctcaatcccgccggctggcatcgctacgtgccgatcgtggccgccgttgcagtgatcgtcatcgcgctcgctgcgctcggatatgccggcggtggcgccaacttggacgcaatgtttaaatcgcccgagctcgcgcatgtaggtacagaagttgtcgagggcgctcaggcccagacgagcgtcgcgccccagcgcggtatcgttgcggcggcctccaccatcgccgatgtgcaaaaggacgaagacaagcaaggcgacgacgtcgatgcgaatcagacgagcgaaacggcaataactccatcggcgggataagttgcgagtggggcagctaatttgggacggggcttttttagctgcccaagacagtggctcattcgatgtcagtcgccaaaagcgagcgagccgcatttgcgccaaggtgacgtgaaatgagagggcgctgaccttctggtcgcgccctcgaaattgaacgtcagattggcgtgaatgcggcccgcgcagcgtcaacgagcccgccgttcggtagaatggcggaactaattaccttacgtagaccacgttgtcgcggcggggtttgggctcgggcagcgtgtcctcggcatagcccagaatgcagtgaccgacaccgcgcaggctgccgtcggcgggtagaccccaactggccagtagctccaggccctcgggcgaatcgaaaacctcgtgggcgcgatgaatccagcacgaatcaacgcccagcgcataggcagcgttgagcaggttgcccatggcgagcgagccgtcttccagatgtgtgggcacgctgcggtcaaccagcaccaccacaacggtcttggcgccatagaaggggtcgctgttgctgcccatgacttgcgcgttgagctgcgagagacgctcgacggtcgcggggtcggtgacggcgacaaacgtcaccggctggcggcccatgccgctcggtgcatattggccggcttcgataatacgtgcaagcttttcggcctcgacgggacgatcgctgtagttgcggcagctgcggcggtgaatgagtgcttcgatagtctccatggtgtctccttgcggtggcgttgcagatgccccgttcatacccgtcgggctcaaacgatagacggtcaattgcccggccaaaaggatagattccaattgggaaagtaggtttgcataaaagtaccttcataatgtgacaaacaaatgggatggttaaacgttttatcccgtctaccctgcggttttttaccacttgcctaaatgacgaacgcataacctctgataagggttttactaaaggagtaccaacgtttatcaatgcgccgtggtggcgccgggccaggaggtaacatcatgttccaggctggagatgtcgtcgagaccgatttcgaaggatttctgaagctgctgcgttccaagacgcgcgctttcgtgtcgatcaacgatcacgagtactacatcacgcacaccgatggctattggcgtgttcaggattgcgaggccctcaacgacaagggccactttactgactgttctgagttggtcaacacggtctgcgaggtcgtcgagctgccgtggattgccggcaagagcctgcatgacagcttctcgggcgctacggtctatgaggccgtcgccgcttaacaggcaataaaacccgattttcacgtgaccgctggcgccgcccccgcgccggcggtctttttctgccgataggccataaaaatgcacgcatttgcggagagcctgttgacgatagtcaaaactcggactaatctagagacacataattggtcaaaaatcggacaattgaatggtgggatagatgaatagtgcggttacgctggtcgacttcgatcggttgctcaatggactcgaccatatctattcggagttctcgcgcgcctgcggcctttcggactgcgcctactggatgctcgtcgacacgagtgcagcgggcggaagcgttgccgtgagtcggctgacgagtgaatggttctacagcaaacagaccatcaattcggcgattaaaacgcttagggcgcgagggcttgcgacgttggagtttgccgagggcagtcgtaaaaacaaggttgtacgactgaccgaagaaggcgtgcggtttgccaagcgctacgcgttgccggcgcaaaaagccgagcaacaggcattcgaggcgctcgagccgtgggaacagtgcgagatcatgcgcttggtcggtaagttctcccatgttcttaacgaagagtgcgaggcatttaaacggcaagtggccgccgagaacgagactgacgataagggcgagggggacgcatgcgactcttaatgaggtttatgaggccgtaccgcggtctgattgcggtgacgctgtttgcggtgctgatagataacgtcggtacgctgttggttcccacgatgctggcgaacatggtcaacaccggtattaccacgggtgatgtcgactatatattacgcaacggcctgtacatgcttatcgcgaccggcatggccagcggcggcacggtgctgggctgctatctttcggcgcgcctggccgccaacgtggcctgcgatatccgcaatgccgtgtacgacaagtcgctcgagctgtccgccagcgactttgagcgctttggcacgggttcgatgatcacgcgctcgctcaacgacatcaacgtgattcagcaagctgtccttcagacgattcagctggtgctgccggtgccgttcttggccgtggcaggcatcatttttgcttggttcatcgatcccgccatgggtacgctgctgggcgtggtggttgcgatcgtgctggtggcggcggtctttaccgttgccaacgccgcgccgatctttatgcgcctgcagagctttatcgaccgcatgaacgtggtgctgcgcgagaacatcgtgggcgtgcgcgtcatccgcgcatttaacaaggagcgccacgaggagcagcgcctggacgaggtgtttagcgattacgcggccaatgccatcaaggtcaaccacctgtttgtgggtctcgacagctccagcttctttttgatgaatatcgccgaggtggcggtgctgtgggtgggcggcaaccgcgtgggcgtccacgccatgcaaatcggtagcatctcggccgtgctggagtacgcgatcctgatcctgttctttgtgatgacggcgcagatggtgattctgacgctcccacgcgccgccgcatgcctgaaccgtgcgcagcaggtgttggagattgagccgagcatcgtggacggcaagcgcacgctggacacgtgcgcggcggagtctgttgacggtgccgacgcggtggccgtgttcgaccacatgtcgttccgttttgacgatgccgacgaggataccctgtgcgacctgagctttgcctgtcgccgtagccagaccacggcgattgtaggctcgacgggttcgggcaagtcgacggtggccaagctcttgcttcgcttccacgatgccacgaagggcgccattcgcctgaatggcatcgatctgcgcgacctttcgcaagacgacatccgcgggcgtatcgcctatgtgccgcagaaggcatggctgttctcgggtacggtggcgagcaacctgcgctttggcaacgaagacgcgactgaggctgacatgctccatgcgctggaggttgcccagagcacctttgtgctcgaccagccccaggggctcgatacgccggtggcccagggcggcacgaacttctcgggtggtcagcgccagcgcctggcgattgcccgcgcactcatgaagcatgccgatctatatatcttcgacgacagtttttcggccctggactttaagaccgatgcggcactgcgccatgcgctgcaggacgagacgtgcgatgccgcggtgctcatcatcgcccagcgcatctcgactattttgcatgccgatcagatcgtggtgctcaaagacggcgagatcgtgggcctaggcacgcacgacgagctcatggaaacctgcgaggtgtaccgcgcaatcgcggaatcgcagatgaagggaggtgagtagcatgaccgaggagctcaagaagcagggcatcgtcgatggcgctgcggttgtagagacagtcgaggagacgggcgtcgcgcccgacctggacgaagccgccaaggcggcggagcgcgaggctcgccgccaagcgctctacgaggaaaacgaacgtgccgaggacgagcgcgcccgcgccgaggcagagcgtatgcgcgacgtggacgacgaagacgaggacgagacgcctcgggatacctgggcgacggtgcgccgcctgtggagtgaggctgccggcgaccattggcgcttctatatcgtgttcgcgagcattgtgttctatgtcatctttaacaccgccgcgccggcatatagcgcccgcgtgatcgatgagctgtggggccacattcaggtggcgtttgccaacgacaccactttcagcatcacctgggagaactgcggcaagaccattttcgtctactttatgatctggactgccgctgcctcgttctatgcgctccagagctttttgatgtcgagcgtcgctgagcgtctcaatctgcgcctgcgcaaccgcatcgcgcaaaagctcaaccgtctgccgctcgcctattttgacgcgcatcgtcccggcgaggtcgtcagccgcgcgaccaacgacctggacaagatgtccgagagcatgcagcgcggattgctgcagctgctcgtgtcgatcggcacggttgttggtgctgtgagcgtgatgttcgtgttcagcgtgcagcttacgctcgtctttctgttctttacggcactgtcgctgctggtgacgaaggtcgtctcgcgccgcacacacgatgtgacgggcgagcgccaggagtgggtgtccaagattacgagtgcggtcgaggaaggctattcgggccgtctggtgatccgcgcgtttaaccgcgaacgccaaagttctgccgaggtgcaccaggcctcgggcgagctggcacgcgtgagtgccaaggccgactttatgatcaatgccgtcggccctgcggtgcgctttatcggccgtttggcgcagatcgtgatcgcgctggtgggctgcagcatgctggttgccggtcacatgaccgtcggcgtgttccaggcgttcttccagtttatctacgaggcgtccgaacccatgacgcagctgtcgtttaccttcaactcgctgcagagcgcgttggcgagtgcggagcgcgtgttcgacctgctcgatgagcccgagatggaggccgatccgctgccggacgaggccgccaagctgccgggtcgcgttgagggtcgcgtctcctttgagcacgtgcgctttggttattcgcccgacaagccgcttatgcacgacgtgtcgtttaccgccgagccgggccagaagattgccgtggtgggaaccacgggcgcgggcaagacgacgctcatcaacctgctcatgcgcttctacgagattgacggcgggcgtattacgctcgacggcgtggatacgagccgcatggaccgcggcgagctacggcagcagtttggcatggtgctgcaggacgcctggctgttcgatggcacgattgccgaaaacatcgcctacggctgtcccgaggcgacgcgtgaggagatcgtggcggctgcgcgcgccgcgcaggtcgacttctttgtgcgcaccatgccgcagggctatgacacgcgcgtggccaacgatgccgaaagcatcagccagggccagcgtcagctgctgaccatcgcacgcgtgctgctcaataacccggcgattctcatcctggacgaggcgacctcaagcgtggatacgcgtaccgagcttgccatcggtcgtgccatggacgcgctcatgcgcgggcgcacgagctttgtgatcgcgcaccgcctgtcgacgatcgtggacgccgacctgatcttggtcatggatcacggcaacattatcgagcagggcacgcataaggagctgctggctgccgagggtgcctacgccgacctctatctgagccagttcgcataatgtgacaaagggacagtctctttgccacatcacaaataaggcgcgccggggatgaattctgaactgcctcccatttcttggacacgagaaatgggaggctttttatgcgtgtcgcgtagcgggtggtttaaagctggccgctgcgcggccagcggactaaagtcttgaacaacacccgccaccggcacgcccggtggcgggttcttttttgcttcgcgcgtataggagaagaacatcatggaaagccgcaagccgtatctcgccaccctgcccggactcatcctgggctgcctcgtttgctgcacgctctgggggtcggctttcccctgcatcaaaatcggctacggcctctttggcatcccggcgcacgacagcgcctcgcagctgctcttcgccggtctgcgcttcacccttgccggcatgctggtcattgttggcatgagcgtggcccagcgccgtccgctcgttccgcaagcgcgtgatatcaagcccatatgtatcctgtcgctcttccagactatcgggcagtacttctttttctacctgggactctcgcgcgccagtgccatgtcgagttccatcatcgaggccagcgccaacttcctagccatcctctttgccgctctggcgtttcgcaccgagaagctcaatacggccaaggtgctcggctgcgtactgggctttgccggcgtcgcgctcgtcaacctttcgggcgcggacggcacctttggctttacgctcgacggcgagggttttatcctggcctccaccgtcgcgggtgccctttcgacctgcctgatcggcatcttctcgcgcgagcacgacggcgtcttgcttgccgggtggcagttcttggtcggcggcctggccctcaccgccatcggctttttgatgggtggcgcgctctcccccacggcgattgcccccgccatcacgctcatcatctacatggcgcttatctccgcggtcgcctactcgctgtggtcgcgcctgcttgccgtcaaccccgtcagccgcgtctcggtctttgggtttatgaaccccgtctttggtgtgctgctgagcgcgctactgctcggcgagggtgctggcacgagccccgttaccgtcatcgttgccctgctattggtctgcggcggcatcatcatcgtcaacaaacccaaaaaagcctagcgagctacccttatttagcagagaggattcacatactttagcttaatggagtacatcagtgagctgagggccgccacgcacgcaagcgtgcaccccttttcctagcgtatctggacgccggctttctttttctcggccttgacgcggtagagctccgcatcggcagcgcgaagtaagtcttgccaggtatcaacactatcgccgacccgcgcgtaaccgatggacatccgcaatgcatacggcacctcggcacgagcgagctcgtcgttaatcgccgaacacaggtctatgatgtcctgttccgccgcagccttctggagcaccacgaactcatcgccgccataacgtgcgataaaaccaccagacgccgagcagacctctttgagcgtagcagatatgacctggagagcatggtcgccctccacatgtccatagcgatcgttaatcagcttaaagccgtcggcgtccatcataagcagatacacatcatcggcctgatcagcacccgagaacagcgacagcatataggtctcaaaacggttgcgattgttaaggccagtcaacgggtcggtcgagatcagctgctcctgacagatgatatagagcagcaacatgctaatcattatgccgacacaaaggccaggcaccgagtatacgatctgaaaggtaccgcccaccagagcgggaaccgcaaaaaaggcgagggtgcgataaatggccttcttttgcaggctttcgacttttcgagcctgaataaaggcatgcaaggacgtatatatgacgtagcagtagctaacgataggctgaatcatataaagcgctccgcgacgatatacgccccgcgcatcgatatagaacatagcgtgcgtccagtagctggtaaatgccagaacgaccaccaatgcggttggcaacgttaaaagtaccaccctatagggcgtggtcaggagccgtgagccctgcatcgtctcggaatagaaaaaccaaatgaggcacgcgatggcgaacagcgaaaacgaaaccgcgttggaaatccagttggccgtgatgcctacaggagtgctcacgccgtccgagagcgtccagatcatatcgaagaaaatgtaggcagcagacgtgtagcccagcatgctaaacaaaagctgctgggtgctcgagaacagggagcgacggcttcgtacggcaagtccgataagaataatcatgcacagcaggaatatctcgatcttgagtgcctttaccactagacgccctcccttcaatatccaagtggccagaatcgcccaattcgaatctgggcaacaaacaccccctactccgcaggagtaaggggaataatagcagagcgaccgaacgtcactgcaagacagctctcgttcgggcgctcaaacggcgcgagttgcacgccggaatcattgatgggtatcgattgctactcgccatcgatgtcggtcgcgacagcctcttcgatggcctcgacaccggcaggcgacaggtcttccttgctctggcagaacttcttatcgacccagccggtcagaatcggggccatgattgccgtgatgatgacggcagtggcgatctgcgcatacgcggtgggcgcaagctcggcatagcgcggagcgacctcggcgagggcgaccggcgtggtcatggccgtgccggcaatggtggaacatgccacagccgccttaccattgccgccacacaggcgctcgaaggcaaaggtaatgggaccgacgataaagagcgtgatgaggcccagcaggatgcccgaaatgccaccggcgatgaagctcgaaaggctcatggacgcaccgagctgaaaaccaattacagcgatcgcgggattggcgccgggaaccagcaggttcttgataaacgggaacaagttgcccaggaccatgccgataacaagcggcaggatggatccgatgatggtgccgacggggatgttggcgagacccgaaacaccaaggatgatcatcgtgacggcggggccggccgtaaagaacaggataccgacagcgccctgctcggactcatcgccgaactcgcccatgatgcccgtatagagcgccatgttgcaaaacgtaatgccgccgatgatggaaaccgagctcaggcctaaaaagttatcgttaaagaagtacgcgacgcccagacccagcgcggctgccactacaagcttaggaatcagcacgacgatgccggtcttgatggcgcccggcgtggacttaaagctgatgccggcgcccacgaacagcaagatcgcggcaacgatggtgttggagccgccgcggcaggcagccgtaaagaagccgccgacctcaaagacctgcgggcagaaggtattgagcaaaaggccgacgatcatcggatagatcatgatgtcgcccgggatgcgcggtaccttgaatttcttttgctcgctggcggtcgcttcctgtgccatgaaacccccatttccgctgacgcagaacaaaagcccacgtcacgctttgctacagtaaagtttgaccatggtaccagaagaagcagaccgcctcggtgagaaattcgattcgttaggccgggacgataacgcgtcctgctcctatacgaggctcaaaacgatatagaacacgatgcccgaaacgcagcaccacaacatcgactttgtcttgattgccaccgccacgacgccggtggccgcaatccagggaaccaaggcaggccagagtcccgcgtcgaacgcgccggggttcaccaagtcgttggcgaccagcgcggcaaaggcagcgggcgggatatagcccagggcctcggtaatgcggggcgacagggtccgcccgcgcaaggcgaacgccggcgcgatgcgaaagaacgcgatagcagcccacgacgacagccacagaaccaagaactcgttagcgggcatcgcgggcacctcttccgtcaaatacagcatcgcacgccagcgcaatggcaatgccgaccacgacgcttgccggcacggcaatattcgcgaggcccaagaacttgcatacggcgacggacaccgcgcccgaaaccgccgcgacaacgttaccgcgcgacagccgctgcgaaaagagcaggcagataaagagcgaggtgcagacaaaggctgcaatggcggtgggaacatcgacaacggcgccgacgatggcgcccatcgtacacgaaacgccccatgttgcgatgaggattacgttgagcacaaaggactcgcgcgggccccaatcctccccttcaaccaacttggcaagcgagatgccatatgcctcctcggtaagtgtcgcggcaacagccagcgtctgacgcttcgaggcacccctcagatgcggtgcgatcgatgccgagtaaagcgcaaagcgcgaggagattgcggcgacgctcgcgacgatcgatgctgcaggcacacccgccagccacaggttgcagatcataaactggccgctgcccgtcacaaacgtactgcttagagcaaagaccatccagggctccattcccgtctgccccatgatcattccgcacggcgcgcctattgcaacataggtaagcatcactggccagacggttctaacgattttgagcaccatacgtttctcatcctgacaaggtctccgagccgcatgtagcgacacggcagaatcatcatccggcagcaaccgagttcacctacaattgccaccggatcgaaagacacaactttttaggaagtcattatgacagctatcgatcgagaccgggcgcgcgcggccttcaaaagctacaccgatgcctacgacgccaccaacccacgcatcgcgctcaaaatcgagcatacgtaccacgtggccgaggcatgcgatgccgtagcgcgcgagcagggctggtcgtcagaagatattgacctggcatggctttgcggcctgctacacgatatgggccgctttgagcagctgcgacgctgggacacctttaaggacgccgagagcatgagccatgcggcgctgggcatcgaggtcctctttggcgagaatcccgccgatgcacccgccgtaacgagcatccgcgactttatcgatgacccggcagaagatgagctcatccgagcgagcattgcctatcacagcgatttccgtctacccgcgcagctcgacgagcgcacgcggagcttctgcgatatcgtgcgcgatggcgacaagatcgacattatgcgcaccatcgccgacagcactgtcgacactatcctcaaggtggacgagaagacgtttctcggcagccgtttctcgtcgccgacacttgccgcctttgacgagcaccgctgcgtcgcacgcgatgagcgcgatgagcccgccgacttcttggtggggcttatctgctttatgtttgagctcgtctatccagcaagccgcgcgctggcgcgcgaacagggcgatatccaccgcctgctcgacgcgccctttggcattacgcggccctttaccgaccccgccacgcaggcaacttggagccgcctaaaggacgagatgcgcgactggctggcgcgcgcctagcgctcaagctgggccagcagctcctcgacgacctcgacggcgtccccaacaaccttgtactgggcagcaccgaaaatgggggcatccgggtcctcgttgatggcgatgatgcactccgccccaccgatgccggcaagatgttggatggcgcccgaaacaccgatactcacgagaagcctgggcgaaaccgatacgcccgtctggccaatctggtggcgatactccagccaacccgcctccacgacgggacgcgtgcaaccaagctcggcacccagagcctcggcgagccttcgcatcaacggcaggtttttcttggaaccaatgccgcgacccaccacgaccaggcgctcggcattggcgatcgagggctgctgtccccactcctcggcgggaatcgagatttcgacgcgggccttaacgtcttctgcaagcgccacctgggtgatcgtgccggagcggccgtagtcgaagtcgggcgccttaaagatgccgggacgcactgttgccatctggggacggtgatgggggcagacgatggtggccatcaggttgccgccaaacgccgggcgcgtctgctgcaacagacccgtctccgtatccatcgaaagcacggtgcaatcagccgtaaggcccgtctgcaagcggacggcaacgccgggcgccagctcgcgaccaaaggcggtcgcgccgtagaggatggcctcgggcttgcgctcggctaccagatcgcagatcagacgagcatagacttccgcgtcgttttgacgcagacgctcgtcgcgacaggccagcacttcgtcggcgccggcgcaaaccaaatgctcaagctcctcgagtgaactctcggggctcacgccgactagtgccaccaaacggcagccgcgggcatcggcaagctcgcggcccttgcccatgagctcataggccacaggggctacagtgtcatgctcgtcagtctgaacgaatacccaaatatctcgatacgcgtcgaggtccaccgtgccgacggcttcatcgcgctcgatcgagatggcgttaacgggacaggcgtcgacgcagccgccgcacaggatgcagccgtcggttacgcgggcgcagcggtttggccgctcaccctccaccacaataccgcccgaggcgcaggcacgaacgcagcgaccgcagccgatgcaggcttcgctatcgataatcagtccgctcatctatgccatcccctcgataatcttggcaagctttgccgcctgctcggtcggtgtgccctcaacggcttcgcacgtttgatcgcggtcgggcacaaacgagcgcacgacctgcgtcggcgagccagcaaggccgcaacgcgcggggtcggcatgcacgtcggcagcgctgaccacgcacacgtccgcctcctctgccgcacgaataccggcaatgctcggcatgcgcagctggccaatctctttggcagttgtcatcgcgcagggcatctccagatacacggtctcctcgccggcatcgcatccgtgaacgagcgccagcgaaccgcacgtcgtaaagcccgcgctctgcacgcagctcacatcggtcacgcagggaatctcgaaggcgccggcaagctcgggaccaatctgggccgtatcgccgtccaccgccatcttgccgcagataagcaggtcgaagtcctcgtcgaacgcctcgataccgcatttgagggcatacgtggtcgccaaggtatcggcacctgcaaaggcgcgatcggttagcagcagcgcgtcgtcggcgccacgggcgatgcagtcgcgcagcagcgcttcggtcgcgggaatacccatcgacaccaccgtcacgcgcacatccatgccaaagccgataaagtcgtccttgagcgccagcgcgcactccagggcactcgcatcaaagggattgatgaccgcctgcttgccgtcgcgcacaatggtattggtcttggggtccatcttgacctcggtgcttcccggcaccgccttgacgcacaccaccatatggaaatcgctcatcttcacgcgccccctttctggacgagttcatccaagagcttctccgaaaacaggttgccgcgacccagctgtccggcaggatcgagctggagcttgagccgcgccgattcgaccatggcctcgtggccgtacatcgtctcgagaaagcccgccttgatcttgccgacgccgtgctcggcggagacggcgccacccatagccgtaacttcggaggcccactgggcaaacaactcgccgccgcggcggtaatcctgcgcatcgcgcggcaggatgttcacatgcaggtggttgttgccgatatggccccacgcggcggactcaagaccgctttcggccaacgtgcggcgatagagggcaatcacatcggccaggcgcgcgttgggcaccgacatgtccgagcccagcttggtgatggtggggtcggtgcgacgacgctcgtcgataagcatgttgacgctctcgggcaccgcatggcggaagaatcgctggcattcgcgatcgacctcggtacgcgcgacccacgtcgcatcatcgctgccgcccgcaagctccaatacccaccccaggtgatacagttcttcagtcgcctgggcttcatcatcgcagtcgagctccacgtagacgcagaccttggcctctttgtcgagcgccggcagcgaagaaaacgccgtcgactgctcgcgctggcggcgtaggatatccagggcgcccgcatcgaaatactcgatggcggccgcgtgggacaggacggggcgcacggaatcggtgaaggacacggccttgtcttcgctatcgaaaaagcagctcacaccccaaacgaccgccggtgccggctgcagggcaatctcgagctccgtaatgacgccgagcgtgccgcaggcgccgataaagaggtcgatggcatccatgtcgtccgcaacaaaatagcccgaagcatttttggtcttgggcatggtgtaggcgggaagatcaagctcgagcgtgcggccctgcaccgtgacgagcgaaaggcgacgaccctgcgcaaaaacctcgccgcgctgaagttcgaccaggtcgccatcggtcagcgcgacatgaagacccgtgatgtgggggcgcatgggaccgtaagcgtagctacgtgcgccagaggcgttgcatgccgccataccgcccaagcaggcagatgcctcggtgggatcggtgggaaagaactgctcgggggcatcctgaaactcctcgtaagccttaagcgatgcctggtcccagcctgcggtcggaagcacctttttgcccagttgcttgcgcaactcggacagcacgacacccggctctacgcgaagcagaaagcgaccctgttcatcgcggcgaaggcctaggtagcgattcgtacgggaagtgttgagaatgtggccgccatggggcacggcgccggcggcaagaccggtccgggcgccctgaaccgttaccgagacgcgctcggcatggagctgccgcaagatggcgcgaacctcgtcttccgatgttggaaacgaaatgctcgaggcctcgcccgacgagcgagactcgtcgcgaccgtattcctcgaactcatcagtgaagggtttgatagttgcagacatgcagaactcccctttagctaactacagtgtttgcagggagatgttaccgcatcgtttcgttgacgtgttcgagaccgtctccataattgaggatttttacgttcgtgcaattcggcgagcggccgccacatctcggcaggcgatgttttttacacatatcgctttgccgccaacgatcgcgaaattggcgctcaaaaaatgttgaagtatttttaccacctgttacctgcgacgatgcgaatccgtcaagtatttggtcagcttttggtcaagtagtggctgatacggtcggcatcgacagccaaaaccgatagaagttttggtcccagaagcagggaggttcctatggcatattactggccccagtacggtgtcgccatcgaagtcgacgacgatccccatctcctgcctttcgaagaagaggcattccccgacacgacggtctaccacgtcactaccgatgtgatctgcgaccctgagtcgttctcggcactcgcccaccacatcgcatgcatccacgacatcgagctccctcccgacttcgatgagcttgtctactcgcgccgtctgatgcttcacatgctctttggagcggacccgtccacgttcgcacgcgtctacaccaccaaggacgccgcatgagcgcgaagaagttgccccggctcgcgagtccgggacatcgcaagaaactcatcgctgtctgcttggctatcgtctgcgccctcgtcgccgtaggcttgtacgcctggcagacacagcccgtacccgaagcgggcgcctcggtcacgacggccgagggcaaatcgcgccaagaaatccaagacgagctcgacgccatcgtccgcgacaacatgatgacgatctcggtcgcgccggtcgcccagctgcaggaaggcggcaagttgcgcgtcaacgtgcaaaacgtccaggacaacaagtttccccagcgattccgcgtcattcaaaacgacgagaccatctatgagtccggcatcgtcgaaaccggcaagacggttgagacgtgtcccgccggcgatatcgaggaaggcgaagcgtatatcgaaatccaggcactcgacaccaagacccatgacaaccacggcaatccgacgcgcgtcaaggtccgggtggaacaggccgagagctagcccctaacgcccgctgtgtcattgcgcgcagtcaccaacactcgtccaatcatcgcggggacggcccgcggcgaatagaaaggaacgaccatggacatcaccaggaacatgaacggagccagagcgctcgtcgtgggcgcagggctcgcgctcgcgctcgcaatgggcgccgccccgacgccagctatggcagccgggcgtgttggaagcacgaaggtaatggtcaagaccgagatcgacaacgttaatttcaaagttccgacggttattccgttcatcgccaaggccgacggcacgcttcagggcccctcagaagatgcaaccaccatcgacaacctttcggcctacggcatccatgtcaccaacatgaagatcgatgccatgaacacctggaccattgccgccgacgcgaagaccggaaccgctcagaactccatcgactttaaggtcggtcccgaaggcgcgctccaagacgccagtgccgcaatgcagggaacgggaatcgatctttccaaaaacgcaacctttgatatgggctatcagggtattgccggcggttcggacaagatcaagctcaagacgagcggaaatgtcgcccgcgtcacgcgcgacatcttccacgtaaccggcgaaggcgatcaagttgcaacaatcacctggacggtcgagcccggtgcgcacacggcataaggtgatcgccctggccgccgccgtcagcatcctagcgtttgggccagccatggcctttgcccagcaagaacaggctcaggccgccacgcaagtgacggtcgacctctcggggctcgaccgcggcaaccaccaggaaccgttggcgcagacaggcgacgaaaagcagctcttggcagcaagcgtcgctgcggcgggcgcgggagccaccggcctcggactgtgcatcaaacgcaaccagcaataagacacaaccagctcgcacaatataaagcaaggagaccccatggcatcgaagaaccttttgcccgtcgtcgcgctctgcggcgcactcgcaaccggaacgcctatcgccgcttgggcgacccccgtcatggcggactccttgccggcagccctaagccccgcaccagacccgtcgagcgtcattgcgtgcaagcggttttcgctcacacaggcaacagtctcgacctcgggatgccttcgtcaggacacggacagctcgatagtcgtggatatcaagcgttcggacaagacggacggctcccaggcaggatgcgccatctgcacgtggcgctcagttgcgctcgatgcagatgacgacccttgcgatttggagctacgcatcgacatcgcttcggtcgatgactcggcgaacgaagcgaaggtcgccttcgacagcgcgtttttcgaagaagaaggaggtgtatgcctgggctgcgttgtctcgcacgccgacggcgcgcagcccacgctctcattcacggcatcgttgcggataaccaaagccagcaccgacgccgtcgcaacgggagagacccccctgttgttctacgccgacaatgccgaaggcgccaaaatcaaagacgataagcaaaacgggtcgctcagccttactcgaggggcgaaactctgccctatcgagatcgatgtccaaacgcaagacaggcagcacgtacttgccgacccggcgctcctcgaaatggaatggaatggagctggagccatcggggtcgccccctttgtattgaacgaaatggccttcccatcaaaagatggcaccacgaacgcagccataacagaggagaaagcagacagcgcgccactgccgacaaacggcatctccgccccttcagaggaaccggatgaagctgttatcgagccaaacgatccccaactcgaggacagcctaggccttgcgacgtcccaagatgtcgatgagggcaactgctgcatgctcaccgcactcgaccacacgacgaccgtcgatgcagcaagcatcgaagttgccgcggccaatcaacctgttcgcaaatctgccatcattgcatttccggagtccgtcgaggtcgtctttttgccatcgggtgaaatcgtggcaccaacattgctcaccttgttaggcgccaagaatactcggaacgaaatcaaaaagatcacgatcgtcgaccctgcgaccactgccaagctgcgcctatacgccgttgccccagatggaagcaaaaccttggaattcgatggcgacacgctccaagcttggcggcgtctggacattatggaagacgtctcgtaccagattgaacttgaagggtttgaccgcgcccgagatgccgatatcatcgccgcgggcatcgagtccccgcaacggctgatgacgctacgctttgaatactatccctacgttccgacgacaacctagggctttcccgctgaacgccagacttaataccactcatataacgtattagacaagtcgcgatatgccctgcgttccattctgctacgattgccaaggtggcatcaatacgggagggctcatgccgggcttgggaacaatcatcaacgttgtgcttttgattgcgggcggtcttttgggattagcgggcggccgttttatcacgccccgtatccaagatacccttatgaaggcgtcggggctgtgcgtcctgtttatcggcttgggcggcaccatgcaaaagatgctcgtcatcgatgggaaagccctggcgaccaccggcaccaccatgctgatcgtctcatttgcgctcggctcgcttatcggcgaggccatcaacctggaggccgccatcgaagacctcggcgaatggctcaagcgcaagactggcagcgagggcgataacgagtttaccaacgcttttgtctcggcttcactcaccgtgtgtatcggcgccatggccattgtggggtcaatccaggacggcctgctcggcgactggtccacactcgccctgaagggtgcactggactgcatcattgtctgcaccatgacggcctcgctcggccgcggctgcatcttctcggccctgcccgtcgccgtgttccaggggacgatcacgctgtttgcgggcgcgctctcccccatcatgaccacggcggccctcgacagcctctcactcgtgggatccatgctcatcttctgcgtcggcgtcaaccttatccgacctcagaccttccgcacggccaacatgctgcccgccgtcgtcatagccgtcatctacgccctcctgttctaaatctatctacgttgcggcatttcgaacatctgtttgatgctgtgctatgatatgaggtcaccgacaccgtatagggagaggagagggcggtggccgaccaggacgtcaagatgctcatcgagcgcattatggccgaggctcggacccatcagtccgcccgcttctcaaataaaatctatgctgacgagccgattctcaagaccggccgacagatgcagaacttcctccccgaccagtaccgcaagatgcgcgagatatcgcgctggcaggatgatcccaagggcggcgcggggcgttggctatcagaggcggagcttttttaccgtcagggcttactgatggccgacttcgaagacgattgtccctacaacggcacgtttaagtcgtactttcccacctacaacgccatgagcgatcgacaactgcgcggctactttacctggcgcgcccaggtgcgccgcaaaaaagtggaagagacgtccacgtccttcgcctttttatatctctacgagctcatctgcggcatcggtgtagacaatccgctcgacggcttccgcaaaatcaaagccttttgggaatcataccgagcttatgagcccggcatcgaccggttcgcgcgcgtatggctgcaggactacgccgtattccacgggctcgatcccaaactgctcagcgattccaaaacggtcttatttgataaggcgctcattgagctgcgccgtgcggcacgcgatatcgagcccttgcctacacccgctacaccagcaaccaaacgccgcaaatcctccgagccgaccctccccctgccgcccgatgaggcgcgcgaggagcgactgatggctgcgatcaatgcgctgtcgacctacaacctgggcaactcaaggatcaaccatgcgcaccatcgcgacctgcgacacgtggcttgcgccgtctatgtccgcatggcccgctactatgacacgcaccgaaagagtggcattgtggcgagcctgtttggggaggagacggccatgccttataccatgtttgcctcggccgtcttctttgcccccgagcgccacaaggactgcgaatatcgtctggaccccatccatatctaccgttgccaaaacggcttttgggaatgcatgcgcatccacggcagcagacaaaagagcagcaagctcggcgagatgatgcgtgcctgcgatcagcgcttgcgcttggcgttggatcccgctcatccccttaaggaagaaaaggttcccaaatatctggccaagatcatcgacgatgagattgtggcctggctttcgtgggacgctgcacaccagcccgtcaagatcgatatcgacctgagccagctggggcatatccgaaacgccgcagcacagacgcgcgaggcgcttttgatcgacgaggagcgcgaggacgatgcgcttacggaagccgcggaagcagattctgggcaaccggaagccgaacccgcggcaaacatgattgccgaaccggccgcagcgtccacgcagcagaatgaggctgacgagccgaccatctccaccgagcagtttggtgtcgtggccccgctcctcgcgcccgagcccacacccgcaacgcccatgtccgccggcaccgcatccgcactcgcccacgccgcagaagactatcttcgtgcgttgctcgagcagaacgcggcgcaggcagcatcggctgtggagaggtcgggccagagcgaagacatgcttgtcgacaacatcaacgaagcgctctttgacctcgtgggcgacaccgttattgaattcggcgcggcgggaccgcagataatcgaggactacgaagcagacgtgagaggatatctagaccatgagtgataccacatccacagcaccccgtgtgcccaagcgcgtcgccgccgtcattctcaactcgctcaagggcggcgtcgtcccgcgcatcggccttccctacatcaccgtgggacgcgaggtcgagatccgcgccctgctcaccgacctgagcctcatagccgatggcggcgcaagcttccgctttttggtcggtcgctacggcgccggcaagagctttttgctccaaaccatccgtacgcacgccatgggtgagggcttcgtcgtcgccgatgccgacctttcgcccgagcgtcgcctgcagggcggtcaggggcagggtctggccacctatcgcgagctcatccgcaatatatcgaccaagacgcgccccgagggcggcgcgctcaaccttatcctggatcgctgggtcgcctcgtgcgccaataccgacgagtcagccgttaatgcccagcttgccccgctcgaggagatggtccacggttttgactttgtccgcatgcttcgtcgctatcgcacggccgtctctgagggcgacgaagagagcatgagccgcgtgaccaaatggattcgcggcgagtaccgcaccaagagcgaggcacgcgccgagctgggctcctcgaccatcatcagcgacgacgactggtacgactacatcaagctcatcgcgcgctttttggtctgcagcggctataagggcatgctggtgctcatcgacgaactcgtaaacctgtacaagatccccaacgccatcacgcgccagtacaactacgagaagatcctgaccatgtacaacgacacactgcaaggcaaggcacagtacctgggcatgatcatgggcggcacgccaacctccatcgaagaccgtcgacgcggcgtattttcctacgaggctctgcgcagccgcctcgcccagggccgttttgcacgcgaggacctcaaagacatgctcgcacccatcattcgcctgcagccgctcacctatgaggagctgctggtgctcatcgaaaagctcatgcagatccatgccggctactttggctggacgcctacgcttaccgagaacgacctggtggacttcctcaagattgagtttggccgcgtgggagccgacacgcacctgacgccccgtgaggtcatccgcgactttatcgagttgctcgatatcctgtgccaaaaccccgatgccgacgtggccgagctgctgcaaagcgtcggcggcgacacactggcaccggccaacgaatcgcccacatcatccgacgatcgcaacttcgccgaattcaccatctaacctgccaaaaagggacaggtttattttgacaggttttatctgggcaaacgtcgagacagtaatgtagcgagccactgcccaccgcgttgagagttccgcttttgagaggaggccccgtgaacgcctttgaccgctacgccccgtttatccaagacttcatctactcccacgattgggagagtctgcgctctatccaggttgcggcagcagatgccatctttaacacacaagacaatgtgctcctaacggcatccacagcttccggcaaaaccgaagcggccttctttcccatcctgaccgagttttgggagaacccgcccgcaagcgtgggcgccctctacattggccccctcaaggcgctcatcaacgatcagttcgtccgcctcaacgacctctgcgaagaagccgacatccccgtctggcactggcatggcgacgtttcgcagtcgcacaaggcaaagctcatcaaaaagccgagcggtatcttgcagattacgcccgagtcgctcgaggcgctcttgatccataagcacatggcgattccgcgcatgttctgcgatctgcgctacgtcgtcatcgacgaggtccattcgcttatgcgcggcgatcgaggcgggcagacgctctgccttattgagcgcctgtcgcgcatggccggcgtacaaccccgccgcattggcctttcggctaccatcggcgaccccgagcgcacgggtgcctttctctcgcagggaacgggacgcgactgcgttatccctcgttttgaggaaccgcgccgcgtgtggcgtatctccatggagcacttctacaactcgggtccccaggcgcagcagcggggattcaagagcatgggtcctcaagaggccgaagtgcttgcatgcgagcgcattgaggcagcggcacccgcggcactgcccgtcagcacccaagacatgcgccatagcggacaactcacacaggaggaacgccgccaacgtcgcgagcaggcacggggcaaggctgcccccaaggacagtcgcgcttcctcggcccccgagggcgaagtcgacattccccgagcacccgaacaggcattactcaaccccaccgacacagcaccagacaacgccgaccccggcatgggctatatcttcgaacacacccgcggccgcaagtgcctggtctttgccaactcgcgcgaagaggcggaggccgtatgctccatgctgcgtagctactgcgaaagtcgacacgagcccgaccgtttcctcatccatcacggcaatctttcggcatcgttgcgtgagacggcagaagagcttatgcgcgacgaggaacaggcacagacgaccgttaccacctctacgctggaactcggtatcgatatcggccgtctggagcgtgcgtttcagatcgatgcgccgtttaccgtcagctcctttttgcagcgaatgggccgcacggggcgccgcgatcttccgcccgagatgtggtttgtcatgcgcgaggaagagcccgagccgcgcacgatgatgcccgagaccattccgtggaagctcttgcagggcatcgcgctcgtacaactctatcgcgaggaaaagtgggtcgagccgcccgagctcgatcgactcccctacagcctgctctaccaccagactatgtcgacgcttgccagcaccggagagctcacgccggcagagcttgcccagcgtgtgctcacgcttagctatttccatcgcatctcggccgatgactatcgcgtactgctgcgccacctcatcaagatcgaccatatccaagtcaccgagggcggcggactcatcgtgggcctcgcgggcgagcgcatcattaacaactttaagttctacgctgtgttccaggaaaacgaggagttcaccgttcgcagtgagtcggccgagttgggcacgatcgtcaatccgccaccgcccggtgagcgcatcgccatcgccggacactgctggattgtcgaggaagtggactggaagcgccacaccgtctttgccacgcaggtcaagggccgggtgccggcctactttggcgactgccccggtgatatcaatacacacgtactcgagcgcatgcgcaaggcgctcaacgagcacgcagcatatccgtaccttatgggtaacgcacgggcccgccttgcgcaggctcgtcataccgccgagatttcgggcgcgggaaccaagccgctcattaacctgggcggcgacacctgggtgctcttcccctggttgggaagctacgcctttttggcgctcgagcgcatgctcaagattaaatgtgccgcggagctgggccttcgcggactcgacccgtcacgcccgtactttatgcagtttaagatgaaggccgacgaggagacgttctttgaagtgctcgccgccgaagccgagaaagacttcgaccccatcgacctcgtctatcccggcgaggtgccttactttgaccgctacgacgagtttgttcccgaagagctcgtgcgcaagggctttgccgaaggcgtgctcgacatcgaaggcatgaagcagcgcgttctcggctggcgcgaccacgcctaagaccagtctttttgggacgaggagacttatttgtcgtgaaggacggtgccgaggaagtcggtgtcgaagggcacggcttcggcaaaggcgtagttgccgtcgctggcgatgagcaggtagttttcctcgccgccgaactccgcatcgccacatgggaccacccaggcgtgggcgaatacctcgagtgccgtggcagcgcaatcgcgcaggaacgtcacatcgctcccctcgcttgcgctcacgatattggccacgtagatgccgccggcattcaggctgccccgcactagacgcaacgcctcaacggtcgccagctcgcgtacgggctcggcaccgccaaagcaatcgctcacgaccacgtcgtagcgacgatgacccacactcgtcacacccagatacgagcgagcctcagcagtaatcacccgcaagcggtcgcccaccgtgcgctccagctcgtccagatagaaccaacggcgcgccaggcgcgtaatctctccgtcatactcgataacgtccatgcgcaagccctcgtgcgacatcagcgcaaacttgggataggcaaacccgccgccacccagcatgagcatacggtcgatgccgtgaccataagcgtcgtgcattgcaccctcggcctcaaacacgtcgtcaaacgcacgatagtacacaaagacgggctcagcccaacgctcgccaacgtaactcgcgctttggtagacgccgccttgcaccaatacgcggacttcgtcgccgccctcgtcgtgcacgcgcttcacacgcgccaacccattgcaggttcgcgcaacctgcagacaggcaacacgaacagcgacagcggccgcaccaagcgccgcggctcccagagcaacgccggcaacgacgccggcagaaacactcggcttgttcatctagagctccttttgcagataaaggccatggtcataaaatccaagatggcgatagtactcgcgcgtaccaatcgcgctgatcacgttgatgcgcgcatagccggcatcccgggcaatctcgcacgcacgctctacgagcaaacgccccaacccgtgatgctgcgccgcctggccctggtcacccacgcgtgccgccatgccatacacgtgcacctcgcgaatcatcgcctcgtccggcgtcgtcggcaactcgtccgcatgcgcggcaacaaaagcgcgaacgggcagcgacaggcgcaaaaagccagcgatcttgccttcgggcgtcacccactgcaaaaagcgttcacgcgtcaccggcgtctcgtaagcgacctcatcaagagacagttcatccaggtcggcacccgcggtactgatctcgcgatagcgaatctcacgcaccgtcgcaccgtcaccccgagcagccaggcggttctcaacgagctgacgcaggttgggcttcttgttgcccaccatgatgtcatcggaactaaaatcgcggatcatgcgactgatacggcagaacgccggcgtcaccacgatgtcgtcggctaacacatcgagcagttcttcctcggtataggggcgccactcgccgcgctcgtagcagcccaccagacgcgagccctcgatgagcgcacacgggtagaccttgacctcgtcgggcataaaggccccctcagtcataaagtgctcgtagtcgcgcttgtccccctcgggtgtggcgcccagcaagttgagcataaaatgcgcatggatcttaaagccaaacaggcgcgcaagcgaaaacgcctgctcgatccgagccaccgaaatgcgacgctcgttgatatcgagcaaatgttggtcgagactctgaatacccatctggatcttggtgcagcccaggcggcggatgagcgtaagcgcctgcggcgttacggcatcggggcgcgtctcgataacgagccccaccacgcgatgcttcgccgtctcgttgatgcgctgctgacgctcaagctcctccatcgttgccgtttgccactcggcaacctcgccccacggcgtaccagggccgtacagccgacgcaccgcgcggttatagccgcccacggcagcatccacacgctcctgctcgtcggcaacgccggcagcaagctcgacctcgtctgtcgcaatgccggcggcccgatagcgctcgcggcgttctgctaccacaggcggcagggcatcggcgggagcgtcatcgagcaggcgccccgcctcggcacggctgatgcccggacgcgccaacatggggttggccgccacgcccgccaccgcatcatcattgagtgcacggaagagctccgacataaaccacgtctgatacccttgcggatagtcgctccaggtaccgccgagcacaatgagctcaatcttatcggtcgcatgccccatctgcgaaagcgccgtcaaacgggcgctcacctgcagatacgggtcaaagcaattttgctccgcacgggcgcatgccggctcggcgtgcagatagctcttgggcatgcgcagatcgttggggcaaaacaggcaatcgcccgagcatggccagggcttggtgatgacggtaatggtcgccacgcccgaggccgttcggcgcggcttcatacgcagcacctgcagcagttgacgctccagatcggaatcgacattccacgcagcccaccgagccggctcctcacgtttaacccgctggtagaacggcagcagacggcgcttggccaaatcgcgtttgtcggcaccctcacggcgcgcctcggcatgtatcagtttgacgagcgctttgtcgtccacggtctcgccgcgacgcagagcctcgagtatgttcaagataatctgttccatgcccccattgtaagggcaaaggcgccgaagccgatctcggcttcggcgccttcatcaaacagcgcgtctatatcttcgcctaggctttcgtctgccccactactccgaatcaaacgacatgtcgcccgaatcgacttcaaaactatacacagcagacttatccccgttatcgaattcaagattcaaaatggtctcgccgtcgtagccaagcggaaggaaatcgctctcgaagtcgccgctgcccaaggtgaggctcgccttaaagcccgtagagttcggaaccgtcatctccacatcgcccgagcccacactcacgtccatcgacttcgcgggggcctggtagagctcgaacgttacatcgcccgacccgacctctgcactaagcgcatcagtcacgctgcccgcaaactctacatctcccgcacccaggaaaaggtcgaaaccatcacaggtgacaccggcaatctgcagatcgcccgagcccacgtgcgcgttgactcccttcagatgttcggcaacacggcgcggcagctcaaccgtaaccgagcggtcaattgccttaccgtcatcacttccaaactgagaaaccttgagcgtcgagtcctcgacggatgcgatgttctgcgtcgcggccttggaggcatccataccattggcaacgtgtccccgctcgataacgcgagccttgttgccatcaacaaccttgacgtccaccgtagccgcagcgatatcgaaatcgaggtagcggaactcatcggcatcaaaagtcgtgctcgaaagctgctgaggccgagcagaatagttaccgctattcaaggaatcgtcctcgtcaaacatatcgtcaaaatcagacaaatggccagatagaataccggtcgtacgcaccatatcggaatgagccaatagccgcgaagtgccaaagacaagcccgatgatgagcacaaacgctccgatgccaacgcccaagcgtaccttggattcatgcgaaagcttcatcattcatcactctctttggcaatcggctcagcggtagtcgcggtagccacgtcagcatcagattccgcagaagtatccttcccctgggccttgaccgccaccgacgccgaaccaacctgaatatccccgcgcgcccaatcgccatcgagcgcacgcgccacccagtgatagatgggaatcgtaaagaagatcagtgcggcaaaggggccggcaccaaacaggaacatcagcaaaaagaacagcagccagcacacggcccaatacgggaacgactggaacgggcccttcaccggagtcgagccaactgcgctgccactcgtcgcctgcgccgtagcggcattggcggcctgcgcactccagcttgccgcttgcgccgccttggcggcggcgtcactcgcctgtgttgccgcctcggtggcacgtgccgccgcctcatgggtacgggcgcgatctgccgcctcggcctcgcgctgacgggcacggtcctcgttctcaaactcgatatcgtcctcaatctcatcgctcggattgagcagctcgtccaagctcacaccatagagcttggcgagcgagatcaggttctcggtatcgggcgagctctccgcgcgctcccatttactgactgcttggcgcgacagtcccagctttcgtgccagcccttcttggctaaaacccttgctgcgacgaaggtcggcgagccgctgcgcagtttctacattcatggttcctcctatgtgatgccagccgtgccgccggaccgtttttcttcttaaggcgccttgcacagttaaaaatctatccgccaccgccaaaagcatgccacctattctagtgagatttttgacaaccgtcggttgcgggtgcatatgagctgcggaaatgtgtccaaacaaagcaatgacccgtagcttggttgtccccgttgcggcgttaacggtagtatggtcgtactgttaattccgcaccgccaacggagggagttccgcgccgtgaaccgcgatttcgcctcatcgctcatccagctcaacaacacgttctatcgcgagcactccgcctccttctccgatacgcgccaggccccgtggcccggctgggtgcgcaccatggacatcgcgctcgaacagctcgatgtcgccacgattgagcatcccgtccgcgtcttcgatctcgcctgcggcaatatgcgattcgagaactttgccgccggcggcgcacttgccgccaagggcgtcgacggcgcaaacccctcggtagatgccagctgcccgtttgagttctatggtgtcgactcgtgtcaggatttggctatcgatgcgcacggtcacgccctgcgcattcccaacctgcacttccaggaactcgacgtgctcgatgcccttatgaagctcaaccccgccgagacacccgacgtgcttttcgacgccccgctcgccgacatctcggtctgctttggttttatgcaccacgtgccgtcgtgcgagtaccgcgtacgcgtgctcgacgccctggtgcgccagacgcgcccgggcggcatcatcgccatcagcttttgggagtttatgaacgacgagcgcatggcgcgcaaggccgttcgcgccgaggcccgtgccgagctcaccccgccgtttgaaggttacgattccgcgcagtttgaagccggcgaccacctcatcggctggcaaaacgaccgccacgcctaccgctattgccatcactttgacgatcagcagatcaccgacctggtgcgcggcgtccgtacgttctacaagagcggcgaggtccccgtgcgcgagcttgagcgcttccatgccgacggtcgcagcggcgagctcaaccgctatgtgattctcaaacgtctgtaggcaccgacgattcgccgccgagccgcaccgcatctttcgggcaaactatgcccaccctttttcaacccattgacggaacgcgcagctatgcgttccatacttatgaccaaggagcctcatgggagccgtccacgttcgcacgcctaagaactttgtgctcgaggagcgcctggagcgctacgccgatgcgatcgagacgaaccccgaggcttatgccggagattggcgcgaggcttgcgcgccagctggcagcaagcccttcgaacaccttcacctggatcttggctgtggcaagggaacctatctggtcgagcgcgcccaccgcgagcccgacaccctctttatcggcatggaccaggagcccatctgcatcgcctatgccgcgcagaaaatctgcgaacaggggctatccaacgcactcgtcctgccccgaggcgccgcatcgctgccacagctgtttgccgcaggcgagctcgatgccatcaccattaactttcccacgccgcagcccaaggccaagtacgctaaaaaacgactcgtccatgtcgaccatctgatgctctaccgcccgctcttttcagccggcgctaccgtcacactgcgcaccgatagcaagccgttgcgcgattacgccctgggacagtttgccgcggccggctacgatacgctttgggtaagcgacgacgtccgccgcgaccatcccgagcatcccgagaccgagtacgagcgccgcacgcgcgagatgggtgccgccgtctatggcatttgcgccacacctggagcgcagcccagcgatgaacagctcgcggcgggccgcgcgcaggagcaaagcctagcctgctacctgcccgataacctcgatgagctcgcctatgtgcctctgggcatggaagaggccgtcgagaactttagaaaccgtgcccgcaagggcaagaagcgtctaccgcaagagtcccaggggcctctgatggtcgcagcttcggcaaacaagcgcaaataggcgccagcaaacgtccctcaaatctaagtgagtagacttttttgcaatagccaagcacaacccgcataaccaatactaaaaccgcaggtagagcccttgcgcaaaagccatgtgctcgcgatattgcaaaaagtctactcacttagctggcaactgcaccaaacggctgggcagaacgcccatttcctgcattttcttgcctgcgaacgcatcgatgcgacgctacgccataatagttggcggacaatcgcgagagaaagcaaacacatggcacagaccacgacagataccgccgtcagcaccgtctccggcgccggggccgccagctcattctcgggcggcacgggaaccgaagccgagttcggctcgctcggcgcgctctcccccacctggtgggagcccgaggacggcagcgagcccgaaccatggctcacgcccgaccaggccttcgaacgcttctttgaatggacgagcgatcgcggcattgagctgtgggatcaccaagaagaggccctcatggacctggcagccggcgatcacgtcattctgggcactccgaccggatcgggtaaatcgctcgtcgcgctgggcatgctctttatgggcatggcgcagggcaagcgctgttattacacggcccccatcaaggctctggtcagtgaaaagtttttcgatctggtacaggtgctcggccgcgataacgtcggtatgatcaccggcgacacgcatatcaacaccaaggcacccgtcatctgctgcacggcagagatccttgccaacgacgcgctgcgcgagggcgaagatgccgatgttggctgcgtcgccatggacgagttccactactttgccgaccccgatcgcggctgggcctggcaggtaccgctgctcaccctgcctcacacgcaattcatgctcatgagcgccacgctcggcgatgtcactgccatcgccgcctcactcgaggaacacaccggcgctacctgcgacttggtcgtcgatgccccgcgccccgtgccgctgagctacgactatgtgacgacctcgctcgaaggcacggtcgagctcgccatgcgccgcggcgaggccccgctctatatcgtgcactttagccaggatgccgcccttgcgacggcacagtcgctcgccaattttggcatcgccagcaaagagcagcgcgaagccatcaaagaagcggcaaaggggacaagcttctcgacggccttcggcaagatcctcaagcgcttgctcggctgcggcgtcggcgtgcaccatgctggcatgttgccgcgctatcgcctgttggtcgagcgcttggcgcagcagggcctgctgcccgtcatctgcggtaccgatacgctcggcgtcggcatcaacgtacccatccacaccgtggtgctcaccgcgctcaccaagttcgacggttacaagatgcgtcgcctgcgcgcccgtgagtttcatcagatcgctggtcgcgccggtcgctcgggcttcgataccgagggcatggtgatcgccgaggcacccgagcacgagatcgagaatgccaagcttatggccaaggcgggcgacgaccccaaaaaactccgcaagattaaaaagaagaaggcccccgagggctttgtcacctggaacaagcagacctttgagcgcctgatcgagacgcagcccgagacgctcaagccgcgcctgcgcatcacgcactccatggtgattagcgtggtcgagcagggcggcgatgcccgagcccgcgtgcacgacctcatcgagacgagtctgcagactcccgaggaaaaggccaagctcgaggttcgcgccgacgaaatcttcgccacgctcatcgattccggcgtcgtcgttcgcaccgaggtgccgcccgcacccgacgccccgactgacgccgcaccagacatcgactatgcactgacggttgatctgcccgaggacttcgcgctcgaccagccgctctcgccgtttttgcttgccgcattggagctgctcgatcccgagagcgagacctataccatggatctaatctcaatggtcgaggcaacgctcgaagatcccaagcaagtgctgcgtgcacaggaacgtgccgcacgcgatcgcgctatggccgagatgaaagccgacggcgtcgaatatgaggaacgcttggagcgcatccaggatgtcacctacgaaaagccgctcgaggatttgctcgatgccgccttcgacaagtactgccaggaagtaccttgggccaacgactaccagctctcgcccaagagcgtcctgcgcgacatgttggagagcgcgagcgactttaagggctatatccaaaagctcggcatcgcccgctccgagggcattctgctgcgctacctagccgaggcctaccgctccctcgatcgcaccgtgcccattgagaagcgcgatgagcgcttgcgcgacatcatttcgtggctcggctttgtggtacgctcggtcgactcgagcctggtggacgagtgggagaacgccggcaacccggcggccctcgacgccgcgccgccgcagggcatcgacgaggtcgttgcggaccgtcgcggctgcacgctgctggtgcgcaacgcactcttccgccgcgtgacccttgccgcccgcgagcacgttcgcgacctgggcgaactcgacgaggactggggcatgagcgaggtccgctggcaaaaggcgctcgatgcctaccatgagcagcacgaggaaatcctcaccgacggagatgcccgcagcgccgcgatgtttaccatcgacgggagcgacgagaagaccgatcacgtgtggcacgtgcaccagatttttgccgacgaggatggcgaccacgactttggcatcatgggcgatgtcgacctggatgccacgcaagacggcggcgaggtcatcttcaaaaactaccgcgtcggctttatcgaggacctgctcgaggactagccgtacatactggaacgaagcggggccgttggcagtatcgccagcggccccgcttttgcactatacgctatcccctactcggcatcctcgacctcatacgaatccgcctcggcgggctcatcgtttgcccctgtcgcagccccgcgcgcctcgtcaaacgccgccttcatggtcttgttgccccaggtgagcttgcgaatggtaagatcgtcggccttcttgttggctagacgtaaattgttctcggaggacagcaatgcctccttggttttctgcagatggctaatcgtcttgtcaatctcctcgatcgccgtctggaacttacggctcgcaagctcatagttgcggccgaagtcgttcttgaacttctccatcttggcctcgaagttcgtgacgtcgatgttctgctgcttgtactccgccagctcctgcttatagcgcagcgaacccatggcggcgttgcgcagcagcgtgatcatgggaatgaagaactgcgggcggatcacgtacatcttctcatagcggtaactcacgtcgactatccctgcgttatagagctcgctttcgggctcgagcagtgtgcagagcaccgcgtactcacagcctttctggcgacgatcgtgatcgagtttcttaaagaagtcctcgtttttgtgcttggtcgcggtctcgtcgttctcgtttttcatctcgaacataatcgaaatgacctcgttaccgcttgcgtcgcactcgcggaagataaagtcgcccttggtaccctcggacgcatcgttatctttctcgaagtacgcgttaggaaatgccgtcatgcgcagacggttaaactcggtctcgcagtgctgctcgagcgactcgcccaccatcttggtggacaggcggaccttcatgtccttaaggcgctcaatctcttcatccttgtagcgaatcaggtcatcgctcgcgcgcttggcctgcgcaagctcgagctcatgtgccgccttggcttgctcctcgcgagaatcgcgcaccgccagctcgctcgtcagcttggcacgtgcctcatcgcgctctcgctccgccgcggcgaccgccttcgatagctccatttttgcagaaagttcttgctcacgaagctgtgcacgaaggccctcggcctcgcgcatggactgagtctttgcggcggaaaacttctcctgtaccttcactcgatagtcagcaagcgcgcgctcggcctcgctgcgagcggcatcgagttcgcgtttcgactcagccgcagcggcggcaagcgccatctcctgggctttatccgccgcggagagctttgcctgcaattcggcaatctgcgcatcgcgtgcggctaaatcgttttgagcagcgttacgcgccgccgactcgacgagcttggcttcgtcatccttgcgtcccagctgcgcgcgcaaattgtcgatctcgcgctgaagcttggcgttctccttttgagcgtcggcacgggcttcaaccgccgcacgctggcttgcactctcgcgctctgcggcagcgccctcgagcttggcgcgcagttcggcaagctcagcatcgcgcttggcgacctcttgtgccagctgttgagccgcagcattcttctgctcgacaagctgagcgttgcgctgagactccgcctcctgcaaagcagccgacgaacgcgagcgctcaagctccagcgcctgctcgccctcacgctggactgccttcacacgctcatccagatcgcgcgaaaactcggcatcgcgcacttgcttgatgatatccgcatagccagacgcgtcgaccttaaaaacttcgccacaatgcgggcacttgatctcattcatagcagctcctcgatggacgcaaatttcaatcgcctacactctaccgcgccgcacggacaaaaaaggcgccgccgccataatggcaacggcgccagaaccacgacaaaggtgcccgccccctttgtcgcggtttgtgcggtggttcgagaattacagtccaaaatagtcgaggatttgatcgcgacttacgggcttgtactcgttggcgtcgaggccgacatcgtagcgaaagatagggcgctcgcgatcgcggttgcgtgcgttggtgcggtcgcccctgctgtggatatgtccatgcagcatgatggcgccgcgcgccttgccattccagctgagcatggggtaatggctcataaccagacgacgccccttggcatagccgggagcaatctccaggtaatcgcgcacgtcttcccaaatctgcggtacgtcgggatcttcccagtcgccgtcatggttaccacggatgagcgtcacattcttgcattcgatacgctcgcgcaggcgcaccgcctctgccaggggcaaacgataggtaaagtcacccaggatgtagagacggtcgtccgccgccacgcactcattgatggcatcgatgaccttgcggttcatctcctcgaccgaatcaaacggccgatccatatcgtgcaagatattcgtatcgcccaggtgcaggtcggcggtaaaccacatcatcgtctgtatcctcatttcgcaacgcgtctaacacgtgctaagtatacagacgcagcgatgcggcggttatccaaagaacccgccgaacagtccgcggcggctcttgtcttgctttttcgaagcgtcaccctgggcattcttatcctgccgcttcttacgatcccgctccaactcattgtcatcgagtagcatatcccactcaaacggatcgtctgccagatcaaacagatcatcgttatcaaacatggcagtctcccttaccgattagcgagcatccaccacgtagagtccaacgcgcacctgatgccacgggctgcgctcgggagcaacctgttgcacgcgggcctcaaatacgtcctcgtgaccgtaatacatcatcaaggacagcgggccgacctcgtttcccggaacatagccgagcttggtcttgccgtaatagatcgcaaccgcctcggggtcatggggattatcgcgctcggcacgcagcgtcagcttatcgcccactttaagatcgcccaagaccaaggcaccgtcggcatactgaaatcccgcgacatgaaacgacagaagcacacgtgaaggctcgtacatggcagctcctctaacggccggataaaccggcgcttaaccgtactgagaagtctacgagcccgtgcggacacaaattcatcctgcccgcgtctttcaatcgcttgccgcaacgcttgcgagacagagcgcttgcagataagataggggtacggatggcacccgttgcagcgggtcttgccaactccgatacacgttttcatcgtgagaagtggccgtcttcgcttacgcgggggcggctatttcattcggccgataaacaggccgagttcgatagccgcgattaacaacgccagtaacgaaataacatcgcttacgttcataccaattcccttctaaagggagttggcccatccgtaccccatagcagtagtataacgtaaatgacaggtaataggaacacttgttcgtattacctgccatttcctaatgcacaaacatgcgcacgaatttgtgcttccagcttgcgtagggcgcataccgaaacggcacgtccaaccaggttgccttgttcacgatgctcttcttgtggctaaacgtatcgaagctctcgcggccatggtactgccccatgccgctcgcgcccatgccaccaaagcccatatggctcgtagccaagtgcataatcgtgtcgttgacacagccgccgccaaagggcacgtagcgcacaaagcgctgctgaaccgcacggtcccggctaaagatatacagggccagcggcgttggacgatccgtaataaacgtctcggcctcgtctaggctctcaaacgtcagcaccggcaagatggggccgaaaatctcctcctgcatcacggcgtcctcaggcgccacgccgtccaaaatcgtcggctcgatcttgagcgaagcctcgcgcgcggcacctccaagcacgaccttatcgggatcgattagcccgcgcacacgcgcgaaatgcttggcgttgacgatatgaccgtagtcctcgttatcgagcggatgctcgccaaacatacggcggacctcctccttgataaggtccagcagctcgtcgtgcacgtgcgcatcgaccagcaggtagtcgggcgccacgcaggtctgccccacgttgagccatttaccaaaggcgatacgccgtgctgcaaccttcaagtttgccgtcgcatccacgatgcaggggctctttccgcccagctcaagcgtcacgggcgtaaggtttttacttgcgcgctccatgacgagcttgccgaccggaacgctaccggtaaagaaaattttgtcccagcattcatcgagcagcgcctcgttctcggcgcgtccgccctcgacaaccgtcaccaggcgcggatcaaatgccttttcacagatttgcttgagcaccgcgctcgatgccggagcataggcgctcggcttgatgaccacggtattgcccgcggcaagggcgccagcgagcggctcgagcgtcagcaaaaacgggtagttccacggagccatgatgagcgtgacgccatagggcacggactgcgtcttgcacacactcacggcgttggcgaggtcacacggacgcagacgcgagcgactccatcgagccacatgcgcaatctgataacgaatctcggaaagcgaggtgccgatctcgcacatatacgcctcgtcatgcgactttcccaaatcggtcttgagcgcatgggcaatatcggcctcgtgggcccgcactgcatcgcgtaaactcacgagcgcacgacgtcgagcatcgacatcaaacgtggcgtgcgtcttaaagtaggcgcgctgatcgccgacgatgcacgcaatttcctcggtgttcatggaccctcctagttctcgccctcaaacataccacctgcaacgacttcatacatacgctcgagctccaagcggtccattaatagcggaacggggtacaggggattggcctcggcatcggcatgcgtcgccatttgcggaatatcggagcggcgaatacccgagacatatttggggattcccagggcctcgttcatgcggtcgacccaatcgataaaggcctcggccgccaggctgtcctgcgcgttagccggcgcgatactggccatgcgggcgagatcggcgagtttaggagcagcggcttcgccataggcacgaagcatgtgcggcaagatgatggcgttggccaagccgtggggaatcccgtaacgcccgcccaggctgtgcgcgatggcatggacgtatccaacataggagcgcgtaaaggcaacacccgccttatacgccgccgaaagcatattgcggcgcgcacgcatgtcatcgccatgctcataggcctcgagcaaattgtcgtggatgagctgcaccgcctggcgcgccatcttgcgcgtatagggcgtggtgctgcgcccgataaaggcctcgacggcatgcgtcagggcgtccatacccgtttgccccgtaatggaggcgggcaggccgcgcgtaaactcggggtcgtgcaccgcatagcgcgggatcagcacaaagtcgttgatggggtacttgtagtgcgtctcgtcgtcggtaattaccgctgcaagcgtgacctcgcttcccgtgcccgccgtggtgggaacggcgatgagcagcggcaggcgacgatggacacgcagcaggccgcgcatcttgttgatgggtttgttgggttgcgcgatgcgcgcacccatgcccttggcacagtccatggcagaaccgccgccaaagccgataatggcctggcaggcgcgcgctcgatacagagacgccgcttcctccacgtttgagaccgtggggttcgctgatgttttggcatagatcgcaacgccgattcccttggacgcgagcgccgtctcgagcggtgccgtgagccccaggcgggcaataccgggatccgtcacgataaggacccgctgtatcgaacgcgcccgaagcactgcgggcacatcctcggcgtgctccagaatgcgtggctcggtatagggcagcaccggcaatgcaatgcgaaaaaccgtttgatacgttcggcaccaggcacgacgggctagatgcataaaggaagctccctcatttgttgatgggtcaacatttgctcgaccgattgtactcatcggcgtccgcatatggcttgccaatcgttaatcaatcaacatcttcacatgcttaaaattgttttattaaaaatcattcctaataggcttcacatttagttgcatttatggataatagaacccgtcaagacgcacgtccggagagggcccttacgggaccggacgagcgcgccatcgccatcgatcgaaaggatcgaatcatgaagtttgtttgccccgtttgcggttatgtggaagagttcgacggcgaccagctgcccgaggattttaagtgcccccagtgcggcgttcccggttctcgcttcctgaagcaggaggagggccagctcgagtgggctgccgagcacgtcgtaggcgtcgccaagatggagggcgtctctgaggacatcgttgccgacctgcgcgccaactttgagggcgagtgctccgaggtcggtatgtacctggccatggctcgcgtcgctcatcgcgagggctatcccgagatcggcctgtactgggagaaggctgcccacgaggaggcagagcatgccgccaagttcgccgagctcctgggcgaggtcgtgaccgactccaccaagaagaacctcgagatgcgcgttgaggccgagaacggcgccaccgccggcaagaccgatcttgccaagcgcgccaaggccgctggtctcgatgccatccacgacaccgtgcacgagatggctcgcgacgaagctcgccacggcaaggctttcgccggcctgctcaagcgttactttggctaagccaaccgcctgagacataacatctagctcgaagaaggcccggaccgtattggttcgggccttttcgttggcttattgcagttgctcctgaagaacactgagcgactgagagctcaggtcgtcgtattgtatgaggacgcgagatggagcgttcttagtcgatgcccgatcacccgtccacaggcaatcggcgatgttgacataggaaatacgagcgtcagcgagagccttcgcgaaactctcccctgccttgtcctcggccagggcaacagtgcagtaaaggcccgcgtctgcatgctcgatcgacacctcccctgtcggaaacgccttgcgcacaattgccgccagaccatcgcgcgcctcacgagcacgaacgcgcacccggttcacatggcgctcgtaatcgcccgattcgagcaagcgggccaacgcgacctgatctacggagctgaccgacgaggcgtaaaaaccaagctcacgcctaaatcgttccatgagctgatcgggcaggaccatatacgccaagcgcagggccgatgacagacttttcgaaaaggtattagtgtagatgaccgattgggcggcatcgatcgatgcgagcgccgggatcggcttgccggccagacgaaactcgcaatcaaagtcgtcctcaatgagatatcgacccggctgctcggcagcccagctcaggagcgcatagcggcgcgcgatacttgtcaccaggccagtcggatattgatgagacggcattaggtgaagaatatccgccccggcatcgagcagctcgcccaagttaacgccctcaccatcaagcggaatatgccgcaccttgcagcccatggcctgatagatgcgcgtcagtcgcaggtagcccgggtcttcgacggcgtacaccttgtccgcgccaagcagctggaccaacatggtatcgagcaactgggcgcccgcaccgatgacgatattgtcgggattgacattcatgcccctcgtcccgcgcaaatgatgagcgatcgcgcgtcgcagccgagcggtgccttgcgcaggtgcgggcgagaagatttcgcgctcatcttcggacgtcaacgtcgcccgcagagcactttgccagagacgtgcggcttccaaggcggaaggagaaagcgcggcgaattgttcaggctgtccataggagtcatgaacgccaaagctcgctggagcagcatctcgatcggcatcctccgcagccgaagccagaaccggggcttcgggaagctcgcacgcgtagtagccacgacgcggctttgagcaaatatagccctcggcaagtaactgactatatgcattctcgatagtaataacgctaattcccagatgactggcaaaggcacgcttggagggcaggtgctctcccgcggcaatgcggccggcgacgatatcgtctcgaatttgctggtaaacatactcatagagcgatgctccgccacgttgttccaaattgtagtcaagcatgagtttgccacctgaccttatcgtgtcattcaatctggtattagtctgaccttgttattatctcgaaaactgagtattccgccatacccagctcccctataggatgttccgtcaagcaatacacatgccaaccaagggagcaaccatggcagaacagaccagcaaggccgatcgcgtcaaactcaaccgcgagctcgcgcagatgctcaagggcggcgtcatcatggacgtcaccacgcccgagcaggcacgcatcgccgaggaggcaggcgcctgcgccgtcatggccctcgagcgtatcccggctgacatccgcgccgccggcggcgtgtcgcgcatgagtgaccccaagatgatcaagggcattcaggaggcagtctccatccccgtcatggccaagtgccgcatcggccacatcgtcgaggcccaagtcctgcaggccatcgagattgactacatcgatgagtccgaggtcctctcccccgctgacgatgtctaccacatcgacaaaacccagtttgacgtgccgtttgtctgcggtgcccgcgacctgggcgaggcgctgcgccgcgttgccgagggcgctacgatgatccgcaccaagggcgagccgggcacgggcgatgtcgtccaggctgtgcgccacatgcgcaagattcagaagcagatccgcgacgttgttgccctgcgcgacgacgagctctttgaggcggccaagcagctgcaggttccggtcgagctggtacgcgaggtccacgccacgggcaagctccccgtcgtgaactttgccgctggcggcgtggcgacccccgccgacgccgcactgatgatgcagctgggtgccgagggcgtttttgtgggctcgggcatctttaagagcggcgaccccgccaagcgcgccgccgccatcgtcaaggccgtcgccaacttcaccgatgccaagctcatcgccgagctttcggaggacctgggtgaggccatggtcggcatcaacgccgacgaaatcgaaatcatcatggaggagcgcgggcgctagtccggcagaaaggatcgcacatgagcgattacgcagaccagacggtcgccgtgctggcggtccaaggcgcttttgccgagcacgaggcaaggctgtccgagctaggcgcacattgtattgagctgaggcaggcagccgatttgaagcagaactttgatcgcctggtacttcccggcggcgagtctaccgttcaaggcaagctgcttgatgagttgggcatgctcgacgagcttcgcgcccgcattattgagggcatgcccgtaatgggcacctgtgccggcctgattctactggctcacgacctcgccacccatgatgacaagggcacgcctcgcctggcaaccatggatgtgctggtcgagcgcaatgcctacggccgacagctcggcagctttcggaccaaggggcaggtagccggcatcgacggtaaactgccgctgacgtttatccgcgcgccccgcatcgtcgaggtccacggtgacgccaaggccttagccgaagtcgacgggcaaatcgtcgccgcccgtcagggcaaccagctcggcgtaaccttccaccccgaactcgacgaggacacccgtctccacgaactattcctgcaaatgtaggcagataaaacgagcgtggattttcggacacttacaaattgagagtggataatctcccactttgagccaacattcaggccaaaaccgggagattatccactctcattctgactagtcattggagacgttctttaacgactagtcaaacaagaacgtccccaacgactacattgcgatagacgaccacgtttgcccagataaaaccgaccaaaataaacctgtccctttttggcaggtttggatcaaggcaacgccgatgttttggtaccgacagacactatgacccaatccgagggcactaaaaagataggagcccccgctcgtgcatgcgaacctccagtccggaccgcttcacggtccaactttctgtccgcaccccccctgggcgcccgtatggcatttttaggaactatttcaccgcaactcaaaaggccgcagtcgggagttccggctgcggccctattgcacatgttaggttgacctacttgctagaccagcttgaagcccttgcgcttgcctacggagagggtgtcgcccagtttgagggcgctggggtcgatgttgtagctcttgggagccacggccttgccgttgatcttgacgccaccgccgtcgatatcgcgacgagcctggccggcgctcgccgaaaggcccaagttcttgagcaggccggcgaggtagatctggccctcgtcgttgacggtcagctcgacatgcttctcggggaagtcggcaagctggccctccttgaacacgcggtcgaactcggcctgagcctcgtctccggcgccggcgccgtggtaggtgtcgcacaggtcgcggcccagagcgcgcttgagctcgtaggggtcggcagaaccatcggccagggcggcgtcgatcttgtcgacctcggccggggtgagcgagctggccagacgatagtacttgccgatcatctcgtcggggatggacatggtcttgccgaacatatccttgggagcgtcggtcaggccgatgtagttgccataggacttggacatcttgcgcacgccatcggtgccctcgagcagcggcatggtgagcgcgatctgcggctccatgcccatcttctccatgagctcacggccagcgagcaggttgaagagctgatcggtgccgcccatctcgacgtcggccttgatctgcacggagtcgaaagcctgcatcacgggatacaggaactcatgcagggcgatcggcgtctgagactggtagcgcttggtaaagtcgtcgcgctcgaggatgcgggcgacggtgaacttggagcacacctgcagcagaccggccagatccatcgaaaggatccagtcaccgttgtgcacgatggtggtcttctcgggatccaggatcttcatggcctggctcacgtaggtctcggcattggcctcgatctgctcctgcgaaagctgcggacgggtggaattcttgcccgaagggtcgccaatcaacgcggtaccgttgccgatgatgagggtgacgttgtggcccaggtcctggaactgacgcatcttgcgcagcggcacggcgtggcccaggtgcaggtcggggctggtggggtcgacgccgagcttgatgttgaggggctcgcccttctcaagcttcttgcgaaggtcggcctcgggaacgatctgcgcggcgcccgaggtgatgatacgcatttgctcgtcaacagacagcattgggtatcctccttttgctatagcaccctcgccgaaaacggcggtgctggaagtccataaactctcttatgataacaaactgacgcgacgcagcacctacgacaggaaaatcctcgtcctgccgcatgcgtcaatggcaactggcagacgtgtaccgtcacgctcgaccagatagcgtacctgccgacgacgcaagcagtcgcggcaacgaacctgtcccgtcgcatcggtggcgcagacgccctcggcggtcagcaggcagtgctcgcacaccataagctcgggacggtcggcgtcgaccggacccaagacgccgggttcagcggccagttcggcaatacgctccgcatcattgccgagcaactccgccggcaagcacacccgccccgcaccgagtccgcgcagccaggtaagcgtggcccgattcgcgcagaacaccggcgccgccacgtcaaacgtcacgcccagctcgcgagcgatcaccacctgtcccaggttgcggcagacgacgcgcccggcacgctgtatcagtgagcgggtccagtcagcgtcacccgtgcggcacacctcgtcaagcaccacaacggcgtcggacaaatcaagttctccgcgcgggtcggcatccatcagctgccaagcaaaaaccatgcgagtgggaaccgcgcactccaccaactccgtggacgcaccgccatccaccgcaacgtcctcaaagggcagcacctcaacggcacgcgcaacgggcgcaatcgcatccgcctcggcccgcatgcgctccaacaccgccgccgtctgatccaacacgccggcgctgcgaatcaggtacacctcgcagcccgtgtcaaccttacgcttgcaatgcacgacgacgcgctcccccgctgcggcatccaccggacagggcacctgcggccagcgcttgggcacatcgggacgcgcgtcggcacccggataaaaccggatctcgagcgtgtcacccgccgccacggcggcgtcgagctcaacggtcacctcttcgtggcccacagcgaccaagcgccccacgcgcacgccctggttaatcgcacgctcaaagctcatcagctcggcacccgaacgccctcgcaggtacgcatcggtaaacccacggttaaacgaccttcccagctcgcgctcaagctcttccacggcaccggggtcccacgcgccgtcgtacagcatatcgagtgcccggcgccacacccgcaccacgttgaatacgtaatcggggttcttcatgcgcccctcgatcttgagcgacgccacgccggcatctacaagctcgggcagatgtgcaatacccagatagtcgcgcgggcacagcaggcgatctccctcgacggcgacaacgctctgccccgcctcgtccaccaggtcgtacgccagacggcacggctgcgtgcagtcgccgcgcatcgccgagcgcccacgccgcagggccgagaactcgcacgcccccgaatagccgatgcaaatcgcaccgtggcagaatacctcgatgggcacgcccgtggcacatagcgccgcaatctcgtcgaccgtcagctcgcgtgccgtcgtcacgcgctcgacccccagctcatcggcggcaagtcgcacggcgccttcgctatgaacgcccgcctgcgtggacaggtgaatctcgaccccgggaatcgccgcgcgcagcgcgcaggccagcccggcatcggcgacaatcagagcatcggcgcccagctccagtgcatgagctcccaacgccaccgcgtcggacaactcatcgtcaaacacgaacacgttgagcgtcacgtacacacgcacgccatgggcatgcgccacggcgcagccgcgcgcaaactcgtcgtcggtaaaaccgtgcgcactcacacgggcgttaaagccgcccaaccccgcatagatggcatcggcgcccgcggcgatggccgcaaacatctggtcgagcccgcccgccggcgccagcagctcgggcagcgccgcaccggcagcatccaatccagtcttgtgttgtccgctcggccccatcgcccgaatcgccatcggcaaactccttaccaaggtatgcattcactctgaaaaatgccgtcttccagcatacacgaggcctcgcgcgccccgtttggtttatcgtgtaataacttatgtccatcctgccccgacggcacatccgccgtccggcacgacatacctggaggtcaatatatgggtcctcgccaacgacagggacgcagccgttcaaagacgcatgccctgcccataatcctgctctcgtttttgggctttttgctgattgcgggcgtggcatttggcatcggcatggtcggcaacgtcaaccgctggctgtccgatctgcccgactacaccgacgccaacgcgtatctggtgagcgagcccaccgagatcgtcgactgcaacggcaacaagatcgcgagcttctacacgcaaaaccgcaagtccatcaccaaggacaaggtctccccctacgtgctacagggcaccgttgacgtcgaggacgagcgcttctacgagcacggcggtatcgacctgtggggtatcgcgcgtgctgcggtggcaaccctcggcggcgggcacgaaggcgcctcgactatcacccagcagctggtgcgcaacaccatcctgcaggaggagcagttcgactcgaccatcgagcgtaaggtgcgcgaggcctacatcgccgtaaagatggaggacatgtactccaaagacgagatcctcatgatgtacctcaacaccatctattacggtcacggcgcctacggtattgaggccgccgccgagacctacctgtccaagagcgccgcagacctcaccctgagcgaggccgcgctgttgatcggccttcccaactcgccctcgcagtacgaccccacggtcaaccccgacctggcgctgtcccgtcgcaacaaggtcctcgacaacatgctgcgcctgggccacattacgcaggaggagcacgatgccgcacaggccgagcccatcaccctcaacgtgaccgaaatctcgggcagcggcgttgacgtatactcgcagccctactttgtcgcctatgttaagcagctgctggagcaggagttctcgaccgacgtgctctttaagggcggcctgaccgtcaagaccaccatcgaccccacgatgcagcaggtggcagagaatgccgttcgcgagcagctcgacacgctctcgctcgacggcctggacatgggcatggtcgtcgtcgaccccaagaccggctacatcaagtgcatggtgggcggctacgattacaacgccgacgagaaccacgtaaaccatgccacggccaagcgtcccgtcggctccacctttaaggcctttacgctggcaactgccatccaaaacggcatgaaccccaacgtcaccctcaactgcaactcgccgctcaaggccaagggcaccacgaccgaggtccaaaactacgccaaccatagctatggcaacatcacgcttaagcaggcgacggcatactcctccaacaccggctacatccaggtggcggaagccgtcggcaacagcaagatcatctcgctcgtcaaaaagctcggcatcgatcccgccaaggacaacatcgaggacgttcccgtcatgaccctcggcaccggctcgatctcgccgctcgagatggccgccgcctacgcgacgtttgccaacggcggctactatcgccagccgatcgccatcaccgagattgactctcgtaccggttcggtgctgtaccagcacaccgacaatccctcacaggtacttaccgagggcgaggccgccgcggtcaccgatgttctgtccggcgtcatgaagggcggcggtacgggtgctgccggcgccctgagcgtcaaccagccctatgccggcaagacgggcaccaccgacaacaccaccaacctgtggttctgcggctataccccgcagctggcgtgcgccctgtggaccggctattccgcgggcgagattcccatccaaaaatacggcacagacctgctgggcgacagcaccaacctgcctgtctttaagcggtttatgaacaccgttctgaccggtaccgagcgcgaggagtttgcgaccggaacggcgcccacctacaagaacaacagcgtctggaagttctacggcaccaacaacaccaagaagacggagaacgacgacaaggacgagaacgaggacgaagaggaaaccaccacaacgactaccacgacgaccacgaccaccgagaccacgggcggcgacaccaccggcggcaccggtacgaccggtggctcgacgggcggctccactggtggttcgaccggcggcgatggcggcacgcctacgcctacgcctacgcctacacccactcccgacccctcgcccacgcctgacgatacggttggctagaaattcatccggccattagcaacaaggcccccgagcagcttattaaagtgctcgggggccttttagtttaaagcgacctggtggacggcctttataccggcaaacaatatagggggtaccgaccaacgtcgatacccccttacaagctaccatgtcacgcacacagtgccgagcgcacgacccgcacgcctacttgcgagaattgctcagcttattgatcagcgcctcgagacgctcgccgtcctcggccgtctgggcaataaccaaaatcgtatcgttgccggcaagcgagccaagcacatcgggcaactctgccgcatcaacggcggcggcgatgccggaagccgtaccaggctgagccttgatcataaccagattatcggtgcgcagaacgcccgttacgagctcggaaaccatacgctgcaggtgcaggtcctctgccagaacatagataccctcggggagcttacgcagccccatatcggcaatatcgcgagagacagtcgcctgcgtgcaatcaaagcccatagcgcggagctcatcgaccagcacgcgctgcgtgcggacgtccttattgcgcacaatatctctaatggcatcctggcgcccattgcgttttttagccatacaaaccctctctccaaaagatggcggagacaatcaatcagtgactgaatagtttaacgctatttgaaggcttttgtgtataagaacgcatttcgaaacaattctatgcaaatttgtttcgaaatgagccgtttaggcggtttttgcgcccgtccggttaagaaaagctgccagatgcgtacacatcacgcagcgcgcgggcttggcgctggcgatcggcccaaacaacaaaccgagtccccgatggttatccttgagcgcggcgaccatctgacgggttcgaggcgcctcgagcatatcacgcatgcgggcggaacgctcgattgacgacactccatgcgggctaagacacaaattctcgatgcaggcgaccagtccggcaaagtagaacttttggcttgccagcttgagccgaccaccgctatctgcttccgagagtgagtccgcaagctcgtcgagcgctcgagtgtcatcggatatcctggcatacatggtgggatcaaaggcatctgtaagcttaggtgccaccgcgtggaaacaagcgtcgccgcagccggacacgaatcgtgcctgcgagagcgcataagccataaactcaaccgtacggtacgccttgccgcgcgacaggcatgcctcaaacagcggacggctatacatcacgccagaggtctgagcgactaggccgcccaaaatcaactggggcagcccagtcaccatagaagactcgtcttctatggcaatagaggcagcatccaagacgcgcgaatggcgttctcgatgtgcatcatagcggtcgagcgacaccgtggggaacactatgtctgccgcagtatcgcacgcgatatcgaccatcttggaaagggactgcggagcaaaccactcatcggcgttcatagcgatgatttgagagccgcgcgagacagcaaaaccggcacgaaggcaagcgccgcgcttcgcgtcctcgacgtcaatcaaatcaatatggatgtccctgtcggcagcaacttgaagcgaatggcgcacaccgggcgcagcatcgcggcaaacaacgacaatctgcaaatcgtagaggtcttggttctggatactctcgagcgcacgcatcgcatagctgggcgaaccttctaccacaaggatcaccgaaagtcgcggatgcgagccacgtcgaaccaagttatccgtcctctcgacagcaatgaatcaaaccgtggttcatggtacaccccggcaataaaagcaatgagacaccggttgtattgcacgccaagaacagatgttgcacacgcgcagcccacagataatgggtgtcgacgcacgacgcgtcgagccctcccctagtcgagcacgacgagctcggcgggatcgtaatccacgcccataaacgtaaggccgcaggcaggagccgtggggcccgcagcggtacggtcgcaagcatcgatgacctcgcgcatccactcgggttcacggcgatgcatgccaatcgcgacaagcgtgccaacgatcgtacggaccatcgaatgcagaaacgcattgccctcgatggtaaacgtcaggatgtcctcgccaaacgcaacctcatggccaaactcggcgcgcattacgcagcggtgcgtaggtttgcccacggcagaagcaaccttgcaaaagcttttaaagtcctgctcgcccagcagcgcggggcaggcagcagacatagcctcaacatccaagggatagcgatgccaccacaccgcaccgcgggacagcacggggcgcgcatcccgatcggcaatacggtacgtatacgtacgggaacgcgcgtcaaaacgtgcagaaaagcctttacgggccttgtagacctcgttgatggcgatatctttgggcagcagggcatccatagcccgcagccacctacggcgcgttagggcgagctcagcgtccgttacgggcacgctgatgtactgagccacggcatgcacgccggcatcggtgcgacccgcgcacgtcagatcgatcggacggcgaagcagcgtctcgatggctcgacgcagctcacccgcaaccgtcgtctgtcccggctgctcggcaaagccgctataggacgagccatcgtatgccacgcggaaaacgagcgtggcatcgagctctggaatcgaattgaaatcagacggcgcggtcatgggcgctcccaacaaacaggcaatggcatttcgacaaaaaaagaggggtacgcgaacgtacccctcgaatatagcctatgcagacggattgtctactcagcggtctcctcagcaggagcctcctcggcagcctcgaccttcttgggagcagcggccttcttgggggccggagcagccttcttggccttaggcgtgcaaggctcggtgacgagctccatgataacgatgggagcgttgtcgcccttgcggttaccgagcttcatgatgcgggtataaccgccgttgcgatcctgccacataccctgggcagccttgtcgaagatctcggcaacgagctgcttatcgccgagcttggcgatagccagacgacgagagtgcaggtcgcccttcttggcccaagtgatgatcggatcgacgaccgaacgcagcgccttagcgcgggtctcggtggtcttgatgcggtcgttctcgaagagggccttagcaaggctcttcttcatggccttggtgtggctcgcatcggtgccgagcttcaggcccttcttaacgttgtgacgcatggtctagtttctcctcaaatatgcgaagcattaagccttcaggctcaggcccatggactcaagcttgtccttcacttcctcgatcgacttaacaccgaagttacggatgttgagcagatcgttctccgagaactcaacgagctgacggaccgagtgaatgctggcgcgcttaaggcagttgtaggaacggacggaaaggtccagatcctcgatctgcttgtccagctcggcgttgtcgttggtgacctcgggagcgaaaatcgaagcctcctcctcgacctcgggggtctcggcaaggttcataaaggcggccatatgctggttgatgatattggcagcctggaccacggcgtcgcgcggggcgatggagccgttggtctcgatctcgaggacaaggcggtcgtagtcggtgtgctgaccgacacggcaagcctcaacgagcttggcgcaacgggaaaccggcgagtacagcgagtcgacgtggatcacaccgatgggatcgttgtcgcgcttgttggcctcgccagaaacatagccgcggccatagccgatgcgcatgctcatggtgagatggccaccctcggtgagcgtagcaatgtgctgctcggggttgaccagctcaaactcggacggaataaagaagtccgcaccggtgacctcgcaggggccgtcaaccgagatggtggcggtcgcctcgtcggtcgtgccgagagccctgaagacaagccccttgacattcaggacgatgtcggtgacatcctcgaccatgttagggatggtcatgaactcgtgctgcgcaccatcgatctgaatagcctcgacggcggcaccctcgagcgaggacagaagaacgcgacgaagggagttacccagcgtatcgccgtaaccacgctcgagcggctcgacggagacacgagcagacgtctcgttgatctcttcgacctgaacctgaggcctaatgaattctgacatgtattacctccagcctcagcagcccggatggactacttagagtagagctcgacgatgagctgctcgttgatatcaccgctgatctgctcacgcgtcggcagagcgagcacgttaccagacagcttctcgatatcgacctcgagccagccagggacctcaaagcgctcggaggaaatcagggcctccttgatggggaggaggtcacggaacttctcgccgacagcgacgacgtcaccggccttgacgcggtaggacgggatgtccacgcgcttgccgttcacggtgaagtgaccgtgacggacggactgacgagcctctttgcgggtgcgggcgaagccaagacggaagacgacgttgtcgaggcgagactcaaggatgatcatgaggttctcaccggtgacgccgttcatcttgcgggccttgttgaagtagccgtggaactgcttctccagaacgccatagatgaacttgaccttctgcttctcgcgcagctgcatgccgtactcagattccttgcgacggcgcttgggctgacggatagattccttcttgctgctgtaaccgagctcagcgggatcgatcccgagctgacggcagcgcttaagaacaggagtcctgtcgattgccatattgatacgatcctttcagttacacgcggcgacgcttcttggggcggcagccgttgtgcggaatgggggtcttgtcctggatgctcgagacctcgaggccagcagcctggagggagcggatggcggtctcacgaccggagccggggcccttgacgaagacggaaaccttcttcataccgtgctccatggcctgcttggcagcagcctcggcagccatctgggcagcgaacggcgtggacttacgggagcccttgaagcccacctggccagccgacttccaggaaatgacgttgccctggggatcggtgatcgaaacgatcgtgttgttgaacgtagaacgaatgtgagcctggcccacggaaatgttcttacggtccgcgcgcttcagacgggcagcgcgaacgttcttcttagcagtagccatctatctagcgctccttatttcttcttcttagcaccgatctgacgcttcgggcccttgcgggtacgagcgttagtgtgggtgcgctggccgcggaccgggaggcccttgcggtgacgaaggccgcggttgcagccgatgtccataaggcgcttgacgttctggttgcgctcacggcggaggtcgccctcaaccatgatctggttcttatcgatataatcgcggatggcgttaacctcatcctcggtgaggtccttaacgcgcgtatccacgttaacgttgcactcgacgcaaatcttcgtcgcagtggtgcggccgatgccgtaaatgtaggtcagaccgatctcaacgcgcttctcacgcgggaggtcgacaccattaatacgggccaacgtagtctcctctcttaaccctgacgctgcttatgacgggggttctcgcaaatgacgaggaccttgccatggcgcctaatgattttgcacttatcgcacatcttcttgaccgaaggacgtaccttcatcgttcttcctttcggtagcgctcaaactacttccctactatctactcgcccagccgcaggcgtttaaaactatggctggtcttcacacacaatccgaccgtaggttgagctaagcctgcagtcggaaatggagtgcgtgtatgcgtgccgctatttgtagcgataggtgatgcggccgcgggtcaggtcgtacggggaaagctccacgacaaccctgtcaccggggagaatacggatgtaattcattcggatcttgccagaaatgttgcacagaaccgaatgaccgttctcgagctcgaccttaaacatggcattgggcagcggttcctttaccgtaccctcgagctcaattgcgtcttccttcttcacaagcaatcatctttctctagaaaacgacagcgattgagtattctacaacacgtatgcacgcatcgtaataacttcgtaatggctccacaactaagtggaacttgttacatttctccgccttggagggagcaccaagcaccttgggcatccgtggtgagaatcaccggaccatcattggtaatggcgacggtgttctcgtagtgcgcggcgggcaggtgatcgttggtcgtaacaatccaaccgtcggagcccgtgctcacatggttggaacccatcgtaaccatcggctcgatggcaataaccatgccggcctggaggcgaacgcccctccccttctttccatagttaggaacgttggggtcctcgtgcatcacgcggccaatgccatggcctacataatcacgaagcacaccgtaaccgtgagactcggcgagggactgaacggcataaccgacgtccccgatatggttaccgggaacagcctgctcgatggcagccttaaggcaatcgcgcgtgacctcgcacaaagccttggcttcgggcgtgggggtgccgacgaaaaacgtccaagcgttatcgccgacccaaccgtcgacaacggctcccgtatcgatggagatgatatcgccatcgcgcaggatcatgtcggggttgggaataccgtggaccacggcatcgttgatcgatgcgcaaatggtccccgggaacccgccgtaacccttaaaggccggggtgccgccatgcatgcggataatctgctccgcgagctgatcgagctcaaaggtggaaacgccggggcgcaccatggctccaacgtggcggagcgccatcttagatagcgctcctgccttcttcatctgctcgatttgcgttgcagacttaatcttgatcatagaccgagagcctctttgacatccccgtacacggtctcgcgagcctggtcaccgttgaccgacttgagcagaccctggccacgatagtagtcgacgagcgggctcgtggacttctcgtagacgtcgagacggttcttgatggtctcgggcttgtcgtcgtcgcgctgatacatctcgccgccacacttggggcaggtagcatcggcagcggtgccggtgtaaccgcatgcgcggcaggtgcgacgcgaagacagacgatcgataatgacctcgggggccacatcgaccagaagggcgcagtcgatctcgcgacccatggcggagagctcggaatcgagcgtcacagcctgggcggtgttgcgcgggaagccgtcgaggatgaagccctgctgggcgtcatcggcggcaaggcgctccttgacaaggtcgatcacgagctggtcgggaacgagctcgccagcgtccatgtacttcttagcctgaataccaagctcggtgccacccttgacggcagcacgcagcaggtcgcccgtggaaatgtgggcgacgccaaactcggcgacgagctcctgtgcgacggtgcccttaccggcacccggagctccgagcaatacgaggttcatgagcaatcctcctctagcctatttaaagaatccatcgtaatcatacatcttgatctggccttcgagcttatcgaccgtgtcgagcacgacgccgaccatgatgaggatggacgtgccgccaaatgcctggatcagatggttacccgtgaaggagaagatgatcgaaggcacgatggcgatgagcgccaaaaagacagcgctgggaagcgtgatcttgttgagcgcgttcttgatgtaggccgcggtagccctacccggacgcacgcccggaataaagccgccctgcttcttaaggttatcggccgtgtcatcggggttgaacaccatggaggtgtagaagtacgcgaagaacacgatgaggacaacgttaagcacccagttgagccaaccggtcgaaagcgcggaggcaactgcctgaatccagccgatgccggggaagaacacggcaatctgagccgggaagtacagcagcgccgaagcgaagatgatcggcacgacacccgcggtgttgaccttgatgggcaggtaggtggtctggccacccatcatgcgacggcccacgacgcgcttagcgtaggagaccgggatgcggcgctggccgcgctcaaggaaaacaatcagcgggataaccagcaggatgatggcgcagatgatcaccatggtgatgatgccaccggcattgccctcggtgctggagaagatagcctgcggcagaccggccatgatgttcgcgaagatgatcagcgacatgccattgccgataccgcgctgggtgatgagctcaccaatccacatgatcagcatggcgcccgcagtgagcgtaccgacgatcatgaggtcgaagatgatctcgggagcgccggcgccattgaagctgatgccgaagctcttaaagaggaagaggtaacccacggagttgaggattgccagagccagggtgaggtaacgcgaatactgcgtaatcttggtctgaccgacctcgccctcgcgggcaagctcatgcagggaaggcacgacggcctggagcatctggaggatgatcgagctggtgatgtaaggcatgatgcccagcgaaaacaccgacacatagctcaacgcgccgccagagaaaagattcaggagggccatagcacctgcggcgaccgaattgttatcggtcgagaaaaggcccagcatcccctggaagggaatgccgggcacaggaacgtgcgcaccaatgcggtacacgacgagcatagctatggtaaaaagaatcttttcgcgcaattctttgatgcggaaagcattcttaagaccatttagcacggcagctcgacctttccgccggcggcctcgatcttggcctgcgcagaagcgctgaccttgtcgaccttgaccgtgaacttcttggtgagctcaccattgccgagcaccttgacgggctcgaactcgctcttggtgatgcgagcggccttaagagcggcaccgtcgatcacagcgccgtcctcgaacttacgctcgagacgctcaacgttaacggcggtgtactcgatacgacgggggttgcggaagcccggaagcttgggcaggcgcatagccagcggagtctggccaccctcgaagccggcacccttggtgccgccagagcgggaaccctggcccttctggccgcggccagaagtggtgccgtgacccgaagaattgccacggccgacgcgcttgcggttcttggtggaaccgggcgcgggagtaagatcgtgaagctgcatttgctactcctctacaatctcgacaaggtgcttgaccttgaagatcatgccgcggacggactcgttgtcagcaatctcgcgaacctcgcggatcctgtggagaccgagggcacggacagtacggacctggtcctgcttgcaaccgttggtgctgcggacctgcttgatcttgatggtgtcagccatgcttagttctccttaccgacgaacatctcggagaccgtcaggccacggcgagccgcgacgtcctcagggctggagagctccttgaggccctcgacggcagccttgatgatgttgaggccgttgtcggtaccgagggacttggacaggacgttcttgatgccagcaagctcaaagaggggacgcacagcgccgccggcgataacgccggtaccctcgacagcgggcttgatgatgatgcggccggcaccaaagtggccgagaacctcgtgcgggatggtgccctgctcggtcaccggcacgtggaacatgttcttcttggcatcgagagatgccttggagatggccatgggcacctcagcggacttgcccatgccaacgccgacgttgcccttgccgtcgccaacgacgacgagagcgacgaggctcatgcgacgaccacccttgacggtcttcgacacgcggttgatgtaaacgacgcgctcctcgaactcggaggcctcgcgctgctgcttctgattacgagccatgtgctacatacctcctagaactcgagaccggcggcacgagcaccgtcggcgagggccttgacgcggccatggtagatacggccaccgcgatcgaaggcgaccttggtgatgccggcctcgatggcgcgcttgccaacgagctgaccgaccttctccgcagcctccttgttcgaggtgtgggtgcccttgaactcggcctcgagggtcgaggcagagacgagcgtcaggctggagcccttgctgtcgtcgatgatctgggcatagatgttggcgttagtacgggtcacgcgaagacgcggacgctcggaggtacccgagaccttgccgcgaacacgacgctgacgacgcttgaggccttccagcttcgccttatgcttgttcatacgtaaactcctaaaaaggttgatcttgccagcacctgacggggtgctggtcttatgcgagtgagtcggttacgactacttggcggccttacccagcttgcggcggatgtgctcgccaacgtagtggatacccttgcccttgtaaggctcgggaggacgatggccgcggatctcagcggcgatctgaccgacctgctgcttgttaatacccttgacgttcacgtgggtgttgtcgggaacctcgaaggtgatgccctcgggagcctcgacgatcacggggtgcgagaagcccagggagaactcgaggttcttgcccttctgctgcacgcggtaaccgacgccggcgagctcgagcttcttctcgaagccctcggaaacgccaacaaccatgttgtggatgagggcgcgggtgaggccgtggcgggcacgggtctcacgctcgtcgtcgggacgggaaacggtgaggacgttgtcctcgacgttgatagcgagcttctcaaagacatcgagctcgagctggcccttggggcccttgacgacaacgttgttgccgttgactgccacttcgactccggcgggaatctggacaggcttattaccgatacgagacacggtgatctcctttccttctacctaccgagcgaattaccagacgtaagcgatgatctcgccgccgacgttgtgcttgcgagcatcgcggtcggtcatgacgccatggctggtggaaataatggcggtaccaaggccaccgcggacgcggggcatgtcagcaacgccggtgtacttacgcaggcccggcttggaaatgcggcggatgccgttgatgaccttagccttcttgggaccatacttaagcgtgatgtgcagagtcttctggggaacggtgtcctcgacatcgtagccctcgatgtagccctcctcgtgcagaacacgagcgatctcgacgagcttcttgctgctcggcatggagaccgtggccttgttcacagagttagcgttacggatgcgcgtaagcatatctgcgatcgggtctgtaaggttcatacagattctccttcgttcttgatgaacacgtgctcttggttcttcgccgcccttaacggcaaagcctttttagcgcgttttccctgttccaaactgatgcttgaaacgctggtagtgacttaccagctggccttcttaacgccgggaagctcgcccttgagtgcaagctcgcggaagcagacacggcacaggccgaacttgcggtacacagagtgcggacggccgcagcgctggcagcgcgtgtactcacgagtagagaacttctgcttgcgattgcacttgacgatcatcgatgtcttagccacttatatcctcctcacatagagtattgttcgccccaagcgccgcccccttgtgggaacggcgcttatagggcaggtgaacctatttcttgaacgggaaaccgaaggcgtccagaagggccttggcctcctcatcggtgttggcggtggtcacgaaagtgatgtccataccgcgctggtgatcgacggagtcgaagtcgatctcggggaagatgagctgctcggtgacgcccatggagaagttaccacggccgtcgaagctcttggcggagatgccgcggaagtcgcggatacgggggatcgcgacggaggtcagacgatcgaagaactcccacatacggtcgccacgcagggtaaccttgcagccgatcggcataccagcgcgcaggcggaaggtagcgatggacttgcgggcacgggtgatcatcggctgctggccggtgatggcgcgcaggtcgcgcacggcaccgtcgatggccttggaatcggtagcggcctcgccgacacccatgttcacgacgatcttctcaaacttggggatcatcatgacgttctcgtactggaacttgtcctgaagctgctgcttgacctcgttgttgtacttggtcttcagacgcggcacatacttctcttctgccattgttcactccttcttggggttttaagcacggggcgtggccacgatgggttgtcctcgtgcctcctggctgcatccgcgccgctcatggcattttgcggtttggactcgacgcagcaggagccgacaaaacaatcggtactatacgcgcatcgggagcgtatttccagaaaaacctcgtctgcctgcacaactccacaactcccccgcacaaatggatcccaaaaagcagttgcggtgaaatagggactgtttggcggcctaacaggcttaaacagtccgtatttcaccgcaacttattggtggggatccgattagcgcttgcgggggacgagtttggtgcggcgcaggtggatcatctcggcggcgatggagatggcgatctccttggggtcctcggcctcgatggcaacgccgatcggaaggtgcagctcgtcgatctggtcctgcgtaaaaccttcctgctccaggcgggcacgcacaaaggccgtcttgcggcgcgaacccagacagcccagataggcaggcttggcacgcatggcctgaatcaccacgtcgatatcggacttgtgacccgccgtggcgacgaccaccaagtcgcgcggaccgatgggacacagctcgctcaggttcttgtaatcgaccaggcgacgatcgtagacaccgggcacccattcgggcgtcaacgtgccggggcggtcatcgcaggccacgacggcaaagcccgccgccgtgagcacgcgcgccgtcgcggcgcccacgtgtccgcagccaaagatgtaggtcaggccctcggggcagagcgtctcgatgtgcgccgcgggaatctcggaggcagcgttggtgtaggtgacgttactcccctcctccaccagtgaaagcccggggcagcccgcaatggtatggcgcgatgcctcgccatggtactcggccacatcgccctcgagcgcgctcgcgataaacggctcaaagtcgatgacgaagtcgccgatgcgccgatagaccaagacgtcggcaatttcctggaacaacggtgcctgggtcgcatccagatgcagatagcacaggcaaatggctccgccgcagatcatgccggtatcggagttctcgccgcccatggtgtagcggaccagacgcgactgtcccgcgctcaggagttcgcgcgcctcatccagcgcaaagagctcaatcttgccgccgccgatagtgcccgcctggctgccgtcggcaaagacggccatccaggcgcccacgccgcgcggcgacgaccccgccgtgccggccacgaccacgagctcgcacgtctcgccagcacgcagggcggcaagcgccgcattcacaacatcgagcttttccattgccgccttctatcctctaaagatatcggtgagcatagcgagtgcctcgagcacgccgccgccgaccgacgtcgccttgtccgaaatgtagttgatatagctggcatcgccacgcggatcgacatcggcgcatttaaagccctcggtcacctgcacgccgttcgccaaaagcccgcgcagacagccatcgatctgcgtgcgcatgggcgtatcgcccgcgtagccaatcacgtctccggcgcgcacgatgtcgccgattgcgcggtcggaccgaaacacgccggcggcggggctgtggataacacgctctttgccatatccggcgatgacgcccggcacgcccgtgttgggctggggtgaaccttgggtaatgacacggcccaggaaatgcccgcgcatggtctcgaccacggcgtcgcaatcgaccggcgcggtaaagcccggccccacggcgatgacggtaggcgccatgtcgcgcgtggtgcccaggttgcgcttggccagaatcgcgtcgaccacagccgcgggtttaagctcatcgagcatcttggcctgagggtccaccacgacggcaacatcccccgcttgggtaatctcgagcgcctctgccggcgtctgcgccaagcgagcgcgaatgccctcgacctggacctcgcccaggcgaatagcctcgcaaaaactgattgtgcggcggatgcacgtgggaaccgcgatatcggccataacgaccgacacgccggcgcgcaccaagcgagcggcgacacccgtggcgatatcgccggcgccgcgaacataaacgagcattcccggggcacctccctgtgctacggtttgagcagagcaaaagcggttcgaccgctactctgatgattatttattatcacagtattatacggcggtgaacagatggaaacggttagcggcaatcttgcctcggcgctcaggatcgagccgggcattaccgcgattatcggcagcggcggcaagtcgacgttgctcaaaacgctgggtcttgagctcatgcgcgctggcggccgcgtgctcctctgcaccaccacgcatatgttccccgtcgccggcgtgccgtgggacgggtcgagccgtcgcctggacgccgcgccttggaagccgggcgcctcgcatgtccccggttgcacctgcgaggcatgcgcgggcatgagccgcggaagtatctgccaggcgggtgttttggacccggagacgggcaaactctcctcccctgccgagccgctcgaccagctggcgcaacgctttgactacgtcctggccgaggcggacggcagcaagcggctcccgctcaaggcccacgccgcctgggagccggtaattcccgacgccacggcaaacgttgtctgggtcgtcggcgcttcggggctgggcaagcccgtcgccgaggctgcccaccgccccgagctcttctgcgagcgctgcggctgcgagcccaccgacgctgccaccccagagcgcgtcgccatggtgctcaatgccgagctgcgaatgctgaacctcaacaatgcccgcatcatgctcaaccaagtcgacacgcttgccgacccaacgatggcagattgcttcgaggcagccctcggcagccccatcgtcgccaccagcctcaaggggtagctaatttgggacggggctcttttagctaccccatgttgagagaaaaatcatcaggcaggcaagggtagctaaaagagccccgtcccaaattagctaccctggcggccttcctgctagcgggggacgtagcggccgggttgggctccggtgggctcgccgtcgcgtgccaccagcacgccgttcacaaacacgaccttggcgcggccatgtgccccaaaaccctcgagcggcgtgtagtccacagcttgatgctgtgtcgcggcactgattgtccagcgcgctttgggatcccacacgcacacatcggcatcggcgccctcggcaagacagcccttgcgcgggtacatgccaaacacgcgcgccgggttctcgctcatcaagcggcacagatcctcggggcccagctggccctcaaagctcgtggcaatcgcgacgggacgatgttccacgccgggcccgccgttgggaatcgcgcggaaatcgtcgcgcccgcggtccttttgcccgtgcaggttaaagctgcaatgatcggtcgcaatcgtatcgatctcgccggccacaagcgcctcgcgtagcgcggcacggtcaccggcatggcgcagcggcgggctcatcacatacttggcacccgcaaagccgtcctcgccctgctccaagtagcaagtatcgtcgagcatcagatactgagggcaggtctcgacatagatgttcttctgcccgcgcgctttggcggcgcggatggcctcgagccccagcttggtcgaaaggtgcaccacgttgaccggtgcgtcgccggccaggtgcgccagatacagcagacggctcaccgcctcggcctcgcacacgtccggacggctgagcgcatggccctcgggtccatgaatccctcgctcgtacacgcgcttctgcagttcattcaccagcgtgccgttctcgcaatgcacgcacagtatgccgccaatatgtttgagctcctcgagcacctcgagtgtctcggcatcgtccaagcgcaggtggtcataggcaaagtaggtcttaaacgacgacacgcccgcctcgcgcatggccgaaagatcggcgcggttgcgctcgttccactcggcgagtgccatatgaaaggcgtagttggccgtgcaggttccgccggcgcggcgatgccactcggccaaggcatcgggcatggtcacgccgcgatcggccgtcgcgtagtccacgatggtcgtcgtgccgccgcaggcagctgcgcgcgtgccggtctcaaagctatcggctgtccaatccatgccggtccagcactgcatgtgcgtgtggccgtcgataaagccgggaaacacccagcagcccgcggcgtcctcgacggtatcgccctcggccggctcaatcgccgcggcgatccgcacgatcttatcgccatccatggcaagatcggcgcggcgaagcccctggggcgtcacgagcgcgccgtttttgatgatgatcataattgctccttattgattgatgctgttggccacgcgatcaaaatacgagcaggcggcgatatgctccgttatgcgtcgctgtcccttggcggtatcgacgtcccacagctcgtaggcacgcgcctcgaccagcaccacgtcaatacggtccttgaggatcgaaccgccgccgtccttgccctcaagacgcatgagcgcatcgaacagttccgccggaaagagcaccgggctcgaaggctcaccgttgcacgcaagacgcaccggatgcttgcggccacgttcgtcaaatgcacgaaccatagcctcaaaagaatccgaactcacgagcggctggtcgcccggcaaaaagaggcaacctttccagttgcgttcgactccccacgaaaggcccgcacggacgctttcgctgcgcagctcgccatcgtgcagcacgcacgggcaatgcttgtcctcgcaaatctgagcgacctcgggccaacgcgtcgaaaccacgacgtcaaagccccggggaaccgaatcgatggtccgggcaatcagcggctcgccatagatatcggcaagcatcttgttagagccaaaccgcttgccctcgcccgaagccataatgacgcatccaagtttcatggtgatacctcccctgaaaccatcgtacccataactcgcgccgcgggcatctacatcgaaagcgcttatcccgcacgcccgcgatgcaaaaaggggcaccccgccggttggcagagcgccccctttacatggcttacctcaacccggctttaggcctggaaccaacgggcggtgttgcgctcgtcgagggccttgagggtagcggcgggatcggcaaccttctgcaggaacatcatggctgcgatggcgtacggcttgtagctggcctccttgtacatgcccacgcggtgcatgtcgaagacgtcggcgttgacctcgccgtgctcgcaggagacaccggagatgtcggcgggcagcgggtgcataaagatggtgtcctggccgttggcagtcttctccatgagctcggtcgtggagcaccaatcctgatgggtggcgttctgagcgagcagctccttctcgagcgcagcgatgccggcgtcgtcgccctcggcgtacaggttggtacgcttctccatggcggcaaacggagcccagctcttggggatcacaatgtcggcgccttcgaaggcctcggccatggtgttgacctgcttaaaggtggtgccggactcggcggcatagcccttggcgcgctcgacgacctcgggcatgaggtcgtagccctcggggtgagccagggtgacgtccatgccaaaacggggcagcaggctgatcagcgactgcgggcaggacagcggcttgccgtaagagggcgaataggcccaggtaacggcaaccttcttgcccttgaggttctcaaggccgccaaactcgttgatgaggtagagcatgtcggcagaagactgcgtggggtggtcggagtcggactgcagggagatgagcgtgggacggtgatccagaacgccgtcctcgtaggcctgctgtacggactcggagacctcggccatgtaggcgtcgcccttgccgatgtacatgtcgtcgcggatgccgatgacgtcggccatgaaggagatcatggtagcggtctcgcggacggtctcgccgtgagcgatctgggacttcttctcgtccaggtcctgcagctcaaggccgagcaggttggcggccttagagaaggagaagcgcgtacgggtggagttgtcgcggaacagcgagacggcaagaccggagtcgaagatcttggacgaaacgttgttctcacgcagctcgcgcagggcgtcggcgacgatgtagagcgccttaagctcatcggtggtcttgtcccaggtgtgcaggaagtcgctgccgtacatacccttaaaatcgaggccgttcagctgctcgacgagctcggtaaacttagcgtccatggaaatgtcctttctaaagatgaaacgatcgcaatgagtagatgtgctccgccatgcgcgtgtggctagaacatgcagagcaccatgacgaggacccgccaccgttgaggaagcatgggagataacgaccgcgggccccaagtcaacagggggtgccggggacacgagcggcccccggctcaacaaaatcgaggaatgggactaatcgatcttgttgttggtcagaccggcgcggaacacggtggcatcgccatcggcctggctcggatcgtagaggttcagggcagccacgtacatggcggcagcggtgaccaggtcgtccttgtaggtgacctcgttgggagcgtgagcctgagactcggcacccgggccaaagcccacgcaggggatgccgtagcggccctggatggaaacgcagttcgtggagaaggtccacttgtcgcacagcgggcgaccggtgcgcttgtccatgctgggctcgcagccgatgcgctcgtcaccaaacatggccttgtgggcgtcgacgagggccttgacgtgcggagcggtctccttgttgatccacgtggggaagtaagcctcggtctcgtagacctcgccggtccaggacggacggtcgtacatgtacatggagaccttcacgtcgtcgccgtacttcttggcggccggcaggttgcggatctcgtccaggcaggactcccaggtctcaccggcggtcatgcgacggtcgatggagatggcgcaggagtcagcgacagcgcagcggctgggactggtgtagaagatctggctgacggtgcaggtgccgcggcccaggaagcgggcatcctcgaagtgctcggggttgtacttggggtcgagcatcttgacgagacccttgatgtcggtcgactcgtcgcagccgttgttgttgagagcgcggacgtcggcgatgatgtcggccatcttgtagatggcgttgtcgccgcggtcgggagcggagccgtggcaggaggtgccgtgaacgtcgacgcggatctccatgcggccgcggtgaccgcgatagatgccgccgtcggtgggctcggtggaaatgacgaactcgggcttaatgccgtccttgttgtagatgtactgccagcacatgccgtcgcagtcctcttcctggacggtgccgacgaccatgatcttgtaaccctcggggatgaggcccatgtccttcatcatcttggcagcgtaggtagcggaagccatgccgccctcctggtcagagccgccgcggccgtagatgatctcgtcggtctcgtagccctcatagggatcggcgtcccagttctcaatgttgccgatgccgacggtgtcgatgtgggagtcgatggcgataatcttgtcgccctcgcccataaagcccatgacgttgcccaggccgtcgaccttgacctcgtcatagccaaggctctccatctcggccttgatgcaggcaacaacctcaccctcctcgcaggactcagagggatggctaatcattgcgcgaagaaaacgcgtcatatcagcacggtgggactcagcagcagccttgatagcgtcgaaatcgagttctttagccattgttcataacctttcaaacgaaggaatctacctgtgaggtggcggagcgatacctatttactccgccccaacgattagcaagtgggatattcgccttcccaaacaatgcggcgatactggtcgggatcggtgtcgccctcggtggagaagcagagcacggagctcgtcttgtccaggccgatgagctccttgagctcggcgtactcgggatcgagcatgagggtctcgaccaggccggtggtcacagcgccggactcgccggagatgacgcgcgggtcgcccttctcgggggcgcctagggtgcgcatgccgcgagcggtgacccagtcggggcaggacacgaaggcggtagcgtggttgcgcaggatatcccagcccaggatattgggctcgccacagcacaggccggccatgatggagggcatgtcgccgtccacgatgcgcgggtcgccgtcgccggcggcagcgcccttgtacaggcaggcggccggagcgcactcgaccacgacgaaggtgggcgggttatcgggatacaggttggtgaagtagcccaccacggcgccggcgagcgaacccacgccagcctggacaaacacgtgcgtcgggcggttgatggccatctcgcgcagctgctcggcagcctcggaagccatggtgccgtaaccctccatgatccaggacgggatcttctcgtagccctcccaggcggtgtcctgaacgatgacgccgcgctcgcaggcgtcggcctcggcggcggccatgcgcacgcactcgtcgtagttgacctcttcgatggtcaccgtggcgccctcggcggcgatgttatcgaagcggggcttggtggaacccttgggcatgtgcacgacggccttctggccgagcctgttggcagcccatgccacgccgcggccatggttgccgtcggtggcggtaaagaaggtggcctggccaaagtcctcggccagctgatcggaggtcaggtaatcgaaggtgcagtcggcaacgtccttgccggtctcgtcggcaatgtagttggccatggcaaacgagccgcccaggaccttaaaggcgttgaggccaaagcgatagctctcgtccttaacgcacaggttggataggcccaggcgcgcggcctggccgtccaggcgggcaagcggagtgacggtgtactgggggaacgactggtggaaggcacgggccttcttcacgtggtcgagactcatgattcccaagtgcttgtcatcgctcttgggcatcgtgttgctcgcccactggatcttatcggccatacggtgaactccttaagtcctctcttgccggcccccgcatacgcgtttcagcccgatcccattcacacggctgaacttttatgtggatgccaaacaaaaagtttgttagtactgttctatcacactttttgattggcatacctaacgaattgtttgttgccgtaatcggtactttttcgccgccgaacggtcatgaattgccttgttgatggatttgtttgcggccaagtgtggtttatggcaaagtgtgcccaaactaatttttaggaaggcaaccatgacccccgcacagattgagttttacaagcgcctagcacacggcctggcgctccaatttggccccaactgcgaagtcgtcgtccacgacctagagaccgaggacgtggaccactccatcgtagtgatcgaaaacggccacgtcagcgggcgcaaactgggtgacggccccagccatatcgtgtttgagtccatgcacgagggcgccaccgacgtacacgaccgcgagccatacctcaccaaaacaaccgatggcaagctgctcaagtcctctaccatctttatccgcaacgacgagggcaagcccgtcggcattttgggcattaactttgacattacgctcatgaaggcttttgagcgctcgctcgatgcctttaccggcaccggcggcacgggctataccgagcccgagcccattaccaagaacatcggcgacctgctcgaggacctgctgcacgagtgcgagcagtttgtgggcaagcccgcggcactcatgaccaaagacgagcgcattcgtgccattggctacctcgaccgtcgcggtgccttcctcatttccaagtcgagcgagcgcgcctgcgagttctttggcatctccaagtacagcttctatagctacctcaatgaggccaaggcggcggccggcgacaagtaagcgctcgcctggattgcccctccccttttgggcgcgagttctggaaagcacgaatccaagaccgagcagcttgggaagttccatataatcgatgtcattagtatttcgaaaggatggaacagaatggcgttgagcaaggcatcatgcaccggtcgcggattgattccggcaattggtggacatgtgcaccgcatgttcgatgagggtgaagacgacctgttttcgctgagccttgacgacgtgatggatgatcgcccgtggaccgccgacgaactcatgggcggcggggctcgcccgtcaaaccccaatcccgcacttgcgcctaagcccgcatctgcgccgacccctgcgcagtcgcccgcacccacttcggcgcccacgcccgctccccgccccgcaagcgacccgtccgagacggcggcatttctcgctgcagcgacgcagggcaaatcggccgacggcaccgttatgtataacgcccagcagttgcccgttcctgcggcgcgcaagcctccggtcacaaggctcgatgagcccgttgcccatcaggttgcccacgattcctgggctgcagccgatctggatgagacctctaccggcatgccggcgctcgatgttccagttaacccgctttttgccgccaacacgagcgccgcggactatgagggcggtgaggcatattccgattattccgatggctatgctggcaacggtcgcatcgagaccgaggattatggcaccgcatcgagcgattatctcaacgatccgtacgctgccacgcctgcaccggaatatgacccggaggccgcatccgcaccggcgtataccaaaagcacgggcgaagagcgcttcgccgattattacgccgaggaaaaggcgctgcgtttctcggaatttccgcaggcagtcaaggttgcctttatcgccattatcattgccctgctcggcgtcattgcgtttgagggattccagctgttccgcggccccacccaagcggagtcagagacccagcaaaaagaggacgataaccagtacctggacatcaacaccctcaagggcgaccccaacgacggggacgacgaatagcgagagctgaaggcagccgcaggatctcgcattcagcatcggcttctaagtgctgttttgtcatccagctatacttttggtatgtaaaataagtagttggaaaaaatcaaaagctatttcgattatcggcctaatacaaccataattccaaccaatggttttagaaacggtatttagcggttcccaaccatttatttaccgttctcgacaatacaatcaaagtcaatcagttcaagctgctctacgaatttctccaaatacgaaacgacttcctcgttgttgacgaatagcggcctgtcttgcgttagcctgcctgatttgtcctgcggatagcggagactgatgccgttgttatcgatgtcagcaacggcttttacgaaagcacccatgttcttgatggttctattgtcctcacggcacttttgcctcggaaaccttgagagcaaagagttccacaagctcgtgaggccatgatctctcttaggctcagctccacacctttttatcgcccttttaattgcaagctcaatacagtgccttgtgaggaacattaccggaatcgcgtaggaatactccagcatcaaatacataccaggcttgtcgattgctttcctcccagcggccgcaagctcctttgcggcattgaggaaagatcgtatgaactcatcatcgaacctatcggctttaaactcgtccttcatcaaggcagacgagtccaacagcgagaaatccctcaaagtggggtcgttgaagccatccatctgagacttcatgacttgttggctcatgtatttaggaaacacatggtcattgaacacactctccatcagagaatctctcccgttttcgcgtctatcttcgctcccgacctcgagccgatgaactcatccaccatctcgtcgtcgcggtcgggcccggtcacgaagagcggtcccgggacgtcgacgcgcgggccaatcgtcaggccgttgctcgcgatgatgcgatcgaggttctgtctacggtggagcgagcgggcccgtagtgtgtcgaaggaatagccccggccccgcacgtctgtcccgttgatgagcctgttggcgcactcggcgtagccgttcgagatgcggctcgggcagttcccagtagtgtcggcggggcgaaacacatcgtgcacgtagttggcgatacccaaaatctcgttcacgtagtcgaacgcggacttctcggccatggtcggtcctctctggcaaagacgatttcagccagagattttacaagttcaatgagttgcttcgctttaaatccaaccattggcttaacaaaacggtaggatgctttcttcaaccagaaaactaacaaacccaaccagttattttacataccctatacttttccggataatttgcctatcgaattagacacttttttcccgaagttttaaggtgcctatttcgacacttttccgtacttttacacggctgatttcgacactttccggatgaaagccgaataatcacttgcgaaaccaacgccgttcacacgtcatttcgcaggcagcgcttgatttctgtccgcacacgttgatagacttcctcttgcccgcaaggagcgggcgcgttttatccagagtcggggtagagagttggctccacgatcccgacgccaaccggccaagaggcacggtggccctgccaacatcgatgaaaggaatccgtatggacaatttctctgtgcgcagtaagcgcaacttccacaacctggcagccaagccaaaacgaatgcatcttctggacgagccgaacggctacgcctcggccatggtcaagagcagcctctcccaccagatgcgctttatggtacagaagctcgaggaaaagctctgtgctgctggcaatccgcatgtgctgcagattaagctgctcggagacgactcgcgtgagccgtctagctggaagctttttgccgacggtgagtgcatcgcggacggctcgggtgactttgcccgcgaatgcttctgcgagggagctgaggtgtttctggacctgtgccgcgacgccgtacgcacagctgagctgcgccagtggagtcagagggagtacgagctgttgagtgcggcccgcgggattgcggggggtgtaggagcagaagcctcatgacggtggcctcagctggaatgacgtatcgctcgataaatgatctcaacaacgtagccgatgcgctgcatttcatctcaaaggcattgagcgatcgggcggcgtctagcatttctttgatatccccaattgattgttccgagaaagtctcttcatgccctcataatcgcccttacgagaaacttgggcgagacaggcgtccatatgccgtctctaaactaacgagccgttcgcggaaagaacatctggctaacgtgggccaaagatatactggtatcgttgcagcaattatggaagatcggtgccgccaatgacctccttgaaattccccaggcgctttgcacttagcctgctcgtcccgttgtccgccgccgtagcgctggctttgccctcaaccgccctcgccgcgtcagacccgaacccgcccagcatatccaacgtgacgatatccgcaacggtcgtcacggcaggctccacgctgcgtgtcggctacgatgtggacgaccccgatggggtgcggtcagtcacgccgatagtcgaggtcgtcgtcgatagcgatgacggaggccaaggcaacagctcccgtctcgccttccagtcgaccggcgacacgaccgcgggcttcgatatccccacctccccgagcgaccagccctgcaggtatcgcatcatcggcctcggcgtgaccgatagccttggatgggttaccgatgtctacgacgcggcgtatgccgaggagaaggggctcgactgtccgaccttcgccaccagccctctcgtctatgaggtgaccgaggggcccgcggaccagaacccgccgaccgtgtcctccgtgtcgctctcgagcagggaggtcgcgaccggcgccgacttccacatctcttggtctgtcgcggacccggacggcgttcgctccgtttcccccatactgcagcggggctgggaggataaggacgacggctgctccgtttcgtcggcctattatcacggaggctcgtctatcgacgggttcgacctcacattcgacagtaataggatcggaaggcacaggctgatcggcctttcggtcaccgatgacctagggttcgagaccgatgtgtacgagagttcctacgccagggccaacggcatctcgggcgcgactttctcggttgccgacccgagcgagctgtgcttcgaggtgaccggcagcgcgatcgaccggaacccgcccacggtctcgaacgtttccatctccgcgaagagggtccctgtcggcggggtcctccgtatctattgcaatgtaggcgacgcggacggcgtgaagtctgtctccccgatcctcggcgaccccggctatgtcgaagacccgaactcggcaaaaactcgcaaaatgttgagctgcaactacgatgcggcaagaggctatatcgaaatcgagttccccacgtcgctctcgatgggctcgtttgaaatccatgccctcgcggtcctcgacaaggcgggtcatgagaccttcgtctacagctccgcctacgccgagcgtaacggcaagaccggcgttcagacctttgatgtcgacgacgcgggggacgtcacctttgacgtgaccgccccgctgtatgccgccaccaagggcaacggacaggcgtatgcaaaggacggcggggtcggcctgaccttccgcttcagcggtcctctcgatgagttcgcgcgtctccttgtggacggaaatgaggtctccgctgagaactacaccacaaccaagggcagcacgattatcgagctcaggccggcctacctagacacgctcgccgccggcggacacaccgtcacggctgtctggaaggacgggacgtcgaccgatgcgtccttcaccgtggaggggaagacccaaggggagcaagcgggcggcaagaccgatgtagattcacccggcgacaacaaaagtgatcctgccactcctgaaaaggacgccgacgaggcgtctacaaaaaggtcgggacacacgacagccgatgaaccaaagctcgccacaaccggcgactccgcttggatggccagcatcgcattagccatggcggccacggcctgcttcacggcagcgagaaggcttgagcccaagcagcataggcacgaacagtagctcaaagcgaactcaactgggaggggcagatggatagccgtccttctcttacaatcaacccaatccgctgaaatgcaatcagttaacgattttcgccagatgctcggtctctaccccgctctggcaagccaccaggcgatgagataatgcccacgactatcaacgtaagcaaggagcgcgctatggcagacaacgagatcaaaccctcgacggacgatggccgagaagaactcgtggcaaaacagctcgcatccaccaaaatccacctcgcgctcacctaggagcgggtggacgtctccagcgccatcaagctcccactcgaacgagtcccccagctcggcatagcgctcgcctcactcccctcgacgttccgtaccgtctccaacacagtaagcgtgcccatgctgctccagccgaccgataagcttggcaatccgcttgacccgtcgatactccaatcgttcaaggacggcagtggcctcatgggatcctatcgcgatgcggccaagggtttcgggcaggcgcgcttccacgtagtcgagggcgacatcgccacaagcgtcacgcaggtgccttacgatccaacatcgctattcatggcagccgcaatcgcgcagataaaccaaaagctcgactccatccaggagtccgtcgacgagatgttcgagtacatgcgtcagcgcgacaaggccaacatgcgcggcaacctcaagacgctcgcagacatcctcaacggttacggcctcaactacagcaacgccacctacatggcaaacgcccatatgaaggtgctcgacatcaagcagtcgtccgcgcaggacatggaactcttccgctcgcaggcgcaggcagatctgaaaaagaaagggttcatcgaggtgcgagacggcttgggcagacgcctcgacaaggtgctcgaatacctcaaagactgccagctcgccacctacatacacgcattctcgctgttcctcgaacccatgctcgcccagaacttcgagcccgcaaagctcgcggatgccaccgcgaagatcgaggccgattcgctcgcgtaccgtgagctctacaccgagtgttacgacgcccttgaggcaggaactgccgacaccgtcgattcggcgctgctgggcggtatcgcatccgcgggcaagctgctcggtcacgccatcgcaaagacccccgtgggcgaccatacactcatcgacgaggcgctcgagggcgcgggagaggacatcggcaggttcaacgacaggcaatccgagaaactcctcgagaagctccatcaggcaaagacgcccgacgtcgcgccgttcaagcagagcgtaaaggagatcgacaccctctacaaccgccccacgcagatcgccgtggacgccgagaacgtctacatcttgcctgccaagcagcaggaagagtagcgatacgcgacaagcatgcgccaagcagacagctaacgcccctacctcccctccgccttcagcctcagcagcaggtcgcccagctcagggcacttgctggagaagcgcgtccgggctcgctcgcccatcctccatcgctggcggatctcctgggcacgcggactcacgcgatagttcccgtccatcacttgcttgagcaacttggcggccacgcgcgcatcggctagagcgctgtgagcgtggcccgtcgactcgtcaaactcgatgccaaaccacgttgccgcgtcactcaaagagacgcgcccgtggctgcccacgtccatgatcgaagtgtaaaacgcctgcaggtcggcccagtccgtaggaaatgcggcaaggtcgatgtgctttgcttggcactcggtcaaaagctgtcgacgatctgccccgctccaacagaccacctgggcggagtagcgaccaatccaatcgctgagccttttgatcaccacatagagcggatcggccatcgcggtgtccacggccgatatccccgtaagctcgcggacggggaacgcaacgccttcggtaaattccgtctgcacaaactgcgagaactcgcccataacgttaccgtggtaatcgagcttgacggcgccgacctcgataatctcattgcgcagtccacgtcgctggcgctgctttggcaccagcgcaaactcaaagtccagcacaatctggcgcgcaaagttcgtcgtatcgatagccgagatgcacggcgtcttttcagctgacacggttatggcctctctccgtcaaatgccgctcgttacataagcggctacattgccgtaaggataggcgctcgtgcggacatgaaagcggggcgcaataccatgcgctggtcgcacgccatgcagacggccccaagagaatcgcccgctctattcaaatgcatgaaaaagatttaggcccggtgacttgaatcagcggtcatcccgggcccatcaatatgcagtgtacctacagagggctggttaatcaaacgggctttcggtgacgaagacctgcgcgtctatccccaatcgcccagcgccgtcttctgccgcccttacgaaaggctgctattcgagggaatcacgttgctgttattatcgaacatatattcgtatttatgaccgcgctttgatagaatggcagttgttgacggcagttccatgtgccgggcagcgccctccatgcgacgggaggtgatgcccatgaccgatctgattgatttcgtgaagctcctgaccgctttggtctcgctcctcacggcgcttatcggactttccgaggcacttaagcagcgtacgaagcaaaagacgatatgagaaagccattggggtcgcctcccccgcgttgcagtttctttccgccgcaggaagcttggatacgcctaggcgcggtccaagaaatcgtccgcacccccaggtaggaactattccaccgcaacctttttcctccgtccccaagggatcatttggcggtgccgttaagcggaaggggtgttatcggcggcctccttttgggcatacaatggctattggtttgctgcggtgaaggtctgtccgctccgcagcttttttctacggttaaaggagtatgtatgtccgttgaggtcatgagatctgtgatcgaggccgccgagggtcgtgtgcccgttgacacgctgtttgccaacgcacagattgtcgatgtgtacggccagcgcgtggcgcccggtagcgttgccgtcaaggatggcgtgatcgtcggtgtgctctacgatggtcgcgacgatgccgccggtacgtatgaggctgccgaggtcatcgattgccagggccgctatcttgcccccggttttattgacggacacttgcatatcgagtcttcgaacatccgccctgccgagtatgcgcgcatggcggcggcgcgcggtaccaccaccgctattgccgacagccacgagatcgccaatgtttccggcttggacggcctgcgctttatgatcgaggacggtcgtcgcgctcctatttccatcaagtacatgatgccctcgtgcgtgcccgcactgcccgacgagcaggccggtgccgtcatcaccgctgccgatatgcaggcattttttgccgaatatccgggtgatgtctttggtctgggcgaaatgatgaacctgccgggcgtctttatggccgatcccgagacctgtgctcgtatcgacgctgccaaccagacgccgtccaaacaggttgacggtcacgccccgctcgttgccggcaaggacctcaacgcctatgccgcagctggcattatcgccgaccacgagtcgacgattcccgaggaggcgctcgacaagctatctcgcggcatgtatgtgatgctgcgcgaaggcacgtgcagccatgacctggccaatctgtctccgatgctgctggaaaaccccgcccgtgcccgccgctgctgcttcgcgaccgatgaccgcgctccctccgatgcactttcgaccggcatgatcgacaacgcctgccgcgtggctatcgaggccggcattgaccccgtggttgccatctctatggcgtccctttccacggccgaggcgtttggcctggaccacggttgccgcgacccgcatgagctgcgtggcgccatcgccccgggcaagcgtgccgacctgctgttgctcgatgacctgacgtttgctaaggctccgcatcgtgtttatgccgccggtgctttggtggcgcaggacggcacctttgtgggcgagattgcacccgagatggccgaggttgcggcccttgccgatgagctgcgcgcctccgttaggctgccgaagctttcgctcgacgtgttcgattatgcctttaagccgggcgaggcggttattgatgtgatccctggcatggctatcacgggcatggttcgtcccgagactgacgatgacttgcgtcgcattatgcttatcgagcgccatggccgcggcgtgtcgctgcaggccgagggcgtcgacggcgacggtcccgccggcatggggctcgtcggcaagcatatcggtcgcggctgggtgcgcggcttcaccatcacgggcggtgccattgcctccacgatcggccacgactcgcacaacgtgtgcgtggtgggcgacaatgcggcggatatgatggctgccgttgaggccgtgggccagggcggccacgtgctggtgcgcaacggcgaggtcgtggcgcgcattccgctggcgctcggtggccttatgagcgagggcacggccgaggatgttgccgcgcagcacgacgactttatggtcaaggcgcgcgccatgggtattgagccgccgctcgaccccatcatgggcatcatcttcctgcccctgccggtcatcccgacgctccgcatccgccccgagggcatgttcgacgtcacaaccttcacctacgccgactagtcatcggggacgttcttaaacgactagtcatcggggacactctttggcgggctgcctgacgccgcgaccgtaggacctctggcatgtgtgagctatttgccaggtccttgtaacgtttacgcccgcggagtcttatttgagctccctttgggtacgttggaatcggatacgcgtctgattccaacaagcccgaagggagcttttctatgtttaaactgattgcatccgatatggacggcacactgcttgacgaaaacggccaggtgcctcccgagacctatgaactgattctggcgctacacgagcatggcgtgcatttcgccgcatcgtcaggtcgtcgctacgatcgcctgtgcgagttctttgcgcccgttcgcgacaagatggactttgtcgccgctaacggcgcccaagtctacgccgacggtaagatggtagaccgtgaggtgtattcccacctggcgattcgaaggctcgcccaagccgtcaggacgtttcccaatctgcatcttgcgctctttgaccgaaccaagtccttcctgctcgatgacgagtgcaagttcgtgcgtgaggtcgataaggaccttcccaatgccgagcgcatttgggagctgcccgatcccagcgtaaatatcatcaaagcgagtatcttttgcgacgacagtgcggttatggacagtgcgtacgtgctacagcgcgaactcggtcagctctttacctttgcgccttcgggcaacgcgtggattgatgccatgcagcccggtgtgtcgaaggcctcgggtattgcacagctcgcggagcattacggcattgggcgcgacgaggtcatggcgtttggcgactcgatgaacgactacgagatcattcgctttgtcggcacgggctgcgcgatggaaaacgcgcgccctgcgctcagggcggttgccgatcgcgtggtgggtcgtaaccgcgaccacgccgttcagcaggagctccgccgcgtgctagagggcctcgcttaatccggcagctggggacgttcccgttctgccggcagtgggggacagtccttgcagcttttcacgaagagtgtccccaacgactagtcattcaagaacgtccccaatgactagccgatgactaggcgagggcggccatgatggtgcgggcgacgccgtcgtggtcgttgtcgaactcggtgatggcgtcggcggcggcgcggtcttcgggctcgccgttgatcatggctatgccgtggcctgctgcctgcagcatgggaatgtcgttgatgttgtcgccgaacgcccaagcgtcggcgagacgctcgcccaggtgctcgcagagccacgtgagggccgttcccttggtggcgccctcgcccatgacctcgatattcatggcgtacgaacgcgtgacttcaatgcctccgagcgtgtcgagttccgccgcgatggcgtcgcgatcagccgggttgtgccagtacatggcgatgcgctcgagcgtctcgacctcgtcgatcttgctgtcgatatccatgtcgatcggtgttcgtgtgcgcttgagcgaagccgcgatgtgggggtcgccgccgcagaattcgtccaggcgcgtgtagagcgagcgggggaggaagcactgcccatccgcgaagatatcgaaggtcacatcgtggccggcggcgatgcgatggatgcgatgggcaatgccgcaatcgagcggacggctcaagatgcacgtggcgcgcgaggcgtcggtgggcacatcgtcgtcgagctgccagacgctggcgccattggcgcaaacggcatagtgcacggcggtatgggcgaggatgggctcaaagatgcccgacagcggacgtcccgtgcagggcacaaattcaatcccgcgtcgagcgagctcgtcgagcatcgcccaggtggcatcactcatctgcttatcgctcgtcaacagcgttccgtccatatcggaaaacacaatcatttgatgcagccctttctgctggcataaaaagcgtggccgagggcgatgatgccctggccacgctcgggttctataacggtccgcgtcctagcgatcggcgagcggcttgtactccagcggctcgataaccgggcgatacgcggggcgaataatgcggtgcgcgcagaagagctcttccatgcggtgtgccgaccagccggccatgcgggcgacggcgaatagcggcgtaaaaagcgtctcgggtacgccgagcatcttgtagataaagcccgtgtacaggtcgatgttggcacagatgggcttggtcatgccgtggtcgcgcatcacctgcggtgccaggcgctcgatgcgctcgatgagcgcgaactcctcgcccaggtccttcttggcggcaagcgtgcgcgcgtaacggcggcagacctcggcgcgcgggtcgctcagcgtgtagacggcgtggcccataccgtagatgagacccgtgccgtcgaaggcctgcttgtcgaggatcttgcccaggtaggctgcgacctcgtcctcgtcctcccaattggagacgtgcgcacggatgtcctcgtgcatggacacgaccttggcgttggcgccgccgtggcgcgggcccttgagtgagccgatagccgcggcgtaggcggaatacgggtcggtggccgaggaggacagcacgcggcaggcaaacgtggagttgttgccgcctccgtgttcggcatgcagcatgagcatcacgtcgagcagcatggcttcgtcgcgggtgaatgccatgccgccgcgcaggacctgtaggatggtctcggcggtggagaggccgggcgtggggtgcggcacgtgaacttcggagccgcgaagcttggcgaccgaggccatgtgtgcgaaggcggcgatgcgcgggagacgtgcgagcatggaaatggcgacgtcgatttcgtgctcgggcgtaatggcgtcgggctcggcgtcgaaggcgtagagcagcagcacggcgcgctgaagcacattcatgatgctcgacgacaccgtggtcatggggaactctttgacgtactcatcgctcaggtgcctaaaagcgcccagacgtccgcaaaaaccgtcgagctcctctttgttgggcagcgagcccgtgatgagcaggtaggcgacctcttcgtagccatagcgattctcggcctgggcgttgttgaccaggtcctcgatgctgtagccgcgcagcgtaagcttgccctggtcgggcacgactttgccgtcgaccttgttgtagccgtgcacgtccgagatgcgggtaaggcccgcgaccacgcccgagccatcggcattgcgcaggccgcgcttgacgttatgctctacgaacaggccctcgtcgtacggggcggtcggcaggccgtggtagaggttttcgctttcgggcgaaatctgacggctcgcctcgtaatccagaaccaggcggctcaggtgatcgtcgaagcggtagtagattttcttggcgtcgtaggccatgcgcgctcctctccggtccgctttggggccgcgcgcttggacgatatgacgtcaagctgccccgagcggcttgttcgctacaggcggtacataaagttaaagacgtcctcgcgctggatggacacgttgacgcccgaaagctcgccggcctcggccagggccttctgcagctcggcgaagtcgagcttggactcggcggtgtcggccagcatggtcatggtgaagatgtcctcgataatggactgcgtgatgtcgcggatgtcgacgttggcctcgcccagaacgcgggtgacgccggcgacgatgccggggcggttcttgccaaggacggtgatgacgatacgggaggacgagatctcggccatgggaaaccctttcgcgtggttgcggcgcgcgcggggcgctccgctacggtacagtgttcatcattgtacctgtctggcgcaaaaaaggcgcgctcgctgcagcgttacatgcctgcaacatgagcgtaagggggaaggccgtacggggaagagccgtctggcgcgtgtccggctcgtgttgggttgatttccgatctcagccgaacacattgagcggacaggccgttcccgcagtcagccgaacgcctccgacggctgattccgaactggaagcggagggcatccccgcccttcggtaggggataccgctccgcggcgcatgccgcgggcggcgcccctatcggaccaccgtgacctcagttgggatgggcccagcactgccgcgtactcggtgagctagagccaactgttcatcttcacgtcgcgtatggcgatatttcggtcgtccggctcggtgatgccgtagccgaacgcctggagcgtctcgatggactcctggatcctctgttggaacatgggacccggatcgaccctcggcccgaggtgcccgcgccaaaggcacggcgtggcgcgcagcatgttatggattttggagatgggctcgatgtcggcgtagacgttgagcgtcgccatggcgtccttgtggccgaggatcgattggagcgccttgatatcgccgccttggcggatccactgcgttgcgaacgtgtggcgaaggccgtggaacgtgatcagctcgtcgttggtgcccatgaggccgttggtctccgagaacgtcttgaacgccctgcggatatagcttgtcgtcgcgaaggtcgcgcccggctccgacaggatgtagcagtccccgatctcgaccgccccggtaaggccgcgcaagcgcagctttccgcagtcgatctcgtgggtctccttcaggaaggggagtaggccgaccgggtcgatggggatacccctggcgtcatgggtcttggtgtccttgatgaacgaacccattcccttcgcgtacgccaccgagtgtctgatcgagatcaggcccgtctcgaaatccacatcgcaccaccgaaggccgcagacctcgccgattcgcatccccgtgtgcagggcgagtacgaccgccctctaatcctcggcggaccaatcgagtccgaactcctttcgggcatcctcttcgctcatgacttcgagaaggtctccgggttggcaacgaagggcgaggcatagctgctcgagcgtgttgaagcgaatgccgcgaatatgcccttttttaatacgggacaggttcacgggcgtggttccaatcctttcggcaagttcgttcgaggaaatctttcgctcggccatgatcttgtcgaggcgaacaattacgggcatggcgtttccttacgcaatctcgtcggagtcgaggtacagctctcgggcgtacaagaagagctgggaaagcatgaacaggacgatgccgagaaccagagaggtccaatcgaatgatgaagcgatctcttgggcgccgacggccccctcgccgccaaacatcgaaacggaggttttgagtgagccggcgtagaggctggtggcagcttgaacaacgaagagaatgccgagcaccttcaagcatgtcgcagaccctttcttgaaggggtctccgctcttgatcgtccacacgagaacggcgctgaggatggtcgtagcgataccgatgacggcagggaccaatgtcgagatcgcaagggctggatacgcgggggagtctgcaattacagggttgtcgagcacttcgattgctggctttaaggagaacgccacttgtgcgatggcggtggcgcaaagggtcgcagaggctatcgcacatgcgatgcggaaggaatgaagccggggagtgcgattgtcggaactcataataacctccgaagaatttaaaaaactcaggttactttttaacagtttatgttaaattgactttgccggcaagtaataagggccgagcattttgttcggcccctctgttccgactggatgaggttaaggttggcgatgaatatgctcaaaatctcgaaggcgatctttaggtcgcttctctcctccaggtcgctctgtgttgtcgttgttgcgttgatggttctttgtgctctgcccgtcttcaggagcgcggctggcatcgacggacgggtcgaatacctcgagtcgggaataacccgtgttgagcaggaattgtcagcatcctatgcggatgcgcttgtgaatgcgggggaggacggtgtctatacctcttcatcaagcatgcccgcgcttctgtaccctcttgccgcgggacgtcttatcttggcaccgctctctcccctacttccgtttctgcagatatcggatggagagtacacctattatgacggatcgaaggagtacttgctatgggtcgcaacggccgttgccgtctcgttccttgccgcgcgtcttaacaaacgtgaaaagctcatcatccaggcaccgatgggcgagctgggtagacttgttgcatcgagcgtatgggcgagtgtttttgcaatgcttgccgtcctcgccatcaatcttccagggataatcgccgcgcttgtgaagaatggcccgggctcgccgttctatccgataggctacattcaatatgcgactccggttatcaaaccggcttggctggtgttcgcgcagacggccatcttgcaattcttggtggcagcgttcatctcgcttgtcgttcaccttgccgtgaagattgccaataaccctacgcttggaatcgtgttcgtatgtgccctgatgggggtgacgatggttcccgggtattgcggaagatccatcgctttacgtgagttcgccctgttgaatccccttacgtatgcgaacactgagttgaccgtcggcgcctatagcccgtacccgacaacgcagatagtgaatctgcctggactttgcttcgagcgtggcgcgattgccctcgtatgcgcaatcgggatcgaggtgctggcaattagcctgctttgcgttgctggaaagagcggctgcgcgtgcccgatatccccgatttgtcttgagagaggttccttcactgcatcgagaacggcaactcgttcgagcgcttgtgcctccgccgttgcatacgtaagaacgatggggaaactgctcctgcgttctcctaccctcgccgtatgcgcgattgcaatgtcgacgacgatgctggccccggctctggtcgagatgtttcctgacgctgataacgtttccgctgttcggtatagggatggggagctccgttcaatagatcggtatctagagcagaacgctgcgaatatggacgtcgagggcaaagcggccctggaagacatgcgggatgctctttcgggtttcgtgtacgcgcctatgcctgcggaggggtttcgaagccttgcgacgtacgagcgcgctcgaggtgagctgggcgcggcagatgcgactctcctgcaatcgatcggaatcgagccggagactccttctcgtgcggaggcgcgcgcccttctgcttgagtcgatcgcgagcttgccggaccccaaggtttacgagttaagtacgaagatgcccccattaatcctcctttcgtatctccaggcagcgcttccctccttatttttgctgttgcccgtggttgtcacatcgctcgcgtgcacccacctgcagtgtcgttcccttctggttctccagatccccgcaacagcgcatgtgcgttttctgacggctgttgcgctggctcccctgcttggcttggtgctgcttttggtgtcgatggttcccgctgtcgttgtgtccgtgattaagaacggtgcgggtggatcggagtatcccgtcgctctcattcgggcgggagcttcgacaacgtccatggtgggggaggcggtgttgtgcagtattccgttgctggtcatggcatacggcgtgatttccgtcgtcgctgcgttgacagcagcgattagccgcaaccccgttgtcaccggaatggtttgcgcggttctcttggtgttgggttcgttgagcgctcatgttgaaagcgtgggcatgggcgtcgcgctgctggctccattcgcctcgtttgattccgcttcccaggtggggacgattgggttccttgggcgagggacgaacgcgatgccttttggagaggtcgtcggcgcatcgggcgctctgctggtggtcttgggcgccgtatctccgttgatggtgcgcctgagtgttccaaagatcgaaaggggatgatctcgatgattgaccttcaaacgctgacgatctcttatggaaagaaggtgctcgtagattcggtgaacgctgagtttgccccgggtacggtctacggtctcgtcgctccgaacgggcatggaaagacgacgttgctgcgtgcgatggcaggtttgccgggtcctcgcgtggacgggagcatcgttctggatgaggtgcagggtacgggtgcgagagaggtccgttctatgatcttctatgcacctggtgaggggacgctgctgtatcccggattgcgtgcggaagatcacctcaagatggtttgcgatatgtggccgcatgctcgcgatatcgaagagatagtggaacaaacgcagataggcgagttcgcgaagatgaggatccgcactctgagccagggcatgaagcagcagcttaccctggcgattgcgtatgcgacgggcgcgcggtaccttctattagatgagcccatgaacgcgctcgaccccagcagggtggacttgcattccgagattctcaggaagctggccgattctggtacgtgcatcatcatgtcatcccacatcttggattcggtcgataggctgtgcgatgagattctgtttttgaaggatgggaggctcattagaagcattccgcaagatgatgctgcgccgaagtctcctggatcccatttcgcaaagcctgccggacgcgccgagggtgcgctaagcacgtatcggcgactctacgaaaagggcgggtagaaatgcaagttaaaaatctatgtggccaatgtgataccgttgaacccgcgcatcgataccgctcagccattcgcctcgcccccgtcgcacgcatcttcatccggtctgttacttttaatctaacaattctttgaggaacgtaggtgcttctgaatgtactgtcgacttcttctcaaactaatcctaagagacaaggccgtatggatttccacgctcgttctcgctgcagccttttccgtccccattgcgttcaattcacccatctacgggcccttctttatgaaacagggcatgcagggctttgtcgacgcattcaatacgcgcgcgccccaggccagcggcacagacctatctccagagcagcaaaatgacgcggagcttgcaagatacgcgaacgccgccctcgccgctcaaaccgacgccgcctttctcgattctgccgagagctactacgcgctcatgggcgaaggcttccaatccgggtccatcgtgggggaccaagagaccaatgacgcagcgctcgcatattgccgcgccctgagcagctccggcatcgcggatatcccggcctccgcaaacgacctgccattcctctccttcctgccctacgccattgccacggcgccgtctttccttcccttcatccccttccttctctcgtcgatactcgtgctcggcgccacaaggcccgggaccctggcggcaaaggcgcccgtgcccaaattccggcgccttatccagatcgtgttttcgataatcgccgcggggaccgcgatgctcctcgccggcctcgcacccgggggcatttacgccttggccctaaacggcttcgggcaaatcgggtacccgatctccttcttccatgacggcgcgctcaccaccacgaccgcgggaaacgtcttcacgaccatacttctcgcgctgctcgcgggcggaaccttgatatccgtttgttccgtcgtcctatcgaccgcaacgaggcgcgtcctcgcgggcccccttgcctccgcgttgcttgtcgcggccccggcattcccgttactgtccgattcggcactggggcataatgccgcgctcgggctcctgccgctggccgtgttctcgcctatcgaggcgacgggttacgtaggatgcttcccgacagaattcattggctccggttcgggcagcgcatcgatgcttgccgtggccctggcatacgtcgcggtcttctttgcggtcggcgccgttgcgacacgttcgcccaaacagtatggacccgcgaaaaagcaccatgggctcgagctcctggacgtgagcgtgggatacggaagcacgacgatactttcaatcgggtcgcttttcctgagcccgggaacggcggcgggcctcgttgctcccaacggctcggggaaaaccacccttcttgaagcgctgtcgggccaatttcccacccgcatccgctcgggaagcctggcggcagacggaatcagccaacgtcgatcagccgaatttgcagaactcgtctacctgagctcttcaggcggcacggatctctaccccacgctatcggccatcgagcaccttgctttcgttagggaggcgtggaaatcggccgccgacatcgactcgctctgcagctccctcggaatctccccatatctcgacaagccgacccgtaaactctcgacaggaatgaagcagcaggtaaagcttgccatggcgatatcgaccgattgcccgtacctcatcctcgatgagccgctgaacggcctcgatccgggaaagcggaaaacctcctgcgacgcgatgcgcagcgaggtggcgcggggacgaagcgtgctcatttcaagccatctgctcgacgacctggcagacctcaccgactcgttctacttcatcgaggccggcacgctcgtggaaaagatcgagtcgtcctcgcagacgctcaagcaggaatacctcgatacatacgagcgaggtgaatgacatgaaactatttgaacagctgaagtccaatgcgtcgcgcatggctgtctacgccatcctcgtggcaacggctttatgcggaatcgcggcacccgtctatgcgctcaacggggagaaaggcgatgtcgaacccgcgtacatggcttcgacggttaaggaccggtacaaagccttctctggagacacgttttacgtagcagggtacgacacgacctaccgtcagcttcgctacaacaagggctacgactatctaggcgcagaggcaatcagctatacgtcgggttggtaccgctccaactatggacacataacccagttcaagtgtaactaccgtgtgtacaactaaagcaaccggccgggacgaggggtgacgcaaaagcgtcgcccctcgtttttaaccatgtcaactgaacctagttcagtttggttgatttccgatctcagccgaacacattgagcggaaaggccgttcccgcagtcagtcgaacgtccccggggcccttctcaggccccggggacggcattttcccagttgaaggaacggtggagatgtgtttcgatgggtcagattcgtgtcgttccgaaaagaccgtgaaccttttgtgggacgcgcggtgccgtggtaccatagccgagtttgttgtcttggtcggaaaccaagacgccttatgcgctgatcggtaaccagcgcctgaccaataaggagtcctaccatgaagcagggtatccatccccagtatgtcgagtgcacggtgacgtgctcctgcggcaacaccttcaagacgcacgctaccgtgtccgagatgaaggtcgagctttgcaacgagtgccacccgttctacaccggccagcagaagttcgtcgacaccggtggacgcgtccagcgcttcgccgacaagttcggtggcgccgctgccgctcagctcaagaaggccgaggaggccaaggctgccaaggccgccaaggctgctgaggccgaggctgctcgcaaggccgccgctgaggctaaggctgccgagaaggctaagcgtgccgctaagtttgccgaggaggctgccaagcaggccgccgaggctcccgcagaggctcccgtcgaggaggccgctgccgaggccgagaccaccgaggctgctgagtaaatagctcgccgaggaatcgctcgcattcgtggctaaagggccgcgtatccatttgggtgcgcggcccttttcctttattggtgcaagctaacccgtccccattgcaccagattggtgcgaaggggacgggttcgtttgcaccaaatggcagagatacagcgttttcccagataaaaactgccaaaataaaccagtccccttttggcaggttggtcgtagttattacgtggcggtcgaggtcgaccgtataggccgcgccttgtttggctaaagtacaatcatctgtgtttaactcgcccgcagctgcacggcgtgggcgatggccaaaaaggaaaaccacatgggattcatgtcaaagctgctgtcctttggatccgataaggaccttaagcgctactacaagatcgtcgaccagatcaacggtcttgagccccagtttgagaagatgaccgaggaggaactccgcgcccagaccgataagttccgcgagcgttacgccaacggcgagtcgctcgacgacatgcttcccgaggcttttgccactgtgcgcgaggcttccaagcgcatcacgggcatgcgtcactttgacgtacagctcatcggcgccatggcgcttcatgagggtcatattgccgagatgaagaccggcgagggcaagacgctcgtctccaccttggccggctacctcaacgctatcgccggcaagggcgtgcatgtcgttaccgtcaacgattacctggcaaagcgcgactccgagtggatgggccgcatctacaagtacctgggcatgaccgtcggtctgctccagaacaacatgccgctcgagctcaagcgtccggcctaccaggcagacgtcacctatggcaccaactccgagttcggtttcgactacctgcgcgacaacatggtcacccgtcccgagcagcgcgtgcagcgcggtcacaactacgccatcgtcgacgaggtcgactccatcctgatcgatgaggccaggacgccgctcattatctcgggcgccggcaccaagtccgccagcacctacaaggacttcgcgcgcgccgtgcgcggcctggagcgcggtgaggacgtgtcgcacgacatgctcaccgccaccgaggacgtcgagcccacgggcgactacgtcatggacgaggccaagcacaccatcgccgccaccgagcgcggtcttaagaagatcgagcgccgcctgggtatcgatgacatctatgccgatctctccggccagctggtcaaccacctgcagcaggcgctgaaggcccagtacatgttccaccgcgataagcagtacgtggtcaccaacggcgaggtcaagatcgtcgacgagttcaccggccgcattatggaaggccgccgttactccgagggcctgcaccaggccatcgaggccaaagagggcgtgctcgtacgcgaggagaaccagaccctggccaccatcaccctgcagaactacttccgtctgtatgacaagctctccggcatgaccggcacggcacttaccgaggatgccgagttccgcgagatctacaagctgcccgtcgaggtcatcccctccaacaagcccgtgcagcgcgtggaccacgaggacctggtgtaccgcaccattcaggccaagtacaacgccgttgccgacgacgtcgagcgtcgtcacgccaagggacagccggtcctggtgggcaccgtctccatcgaaagctccgagaagctgtccgccgcccttaccaagcgcggcatcgcgcacgaggtcctcaacgccaagcatcacgagcgcgaggctcatatcgttgcccaggccggacgctacggcgccgtgaccatcgctactaacatggccggtcgtggtaccgacatcctgctgggcggcaaccccgacgagctggtgcgcgagcgccttgagtacgagggcctgaccatagaggacgtgacgcccgagcaactcgagcagtttaacgccgaggccaaggagacttgcaaggccgagcgcgagcgcgtgcttgccgccggcggcctgaccgttattggcaccgagcgccacgagtcccgtcgtatcgacaaccagctgcgcggccgctccggccgtcagggcgatccgggcgagacccagttctacctgtcgctcgaggacgacctcatgcgcctgttcggcggcgacaagatggaccgcgtctccaagatgatggtcacggccgacatgggcgacgacatgcccatccagcacaagatcatctccaaggccgtcgagagcgcccagcacaaggtcgagagcatcaacttctccatgcgtaagagcgtccttgagtacgacgacgtcatgaacaagcagcgccaggtcatctacgccgagcgcaataagattctggacggcaaggacctgaccgaccacatcaccgaggtcatgcacgacaccgtgtaccgctgcgtgcaggagttctgcaccaaggacagtcacgatggcgagcgcgacctggagggcctgcgcaagtgggttgtggagctcaccggccacatcgatacgccgaagttccctgacgaggattatgaggccctggctgccgatgtcctggcttacgtggagaagtgctacaacatgaaggccgagcgcttgggtgaggacctgatgcgcgagctcaacacccaggtcatgctgcgcgtcatcgatacccgctggatgaactacctgcaggagatggactacctcaagaccggcatcggcctgcgcggctttggccagcgcgacccgctggttgagtacaagaccgaggcctacggcgcgttccagatactcgtcgataccatgtatgaggattacctgcgcacggttctgcgcatcgagatcaaggctgccccgcgtgccgtggagcacaaggaggagcccgcgctcgagggtgcgcgcttctccggtcctgccgaggtcgatggtgacaacggcgactcggtgctgcgcaagcaggcgcaggtgcaggcccgcacggctgtccagggtggtccggctgccgtcaacaacggtggcaaggtgaccacctatcgcaagtccgagagcgacgatccgtacgtcaacgtgggccgcaacgacccgtgcccctgcggtagcggcaagaagtttaagtactgccacggcaggaatcgttaatggctgaggctttagaggtaacgcccgccgagctggacgcgttcgcggaccggctcggtgaggtcgagtcgtatctccacctggacgagaagcgtacccgcgtgttcgagctcgaggccaaaagtgttgcccctggcttttgggatgacgccgacgccgcccgtgccaccatggaggagatcgcgcgcaccaaggaagatatcgctgccgtggacaccgcgcgcggcgagctttccgatgcccgcgccgcgctggagcttgccgaggagatgggggatgaccccgacgccgccgcccttcgcgaggaggctgcagccacggctgagcgcctggcccgtgccatcgatgagcttgagctttcgagctggtttaccggtgagttcgatcacggcgatgccatcgtgaccatcaagcccggacagggtggtctggaggcccaggactggaccttcatgctctttaagatgtacatgaagtactgccagcgccgcggttggaaggtcaccatcaacgattgccccgcggccgaggtcatcggcatcgatcgcgcgacctttaccgtcgaaggcaaggatgcctttggcatgcttcgcgccgaggccggagttcaccgcctggtgcgcattagccccaccgacgacaagaagcgccgccagaccacgtttgccggcgtcgaggtcattccggtgctacccgacgatatcgatatcgagattaatcccgatgacattcgcgtcgacgtataccacgcaagcggcccgggcggtcagggcgtcaacaccaccgactccgccgtgcgcgtgacgcatttccccagcggtatcgtggtcacgtgtcaaaacgagcgcagccagattcaaaacaaggccgcgtgcatgcagatcctcaaggcgcgtctgtacgagattgagctcgagaagcgcgccgaggccctggatgagattcgcggacccaagaccacgatcggttttggcaaccagattcgcagctacgtgctctacccgtaccagatggtcaaggacctacgcacgggcgtggagaccagcaatgtcgaggccgttcttgacgatggcgacctggacccgtttgttattggctaccatcgctgggccaccggcaacgccgatgcagaaggctcggaggtctaaaacatcgggcagcttcaagccgatgttaagcccaacggttggacgggtttgtatccagaataaaccctgcgcaggggtggtttttgtccggcgaatcggtagaatcgaatacaagaagaagttcaaagcgcatccgatggggtgcgcttttttaaaggaggcagcatggcatatcgtctggacatcaagcgcattctttcgatgaacttctttcacgatctgccccagatcatgttggggtgtgccttggccgccatcgcgaccgacctgtttttgattcccaacggccttgcagccggtggcgttacgggccttgcgactattatccaggcagtcggcgcagcgcgaggcgtgtcgcttcccgtcggtatccagaccatcgtgatgaatgccttgctgctactggtcgttatgcgcgagggcggcatgttctacgtggtgcagacggcgacgggctttgtgctgctgggcttctttaccgatctgtttgccccgtttgttgcgcctctggcacatgctgacctgatgcttcccgctatgtggggcggcattatcacgggcatcggttacggcatggtattgcgcgccggcgccaacaccggcggctcggacacgattggccaaatcatctcgcgtaacacctcgctgccggtaggctcgaccgtcatggcaatcgacgttgccgtatgtgcggcatcggctccggtcttctcgctcgaaaatgctctgtatgcaggactttcgatggtgatcagcggctatgtgattgatgccgtggtcgatggcggcaataagcgtcgtatggtgctcatcatctcggataacttccccgatatcgcggccgacatcatgtatggtctgggccgcggctgcaccaaattaaaggcgaccggtatgtattcgggcgtcgagaagccggtgatcatggtgatcgttagccgtcgagagctcaacacccttaaaacgatcgtgcgcgaacgcgatcctcacgccattgtgacggtcgccgacgttacggaagccttcggtgaaggattcaaggacattaacgcgtaggctgaatttcggtttgcggatcatttttgtgccggggcgagaggcagccaccgcatccaaaagacgttcacattgataaaccgtttcatcagcggttctgcctgctaaattgttcaaataatgataaaaactctggtaaagccatcagtttccagcataatgaatgacgtacgtgcattgcggctgtgttgggattaccttcggtgccgtgcgcattttgtctaatgaggatgaaaggaaggcacaatgagcgacgaagagctcaaaaaggttgccaacgaggtaaggaagggcatcgtcaccggcgtgcacgctgccaagtccggccatccgggcggttcgctcggcgctgccgacatcatgacctatctgtactttgaggaaatgaacgtcgacccggccgatccccgcaaggccgatcgcgatcgcttcgtgctttccaagggtcactgcgcgcctggtctgtacgccgtgcttgccgagcgcggattcttccccaaggaggatctcgagacgctgcgccacatcggcagtcacctgcagggtcaccccaacatgaacgacaccccgggcgtcgacatgtccaccggttcgctcggccagggcatctccgccgccgtgggcatggcggttgccgctaagcactggggcgatacttaccgcacgtacgccctgctgggcgatggcgagagcgaggagggccaggtctgggaggccgccatgtttgccggcaaccagcagctcgataacctctgcgtgatcgtcgaccacaacggcctgcagatcgacggccccgtcgaggaggtcaacgaccccatgccgctcgccgacaagttccgtgcctttaagttccacgtggtggagcttgccgacggcaacgatttcgaccagatccgcgccgcctttgccgaggctcgcgctaccaagggtcagccgaccgccattatcgccgagaccatgaagggcaagggcgtctcctttatggagaaccaggtgggttggcacggtaaggcccccaacgatgaacagtttgagcaggccatggcagagctcacggccgccggagaggagctctaggatggcagacgtcaagaaaatcgccacgcgcgtaagctacggcgaggccctcgtcgagctcgccaacgagcacgatgactttgtggtcctcgacgccgacctggccgccgccacgcagaccggcaagtttaaggccgcctgccccgaccgcttcttcgatgtgggcattgccgagagcaacctgatgggtgttgccgccggtatcgcaaccaccggtcgcgttgcctttgcgagcacctttgccatgttcgccgccggtcgcgcctttgagcaggtccgcaactccatcggctacccgcatctcaacgtcaagatcggcgccacgcacgccggtatctcggtgggcgaggacggcgccacgcaccagtgctgcgaggatatcgccctgatgcgcgtcattcccggcatgaccgtcatcgttcccgccgatgacgtcgaggcccgcgccgtgacgcgcgccgcctacgagtgcgacggtcccgtgtacatgcgctttgcccgcctggcctcgccggtcatcaacgaccccgagacctacaagttcgaggtaggcaagggcatcgtcatgcgcgagggcaccgacgttaccatcatcgcctgcggcctgatggtcggcgaggccctcgaggccgctgagcagcttgctgccgagggcatcgatgccgaggtcatcaacatgcacaccatcaagcccatcgatgccgacctgatcgtcaagagcgccaccaagaccggccacgtcgtgaccgtcgaggagcattctgtaatcggtggcctgggcagcgccgttgccgacgtcctgtgcgagcagtgcccgacgcccctcaagaagatcggcgtcaacgacacctttggcgagtccggcccgggtgccgagctcttgcacaagtatggcctggacgccgccaacatcgtggcgaccaccaaggagttcttggcataaggcaaggcggatctcaaggactgtttcgccagtactatggaaacccggcaggggcgctctcttggagagcgcccctgtttcagttgcggtgaaataaggactgttttgccagcttaaaggctcaacagtccctatttcaccgcaactcatgaagacgcccctcaagcacggtcccatcagggaaaagggcatatatcggcaaagtgcaattcagacccttccaactttgtatatgcagcaccccaagataaacgcggcggccccttagtagccgcaggccgcgtacagggttacctcccgaatctttccgcaggacggaggagcccccgcagcgcgaagcgcgcagcgggggctccgacatgtccgaggacgatttgggaggtaaccctgtacgcggccggagggaccaggccccgccatgcttcttatgtgcagtaaagctaatactgctaaaatacaaagcgctcatgtagtttaaacgcacgacgataaggagcaccagtgggtaaccacttccgtacctccggtgcgggcgatgatgcccccaagacgcaggcaggcgtccagggcagtcgtttcgccactccggattcagagggccagcctgttgctcaggcccccgctcagccggcagatcaggcacagccggcatccgatccctttgcctacaatccaaccagcgatgtcgcgctttccggcacggcgggttttgagcccgttcaggccgtgaccgctcgcgtggagcagcctcaggctggtgccgccacgccgcagcctaccatggccggcattcccgaccccttggcccctgcgacgccggctcctcagcctgcgcagtccggtctctttgccgctattcccgaccccacgcagcctgctgccccggtggtcgagagcgatcaggcagccgaggtcgcaagcctcgataacgcgctcaacaaccccgattttacgtcggtgtttgcgcccatcgatccgcaggccagccgcaagaagatggccaagcaggccggtgtcgagcccgtcatccttatggagcatgtcaccaagatctatccggcacagcccaacaagcctgcactcgacgacatcaacatcgagatctatccgggcgagtttgtcttcctggtcggtcactccggctcgggtaagaccacgctgctgtcgacgctcaaccgcgacgtcaagccgacgagcggccgcatcctggttgccggtcaggacctcatgaagatcaagaaccgcaaggttccgttcctgcgccgccagattggcgccgtgttccaggactttaagcttctgccgcaaaagaccgcctacgaaaacgtggcgtttgccctgcagtgcatcggcaagcccaagggcgtcattcgcagccaggtgcccgaggtgctgcgtctggtcggtctggccgatcagatggactcgctgcccgaccagctttccggtggcgagcagcagcgcgttgccgtcgcccgtgctatggtcaaccgtccgccgctgctgatctgcgacgagcccacgggcaacctcgacccggcgatctcgctgggcatcatgaagctgcttgagcgtattaaccgcaccggcaccaccgtgatcgtcgccacgcacgaccgcgagatggtcgatagcatgcaccgtcgcgtgatcgccctcgagggcggccacgtcatccgcgaccaggagaggggaggttacggcaactatggcaccaactaacgtgggctactccttcaaagaggcaatcagccacttcttccgtaactggactacctcgctcggcgccgtcatcacgatcttcctttcgctgtttatcatcggcctgttcattatgggctccgcggtgctgaactccgtgatcggcaccgtcgaggatcaggttgtcatcaacgccttcattagtgatgacgccgatcaggctgatgttcaggcttttgaggccgagcttaagacgtggagcaacgtcaagtccgtgacctataaggacaaggacgacgcgaaggccgagtattcgagcaagatgtcgggcaacgccgacgccaccatgagcgcgctcgatggccagaacccgctgccggcttccttcgctattgagatggacgatccgtccaaggtcgagagcacggcagagaagctcaagaaggatgccgatttccagaagatcgtggatgacggcgacgtcaacgcgagcgtgctgtacggccaggaggcagtgagccgcctgttccaggtgaccaactacatccgcatcgccgccgtggtgctcgttggccttctgacctttatcgctttcatcttcatcaacaacacgattcgcctatccatcacggcacgtcgtcgtgagattgcgattatgcgtctggtcggcgccagcaacggcttcattcgcggcccgtttatcaccgagggcgtactacaggccattttgggctcgttgctttccatcggcgttctggagctgctgcgcaacctgatgattccgcgtctgcaggagagcatcggctggatgtcgtttgccctgccgatgcagtactacttggtgacctatgctgcgctgattctggtcggcgtgattatcggtttctttggttctgccatcgccatgcgccgctacctgcgcgtgtaggcatgcctggaattcatcccttccaacgggtcgtctcttatggggcggcccgttttttgatccctaggggacggcaggaaagcgaatcatttgggtagactctttggagttcgcaatcgatagttaggaggcgccatggggcgcaataacaagcataagcgtggagctcgcaataagcgcgggccggtgcgcagcgaacgccgtccgagcctgaccgggcgcgtgcagctccatgagcacagtgcctatgtcataaccgagaatggcgactacaaggtcatgggccgcggtaagcgcgagatcatggatggcgataccgttgccgtgagcattaagaacagcccgcacggtgagcggcgcgccgtgatcgagggcgtggttgagcgtgcagccataagcgtggtgggcacgtaccagaccgccggtccgctcggtgtgattgagccgctcgattcgcgtctgaaggccgacttcttcattctgcccgaggatacctcggcggatcgtctgggcgtccacccgggtgatgctgttgtcgcgcacattttgacctacccgacgcgcctggaatcgggcaccgtgacgattgaacgccgcattggcggagatgacgcgcccgatttgggcgttcaatatgtgatggcgcgttacggctataccgatagctatcccgaggccgcgctggacgaggccgaggggctttcgctcgatgtgtccgcggcgcttaaggacccgctccgccgcgatctgcgcgaccgctttgtcatcacgatcgacccggtcgacgcgcgcgactttgacgatgccatttcgctggagcgtacgcccgagggtggctacaagctgggtgtgcatatcgccgacgtttcacactatgtggcttgggacgggcatatcgatcttgaggctcgccatcgtacgacatcggtgtatctggccgatcgcgtgcttcccatgctgcccgaacgcctgtcctgtgacctgtgctcgcttcgccctgacgaggaccgtcttgcgtttaccgtcgatatcgagctcgatgcgcagggtcgcgtgcggcattacgatccgtatcccagcgtgattcgctcgcgtgtgcgtatggactatgacggcgccgaggcgctgctggtgcgtgccggcgcggttgagtattcggtgctggagggtgcagccgaggatgttgcggctgccgagacctcgcgcgaggaagcgcttgagcgcggtcttgcgtgcgaggaggccgcccgcggctacaacatcgacctcggcgatttccttgtcgccgctaacgaactcgccgaacttcgccgtcgtattcgtcgcgcccgcggctcagtcgattttgacacagccgagattcgcgctctattggatgaggacggagtgcccgtgcagattgtggcgcgtgagcgttcgtgtgccacgtcgcttatcgaggaagccatgctgctcgccaacgagtgcgttgcagagtggctggcagaccgtgatatcgaggcctgctatcgtgtgcatgaggatccgagccccgatagcctgcacggtgctgccgttgcgctggcgcagctaggcatcatcgacgatcgccgtgctgccggtattgccctggggagccccgatgagctgcaggctgcagttgatgctgccgccggtacggccaacgcaccgctcgtcaacacgctgcttctgcgcagcatgcagcgcgcgctgtacaagccgcgcaacgagggccactttgcgctcgccgcgccgtgctactgtcactttacgagtcccatccgtcgctaccccgatctggtggtgcaccgcgtgctcaaactgcagttggcctatgagcagctcggcggcaaggacgccttggtccgtacgccgcggctgatcggtaaggggcgcgagtcgctgccgcgcattctgccgcagatctgccgcgcatgtagcgatgccgagcgcgcggcagatgccgccagccatgcgacgcaaaagatcaagattgcccagtactatgaggaccgtctgggtgagcgctatgccggaaccgtctcgtgggttagcagcatgggcctctttgtgcgcttggacctaacacaggtcgagggcctggtttcaattaagagcctgggcaacgagtggttcgagttcgacgaggacgcgctaacgctcacaggtgccgacacgggcacccgttacgagctggggcagcgcgtgattatcgaggtctcgcgcgtcaataccacgcgtgggcacttggactttaagcttatccattagctaaatcccgactcgtggcgagagagcggagggcggcctttcgggaccgcccttcgcatttgaatcgtggctaccttgccgtctgctcggccgcccgcttacctgctatttgagaggtaaaacctaccaaaataaacctgtccctttttggcaggtttacaagaaagcggggatgagatggcgacggtgtacggttatgcgcgggtgagttcgcgcgatcagaaccttaatcggcagctggatgcgctgggcgcctatggcgtgggctcggcgaatatttatgccgaccatgcgagcggcaaggacttcgatcgaccgcgttatcgcgagctgctgcacgtcctgggagacggggacgtactggtggtgctttctatcgaccgacttggccgtaattactccgagattcttgaggaatggcgacgcattaccaaggagctcggggttgccattgtggtgttggacatgccattgcttgacacgcgcgctagggccagcggcgcgccggatgtgaccaacgtcctgattgccgatattgtgctgcaactgctgagctacgtggcgcaggtagagcgcgagaatatccatcggcgccaagcggagggaattgcagcggcgcgggcgcgaggggtccgtttcggtcgacctcgcaagccgtgccctcctcagtttgagctggtgcgcgatagctatgaggcgggcgatattacccgcagccaggcggcaaagtgcctgggcgtgtgcgtggggacgttcgatcgctggatgcgcgaggcggggtaggggtttgcgtcgctttgtcgcttcctgttgcgattcaaattttgatacggtgacgatgccatttggggctacactcgctgatattcaaaaaaggaggttggcccttggcgcgcgtaaaacaaataatcggatggaccgcgatcgttctgttcgctgcaacgctggcgggcatctgggtgctgacggagcaaaatgcggtggagacgtcgttgctgagcgagtccaccgcgcgtgtggtggagggccaggctacgggcgttcaggctaccggcatcacgggtgaaattcaggcgggggacggcatgactgagagtaccaatccggctgcctcgacggtccagcctggtcgacttgcttccattcgcatgtgggtaggcgcaaacgtccgtcgcgtcgcccataccgtagagtttttcttcgtcggattggtcgcctcggtgatcgtggtctgcttttccaggcgtccatggagtgtgtgttcccgttgcgtgcctgtgtttctcttttgcgctgcctgctccgttggcgaccaggtgcataagatctttgttcccggcaggcatttcgacgttatcgatttaggattcgatgctgcgggctatgtcaccgccatgctgttggtattgctggcagcggcgctggtgcgccatgcgactcggccgatcggcgcccatgcgaggcgctagccggtaacaaacccgtttctgataatgcgaccttgttgaattattttgtgtcgcgcgtatttccgagcggtcggatttgaggggcgagcggtagaacgctcgccctttgtgcgccacgatgcggcacaatgtaccgcaaaagctgtttgtatccggtacgaatcgttcgttggtctttaattcttctcaacggaggtgtttgagatggcaaacggattgcttttgcggcttcgcgagcgtgagctcagcgcgagcccggcggaacgcaatgtcatcgcatatgtaagcgctcatccgcacgaggtggtcgggctgtccgtccgcggtcttgccgatgtcacgttctcctcgccctcgagcattttgcgcttttgcaagcgtttgggttttgcgggctacaaggagttccagcgcgaactgattgccgagctggcgctcttaggtgacaagaaagacgtagccctcgaggacatctccatggatgacagcgtcgaacgtatcgtggggaaggtgatgaaaagcaacgtgcgcacgatcgaggcgacggcgcgaacgctcgattacaccgtcttggagcgatgcgcggcccgtcttaagcgggcacgcgcggtcaatctgttcggtattggtgcctctcgtttggtcgcgcacgaccggcgcaaaagctcatgcgtgtcgacaaagagtgccatctgtacgacgactggcatgatcagctcttatgtgccaagaacatgcatgagggcgatatggcaatcgcctttagctactcgggcttgacgcaagaggtgctggactgcaccgccgaggctcaacgtcacaactgtcccgttgtggccgttaccaaagtagatggatcatccaatcttgccaccatggccgatgccgtgctcggcgtcgctgcgagtgaacccttggtccgcagcggtgccatggcttcgcgtatggcccagcttatggttgtcgatgccctgtacgctgcttacgttgccagcgactacgaacgggcgacgcatgtcataaagcaaaactacatcgagaaacaggaaagatgaggtgaatgaaatgctcgatttaacaaaattcacgaccgaacagcgtaatcaaaggtcaatggacctcgatacgatgacatcgctgcaaatcgtcacgacgatgaacgatgaggatcttcgtgccgtccagtcggtcacgaaagtgttgccccaggttgccatggcaatcgactgggctgctgagacactcgagcgcggcgggcgcgtcttttacatgggagcaggcaccagcggtcgtctgggcgtactcgacgcttcggagtgtccgcccacgtttggcgtgtcacccgatctgattgtcgggctcattgccggaggcgagacggcgtttatcaaggctgtcgaaggtgccgaagacagcgaggagcttggcgcgagcgacctgcgggagcgtggactctcggacaaggatcttgtcgttggcctggcggcaagcggccgtactccttatgtggtgggcggccttgcgtacgccaaggcaactgggtgcaagaccattgcaattgcctgcaaccaagggtcgaagatcggggagagcgcagatcttgccattgagcccgtgcccggtcccgaggtgctgaccggctcaacgaggctcaaggcgggaacggttcaaaagctcattctcaacatgatttcgaccggtgccatggtcaagatcggcaaggtataccaaaacctgatggtcgatgtgcagcagacgaacgagaagttggtggtgcgcggccagaacatcgtgatggaggcgaccggctgcacgcgcgagcgcgctgttcaggcgcttgcggatgccggcggccacgtaaaaaccgctattgtctcggtgctgttggactgcgatgccgagcaggctgcggtagctcttgaacgggcgcacggccatgtccgtactgcggtgagtggccatgagaagagcaatgccgatgtccaataggtgcacggcgtgagctgatatgacatctagacgagatacccaatacaaggaggagttatgacgaacaaagagctggctcaaaagctgctggaccttttgggcggtaaagacaacgtgctcgcaaacgcggcgtgcatgacgcgcctgcgcgtgaccgtcaaagacacgggcaacgtcgacacggagggtattaaggcgctcgacggcgtgatgggcctggtcgaggacgacacgatgcagatcgtgctgggtccgggcaaggtgaataaggtgctcgaggagttctccaagctcaccggccttgcgaaaggcgttgccgacgagagcgtggttgacgctgcggccacgaacaaggccgcgcagaaggccaagtacgagtccaagccggttcaggccttcctcaagaagatttccaatgtcttcgtcgccctgcttcccggcatcattgcggctggcctcatcaacggtatctgcaacgtcattaacgtctcgacggcaggcgcgcttgcaggcgagtggtggtaccagggcattcgttccatgggctgggccctgtttgcctatctgcccatcttggtgggctataacgcggcacgtgagtttggtggctccgctgcgctgggcggcatcgccggcatgatgtgtatcgccaacagtgccatgcccctgcttgcgcctggcgcggctgatcctgccactgccattctgctgccgctcaccaatgcgcagtacaaccccgcagcgggcggcatgatcgcggctctcatcgctggtgcattttttgcctggatggagcgtcagattcgcaaggttatgcccaacgcactcgacacgttcctgtccccgctgctggtgctcatcatcggcgcctttgctctgatgctcgtcatccagccggttggcgcatggctgacgactgccatctttagcgttttgacctttatcttcgagaagttgggcgtcctgggcggctatatcctgtcggcaggcttcttgccgctggtgtccgtcggcctgcatcaggcgctcacgccgatccacgctatgctcaacgatcccgacggcgctaccaagggtatcaattacctgcttcccatccttatgatggctggcggcggccaggtcggtgccggtttggcgctgtactttaagaccaagaacgccaagctcaagaagtacgtcgccgagtccatccccgttggaatcctgggtgtgggcgagcctctgatgtatgctgttacgctgccgctcgttcgtccgtttgtgacggcctgcctgggtgccggatttggcggcgcgctcgcggcgctgcttcacatcggcacggtttctcagggcgtttccggtctgtttggcctgctgatcgtcgttcctggccagcagctcggctacgttgccgctatgctgcttgcctatgccgccggctttgtcctgacgtggttctttggcgtcgacgagcagaagatcaacgagttctttggcgagtagtttgatatcgcgagccgtgttgctcagagctcgcggcgcgcggcagatttcttgatgttatggttgtgccggcggggctagctgctccgccggccttttttaaaggagcgttgaagcgtgaaaacgggtatttcgatttatctttccagccctttgcaggatattgagcggacgattgagcgtggtgccgcggcgggtgcgcgctatgcgttcacctcgctgcatattcccgaggatgggggagcggcgtatgccgataaggtccgtcatgtgctgtcgctgctttccgcccgcggcattgcgctcattgccgatgtggggcctcgcacgtgcgatttgctcgggcttgagcgcatcgaggccctgcgcgatctggggttggaataccttcgtttggactatggctttagcgcccagcgggtcgcggagctgtccggtgtatttcgcattgtggtcaatgcatcgacagtgagttctgatgaaatcgcatcgtggcgtgaggccggtgccgatgtgactcgttttgccgcctgccacaatttttaccccaagccttataccggtttagctctggaggacattgctcgggtgaatcttcgtcttgcggcgcttggattcgaaatcatggcttttgtgccgggtgatgctaacgttcgcgggccggtattcgagggactgccgacggtcgaggcgcagcgcggtcgcgcgtcaaaggttgctctcaatatgcttgagcttgcacatggcgccgattgcgacattgtgttggtcggcgaccccgatctatccgatgcgggctgggcgcagtttgctcaagtttccgccggatacgtggacctgcaatgcgagcttgagcccggttatgcctatgcgcgcgggcagattcatcacgaccggcccgactcgagcgtcctcatctttaggtctcaggagtcacgtacgacgcttaagccggattccgtgccgacggatgccggagccggcctgccgcgaaaggcggggtcgatcgctgtgagcaatagcggatatgggcgctacgaaggcgagcttgagattgcgcgggtcgatcttcccggtgacgagcgcatgaacgttgcgggccatatcacgcccgaggcaatggagctactgccgttcatcaaacgcggattcggggtacggttcgtttagcgtgtgacccgtgggctacaattggcccatcatacgaaggcgcctcgtgtggcgtgtgcccgcgttggccgatctatattcggaggattcccatgaccgtactgtttgttgaatatcccaagtgctcgacctgtaagaaggccaaggcatggctggacgaacatggggtagagtacatcgaccgcgatatcgttttggacaatcccgcggctgatgagcttgcgacctggattgctcgttcggggctgccggtgcggcgcttctttaattcgtcgggcatgaaatatcgagagctgggcctgaaggcgcggttggatgcgggcatgacgaatcgggagtgctacgagctgctggcgaccgacggcatgctggtcaagcgtccgctgctggtgggcgacgactttgcgattcccggctttagggaagcggcttgggccgaggcgttgctgtagcggctgcggaaagtgcgtcccgttttgagctcggattccgggacgcagtttccggttgaaggggctagcggaaaccgtatcccagtttgagcgcgaaatctgggatacggtttccgtttggggcctctaggggaaagcgcgtcccgttctggacgtaaattccgggatgagctttccggttggcgggcatgcgcactatcccggctggcgggcatatgcgctaatcctcaagctgtgcccattcgtgcggatcgtagacctttacgtgcttgttgggcttgccgctccagtactcctcgtccataaagggcagatatgcctgaatgccggggcagataaagggaatccgctgctgttgcagtcgctcgcgctggcgctgctccaggtgcgcctcggatatgacggtcggcatgccggacagctcgacgaggcttgcctggattcgcttaaggtcggggagtcccgcgtgccatgacatccgcatgattaaaaaggatgcacggcggtattttgcctgcaccacagtaatggcggggcgtaacgtggggtgaattttgtcccgttcgggccaaaggtcggcagtgatctcgaggcccagggtctcccataggtaatcaagctcttcgtccatggcgcctcgatatctacgcgatcattgatacttcgattgtgttgcctggtgctatcgttttcacggtagaatctgccaacggttgacggctaccgctcacggcgttttgcccttcgtgtacagcggttggcttcacaggtccttcacgggttgggccaatttaggccaatttggctgaatttcaaaaaagtcaaaattggggcttgcgtcacggcgggacttcccgtatatttctttcttgcgcaaaggcacagccgagcgcagcgatgcagtcattgggatgtcgtctaatggcaggacagcggattctggttccgtcaatgggggttcgactccctccatcccagccattgcatttgctacatatggcccgttcgtctagcggtttaggacgccgccctctcaaggcggagatcaccagttcgaatctggtacgggctaccacaaaatgaacgcccgggcctcgtaagagacccgggttttgtgtattgaccgatgtttaaggcgcgcgttgagtctgccgcccggaccgaggagttgtcatggacctgcccatcagcttgcaagacatcacgtatgccgagaactatctggcgcagggcgacctggctacggcgacgccgctgctggagcgcctggtggagctcgccgaggagtatatcgacgccgagtgcaagacggaggagaagcgccaatactttagcttcgatagcaagtttgagcgcttggcctatcgccgcgtggagaaggatccgcgcgagctcgtgcaggtcgaggtgccgtttgaccgcctgtactctgacatggcgtttgcctacattcgccagcaggattatgtgagcgctcgtaatgccttgatgcaggctgtgcgttgggaccccatgaactgcaactatcgcttggatttggccgagctgttccgcgctctcgaggacaagcaggagtgggcttcgctttcgttttcggtgctagagcgcgcgagcgatggcaagtgcgccgcccgcgcttacgccaatctgggtcagtacttcttggagcccgagaccgagaacgtttcggctgccgtgggctgcgcgcgtctggcgctgcgcctggcgcccaacgatacgcatacgacgcgcctgctcaacaagatccatactacctatccggatgccgccgaggagagcgacgagcacgtgatgggcgagctggcgttgcagggcgttccgacctcgccttcggccgagattgccatctgcctgattatgtgcgcgaccgatgctgcaagcgacggcgacaagcaggaggcgacgcgcctgacggcgcgtgctcgcgacttggtgggcgaggaggcctgtgcggcgattattaaactggtgcgcgagagcgatgccgagctcaatgccgagcgcaaggcaaagcacgcgggtgtcgacaagggcgctgacgatgtcaaggaggccgacgatgcccagtaagcgcgagcgcaaactcatctccaagaatcgctcggcacatcacgagtactttatcgatgagacatttgagtgcggcattgaactgagcggcaccgaggtcaagtcgattcgcgagcgcgcctgtcagatcactgacacttttgcgctgattcgtggcggcgagtgctggctcgtcggcctgcatatccatccttatagccatggtggcgtgtggaatcgcgatcccgatcgtcgtcgtcgtctgctgctgcaccgcaaggagattgactttcttgacggcaaacttcgcaaccgtggttatgcgctggttccgttggagctctactttaatacggacggccgcgtaaagctgctgctgggtctgggtcgcggcaagaagctctacgacaagcgcgaggacatggccaagcgtgatgtccaacgcgagatcgaccgcgcccttaaggaacgcaaccgctaggcgctctatataagttgcggtgagatacggactgttttgcctgtttgaggggctattcagtccctatttcaccgcaactgcgggcgtcttatctttcttactgttctgacacatatgtctcaaaggcggcgtccgttatgggtgccgccttttttgtgggtacatacattcatgaggttccaacccgagctaggggagtgatcgttatggacaaaactgcgttctttaccatgccgagcggtctgtacgtggtgagcgctgcggcagacgggctgcgcgccggctgcgtcatcaacactgcggtgcaggtgacgtccatgccgccgcgtatttcggttgccgtgaacaaggacaatgtcacctcgggcgtcatcgcatcggccaaagcgttcgcgctgaccgtgatcgatcagacggccgacatgctctacatcggtaactttgggttccgcaccagcagcgattatgacaagtttgccaaatacgagacccgcgagacggctctgggcatgccctatgtgcccgagcacgcggcggccctgtttagctgccgtttgatcgacactgtggatgtgggcacgcatctgctgtttattggcgaggtcgaggatgccgagcgcctgagcgacgagacgccgctgacgtacgactactatcacaaggtgctaaagggcaagacgccgcccaaagcctcgtcgtatcaaggctagaaatgttctaaaaatacttgcattatactattgagaatatatactaataagtaagtacaccagcagtcacgttcgagaggagaacatcatggctgaggagaagaagacgtataagtttgtgtgcaccgtttgcggttacgaggttgaggtcgacacgcccgagctgcccgaggactacgtgtgcccggtctgcggcgtcggccccgatgagtttgagcttgtcgaggagtagctcgtagacacacgacttgcaacaacatatagctctgtccaagggccccggtcgaattctcggccggggcccttttgattcaagactttagtccgctggccgcgcagcggccagctttaaaccacccgctacgaagcggtcggcggggccattgtggctcttgacagcggattgggtcatatgagcgaaaacccgccagagtgagcaaggtgccttgaaacgaggcggcattgaccttctggtcatgccgccgaagttgaaaggcagattgccgctctggcgggtttgcagcgtcgagccgttacgcggtttggtaaaaccgcgtaaccactagtttggtaccttgacattcatttctcatgctcctaaattggttaggcacaaaacaatttcactacctaactaaagaaaggagcgaagattagatatgcgtgttgaaccactcgcctatccgcatgaacccggcggcgacccctcacggccagcagacgagcccgagacccagtccgacaaagaccgtctcgccaagcgaatcctcaatgggctggggttttgcggccattacatgcattttcacggcggcggcatatctggcaaggcgcctattgtctgcctactcgccaagcagccgaccggcgagctgtcccaacaggagctcggcatgcacttcgacctcaagccggggtccctttccgagattctgtccaagctcgaactgggcggtcttatcgagcgcagtcgcaatcccaaagaccgtcggcagctcaccatccgcctgaccgatgcgggatgggaaaaggcccgcgttgagcaggcggcccgcatccgctttagagagcaggcctttagtgccctcactcacgacgagcgcgaacagctcgccgagatgctcgaaaaaatccgcgcaacctgggaggaactggatgattaaaaccctcatgggaagcatccgcgattacaagaaggtcacgatcgccacgccgctgctggtgcttggcgaggtgctctgcgagatgctgattccatttatcaccgccaacctgatcgacgccatcaaagacggcgccaccgtagccgagatgcttcccaccgcgggctttttggtgctcatcgcgctgacgtcgcttgcttttggcgccgctgccggcatcacctgcagccatgcgagttgcggcttcgccaagaacctgcgtcacgacctgttctataagatccagacgttcagctttgccaacatcgatgagttctcgagctcctcactcgtcacgcgcctgaccaccgatatcaacaacgtgcagcaggcctttatgatgatcatccgcatcgccgtgcgcgcaccgctggtgctggtctttgcctttgccatggcctacgccatgggcggcagcgtcgccatggtctacctggtcatcattccgctgctgggctttggcctgttctttatcatctataaggtgcgcccgatctttgcccgcgtgttccgcaagtacgacgcccttaacgagtccgtcgaggaaaacgtcaccggcatgcgcgtggtcaagagttacgtgcgcgaagactttgagaaggagaagttcgcgaccgccgcacgcgacgtccagatggacttcacccgcgccgagaagctgctcgcctttaacaatcccatgatgaacatctgcgtcaacggcgcgtttgtcgtcatcatctacctgggctccaagctcatcatcacgagtcagggcacgctgttcgacgtgggccagctctcctcgatctttacctatggcttccaaatcctcatgagtctgatgcagctgtcgatgatctttgtcatggtgaccatggccgacgaatcggcacaccgcattaccgaggtgctggccgccgagcccacgatcgccgatcccgccgagcccgtgctcgaggttgccgacggttccatcgactttgaccacgtgagctttaagtattccgcgcatgcgaagcgccaggcgctcgacaatatcgacctgcacattaagagcggcgagaccatcggcatcatcggcggcaccggctcggccaagtccacgctcgtaaacctcatcgcccgtctgtacgacaccaccgaaggtaccgtgcgcgtgggcggcgtggatgtgcgcgactacgacttggacgctctgcgtcaccaagtggccatggtgctgcagaaaaacgtgctgtttagcggcaccattgccgagaacctgcgttggggcgacccgaacgccaccgacgaagaggtccgcgaggcggcacatctggcctgcgccgacgagtttgtcgatggcttccccaagggctatgacacctggatcgagcagggcggctccaatgtctcgggcggtcagaagcagcgcctgtgcattgcgcgtgccctgctgcgtcgccccaagatcttgatcctggacgactccaccagcgccgtcgacaccaagaccgacgccaagatccgcgcagggctggcaagctatctgcccaacacgaccaagctcatcatcgcccagcgcattagttccgtgcaggatgcagaccgcatcatcgtcatggagggcggccgcatcgcgcagatcggcaaccacgatgagctgctcaagacgagcgagatctaccgcgagacctttacctcgcagaacaagatgtctgccgagggcgaagaggccgtcgaagccgacaccgaggcatccgcaacacaagctcagacccaggaaggaggcgaggcacatgagtaaggcaacgaccgccgagcgcgcgctcaaccgcaagggtggcaccatgtcgcgcctcatcaagacgctctttggcttctaccccgtgcttttgcccctcgtcgtcgtcggcgtggtgctctgcgccatcatcaactccatcggcgcgaccttccttcagagcgccctgcagattattagcgaatcgtggcagtcgggcgattgggaagctgcacagcccaagatcgcacagctcgtgaccaccctcgcctgcatctacggcgtcggcatcctgtcctcgctgttctggaaccgcgccatggccatcgtcacgcagggctcgctcgagaagctgcgcgagaagatgttcaaccgcatgcaggacctgccgattcgctacttcgacacgcaccagcgcggcgacatcatgagccactacaccaacgacatcgacacgctgcgccaaatgatcagccagtcgctgcccaacctgctcatgacgaccatcgtcatcgtcacggtgttctttatcatgctgtactacagcgtttggatgtgcctggtcattgtggcaggcgtcgcctttatgacctttatgaccaagctgctcggctccaactccgcgcgcttctttattgcgcagcagaccgagctcggcgttgtcgagggccatatcgaggaagtcatgaacggccagaaggtcgtcaaggcattctgccacgagtctgccgccgaagccgattttgacgagcgcaacgaaaagctcttcgaggtctcgcagaaggccaacatgtacgccaacatcctcatgcccatccttatgaacctgggcaacctgctctacgtgctggtcgcactggccggcggcattttcctagcgctgggcgtgcccaacctgagcatctcgggcatggcgctgtccatcgccgtcgtggtgccgttcctcaacatgaccaagcagttctgtggacagatcggccagatctcgcagcagatcaacgccgtggtcatgggcctcgccggcgccgaccgtatctttgagctcatcgacgaggagcccgaagccgacgaaggctatgtgacgcttgtcaacgctcaggtgaaccccgatacctggcagctcgaggaggccgaccaccacactggcatgtgggcgtggaaacatccgcaccgcgcaaccggcgagatcgagtacgtgccgctgcgtggcgacctggtcatggacaacgtcgactttggctacacgcccgaccacgaggtgctgcacggcgtgtccgtgtttgccaagccgggccagaaggtcgcgtttgtcggcgccaccggtgccggtaagacgaccatcaccaatctcatcaaccgcttctatgacatcgccgacggcaagattcgctacgacggcatcaacgtcaacaagatccgcaaggcagacctgcgccgctcgctgggcgtggtgctgcaggacgtaaacctgttcaccggcaccgtgatggataacatccgctacggcaatctggatgccaccgacgaggagtgcatcgcggcagcaaagctcgccggcgcggacgactttatcacccgcctgcccgacggctacgacacgatgctcaccggcaacggtgcccagctgtcgcagggccagcgccagctgatctcgatcgcacgcgccgccgtcgccgatccgccggcgatgatcctggacgaggccacgtcgagcatcgatacccgcaccgaggccatcgtgcaagccggcatggacaagctcatggaaggccgcacgacgtttgtcatcgcgcaccgcctgtccaccgtgcgcaactccgacgcgatcatctgtctggatcacggccgcatcatcgagcgcggcaaccacgacgagctgattgccaagcgcgggtattactaccagctctataccggagcgtttgagctggagtagttcggctcgccgagatggccgatttgccgctcattcgtcgggcatgaccctaaggtcaatgccctcctctttcggggcaaatcgactcatctcaacgacccaaacacaatgcgccgcaacgaataaagcctccgcagccacacgagctgcggaggcttttctatgccctttgttacaagcttaccgttcctcgcgttgcggcccggctgcctcggctgtctttacgcggttcttgtcgatgtacatgtttttgtcggcctgggaaaagagctcgcgcatcgtaggcggttcatcaaaatcactggaaagtgcatagcccaccgcatagctgataggcatgtcggggtgagcctcggaatactcgttcacgttcgcacgaacccgagcgagacaggactccacagcagttcgatcggcatcccacagcaccgcgataaactcatcgccgccgtcgcggcccacaaagcaggtctcggacgccacgcaccccagctgctgggcaaaagaacggatgtattcgtcgcccttctcgtggccgaagttgttattgaccgtatgcagattgttaaggtcgaagacgcacaccgcaacgggcgcctccgcggagacaggccgctcctgccccaagatctcctcgcacttgttcttgttgggcagtcccgtggcttcgtcgagatagactttgctctgcagctcgcggttgagcgcggcagtgcgcaccgcgcgaacaagttcgaccgcaaaggtcgccaccaagcccacgatgtcgatgatcaccaagccctcgagatagttgagcgccgacgccttctcctgagagtagtcctctgcgagtcgtgtggcatcgtcacaaataccaaagaactcctcgctcatcgcgatgatatcggtgctctcgtagccgacttcgcgcacgcggctgatctcggcgcaaagctcatcaaaataatttgcaagctcggtcatctttgtctgatactcatcgtcgtcgagacggacgaggttgaggtcgtcacttccgtaacgcaaaccgttgatgtatgaatccacggctttgagcaggtcatcttgaggctggcccgcatcctcgagcttaacgattcgctgcgtggtaccgcgcaccagaccggcgtaattgaccacgcgcgccgtgccctggatatcggagacgagcagcataacattgatgaagaagaagatgagaactgccgtgagcaccatcatgagcaggcgcaccgcccggctggctttcttggcgacagaagtattcacaagttcactcccccaaatgacaaaagcacaggtagtacgcaacgtgctggaattcacgtgaggtcaactctaccagatgatttttctaggacgggaattaaagaatcatcgacacgatagctatttgagaagttgtgccatggcgttgacgaatttttggacttggagggtgggctcgagcgggtagtgcagaaagaccggtacctcgcgaccgcacaggaacggcacgcccacaaaggccgggtgcacgcccgaccatgcgccgcaggtgagcaccgcgtcgcccttttcctccgcctcgttaaagagcgcaaagtcgaagctatccacgtcaatcacgtccacgccgccgtcggccaacaggtcgatgcgcaggctgtccatggcgtcgttgccgtggcggagcacgcgcaggcgcatgccctccaagtcggcgaccgtaatgcgtgtcttgcgcgccagcgggctcgtgcgcggcacgtcgatataaaacggcacgttgacgatgcggagcttttggcaggcatcaccccagcgcggcgtcgaaaaactcgactgcactacatccacctcgcgaccaaggctgcgcatgacggattcgcgctcgtcgtagaggtcgcttaccggcacaatctcaaatcgcagcgacggctccagatcgtggatgcccgtccacatcgaaagcgtttggcgccccggacacatcatcgacacgcccaggcgcacggcaccgccgtcgcccgccgcacgtcgggcacggcgcagtgcgtcctcggactgccgcatgatcgagcgcgcgtcgtccaccagtagtgcgccggccggcgtcaccttaacgcctgagtgcgagcgttcgaacagcgtgatgccgaactcggcctcgaagcccgacacctgcttgacgagcgccggagtcgacacacgcaattttgccgccgcacgcgagaagcttcccagctccgcggcagccgatatggcctcgagtcgtcgatcgtacacgtcaatctcccgttttcgcgcctgtgaccgcatggtgccacagggggttgttttcgcaggtcacacgctcaattgagaataaactgcatcgcacagtgtaaacctacggttaacgcaattctaacaaatatgcaattcacctgcgcaaatgcaaagcatacgataaccagcgaaaaccacgtgggtcgattaatgggagcgacccaccgggaggcacaagaagggaagttcctatgagcaattggcttaagctcgagggcgatgtctgcgccgtgactggcgcgctcggcggtatgggcgccgagatctgccgcgagttcgcccgcaatggcgccaacgtcgtcatgctcgacctggacgaggagaaggtcaaggccgcagccgccgacctcgccgccgagtttggcatccacgccgagggttacaagatgaacgccaccgacgaggccgaggttcaggctgctgtcgacgccaccatcgccaacttcggccgcgtcgacgtcctcgtcaacaccgccggtatcctgcgcttcgccgccatggaggacctgccgctgagcgactgggagcaggtgctcaacgtcaacctcaccggttacttcatcacctcgcagcgctttggtcgcgagatgatcaaggccggccagggtcgcctggtgcacatctcgaccgtcgccagccactcccccgagacgttctcgggcgtgtacagctccaccaaggcgggcgtcaacatgatgtccaagatgctcgccgccgagtggggcccctacggcgtccgctccaactgcgtcgaaccctgcttcgttaagaccccgatgtcggccaacttctacgccgaccccgaggtcgaaaagagccgcagccgtctgatcgccacgcgccgcatcggcgaggtcagcgatatcgccaacgccgtcatgttcctggcgtccacgcgctcggacttcaccaccggcgacgccatcaaggtcgacggcggcttctccaacatgatgggcgacctcaccgccaagcccggcggccgtcgcgcctatgccgacaactaccttaagaacaagggtgtcgagctctggtccgatgagtccggcgtcgccaagccgactgaccagtaaaccaacctgacagggaggtcccgcggacacgcccgctcctcccccgtatcgatcagaaagagtccaatggcttccaccaactccaacaagggtcgcgccgtcgtgctttccgccgcgtgcgtcaccatgttcttcatcagctccatcgcgctgtattccgtcgtgagcaagaacctgctcgccgtctaccccgagtggtcgagcgccctcacctgggccttcccggtctttcagaccatcatggccgtgacgggcatcttcgccggccgcatctccgataagatcggcccgcgcaacgtcgttatcgccgccgccgtgtgctacggcctgggctggttcatgtccggcaccgtcaccgagccgtggcagttctacctgtggttctcgctcgtcgccgccatcggcaacggcctgggctacaacccggcgctcaccaccggccaaaagtggttcatcgacaagaagggcctcgcctccggcatcaccctggccgcttcgaccgccggccccgccgtgctgtccccggtgctcgcctcgctgctcatcccgagcctgggcatctttggcgcccttaaggcgctcggcgtcatcttctttgtgatgatcgccgcctccgccctgttcctgaaggcccccgaggccggttggctgcccgagggcttcgaggcccccaagggtggcgcacatgccggcaccttcggcgacctcaccccgggcgagatggtcaagaccccgcgtttctgggtcctcatcatcaccttcgccttcgccgccaccgcgggcaccctgctcgtgggcaaggttgcctccatcgccgccgtccagctcttcgccgaccccacgagcgccgcggccgtcgccctcggcggcgtggtcgtctccgtcaacacctgcgccaacctggtcggccgtctgtcctttggtcagatcatcgacaagctcggcgcctataagtcgctgctcatcagccttgtcgtcaccatcgtcgcgctcgtcatcatgtcgatgagctttacgcaggccatgttctttgtggcgctcgccctgctcggctttagctttggcgccctgctcgtcatctacccgccgctcaccggtggcgcctttggcaccagcaacatcggcgtcaactacggcatcatgtttttgggctatgccgcttccacctggatcagccagcccatcaccgccgtgctgtatcacgccgaggctggcagcgccgcctaccagcagtccttctacggcgccatcgtgatcgccgccatcgccgtcgtgctcaccgtctacatgatggtctccgacagcaagaagaagcccgcttagtaattgccaatgcgacaaagggactgtccctttgtcgcattccatcgccaacagtattaaggagtcgaaatgtctgagctcaaccccgtccgcattgccgttatcggcgccggcgccatgggtcgcaaccacatccgcttcgtcaccgaggagcccgaggccgagctcgtcgccatcgccgacgcctttgagggcgcccgcgccacggccgaggccgccggcgtgccgttcttcaccgatcccgcccagatgatggacgaggtcaagcccgaggccgtcatcatcgccacccccaacgacctgcacctgggcgttgcccgcgaggccgtgaagcgcaatattgtgccgctggtcgagaagccgatctccaacgacctcgaggatgcccaggcctttgccgccgaggccgagaccgccggcgtgcccgtgctcgtgggtcagcaccgtcgccacaaccccttcgtcaacaaggccaaggagatcatcgagtccggcgagctgggcaagctcaccgtgtcgagcttccactacatgatctataagaacgacgagtacttcgacgtcgagtggcgccgcaagaagggtgccggcccgatcctggtcaacctggtgcacgacgtcgacctgctccgttacctgctgggcgagcccgttgccgtccagggcatgcagtccagcgccgcccgcggttttgagaccgaggactccgccgtggtcaacgtccgttttgccgatggcgcgcttgcgagcatgaccatctccgacgccaccgccagcccctggaactgggaggccaccgctcgcgaggacccgcagtaccgtcccttcgacgccgacgcctactttatcggcggaactaagggcgccctttcgctgccccgcctgcaccagttctcctacgacggcgcctccaactggcacaagccgctgcagatggagattccggcagtcgaccccgcgctgccgcacaagatgcagctcaagcactttgtgaaggttgtccgccgcgaggtcgagcccgtcgtgacgcccgccgataacgtcaagacgctcacgcttctcaacgccatcaaggaggccgccgagaccggccagctcgtcgagctgtaacgccttagggcagaccgcggcagaagccccatgccgaacccttcggtccgccaccaacaagcccctcttctttgccccgcgagcagcctcctgcccgcggggcattttgctacctttccgacgatttttctggggcgaggggccattttgcacctcggcctgattcgttcgccacgaaatgcgcctatctactacgtttaaccgatcgccctcaaccgtgccaaatttcgcgaagtaaaaaccgcaggtagacggcttgcgtattttcggaaaaccgggggatggtcgacccatacgggttaaacgtagtagataggtcattttcgtggcacggcccaaaacagtcttttgggacgggtggtatccttggtagctctgtgctgcaaacgcacctttaccgcaaggagtttcatggatcttatcgcccagctcgcccgcgagctcaaccttaaggccgccaacgtcgaggcggccgtcaagctcatcgacgagggcaacaccatcccctttatctcgcgctaccgcaaggaagccacgggcggcatggacgacgtcgccctgcgcgcactcgacgagcgcctgtcctacctgcgcaatcttgagcagcgtaaagaggacgtcgttctgctcatcgacgcccagggcaaactcacgcccgaactcgagcagcagattcgagaggccacgcagctccagcgtgtcgaggacctctacaagccctaccgcaaaaagcgcatgacccgcgcacagaaggcccgcgaggcaggcctggagccgcttgccaacatgatcatcatgcaggcctcggccaagggcagcgcgctcgacaccgccgcggcctacgtcaacgaggaagccggcttcgacacgcccgagaaggcgctcgccggcgcggcggacatcgtggctgagacggtggccgaagaccccgagaacgtcgccgacctgcgcgcctttacgcaaaacaccgccgacatcgtcgtcgaggccaccgaccccgccgaaaagactccctacgagccctactacaactatgatgagccgctgcgccgtatacccaaccaccgcgtgctggctatcgaccgcggcgagcgcgagggcaagctccgcgtgcgcgtgaacgtcgacggcgctgccgccacagcgcgcctcagcagccgttggccccgacgccagggcgtcttcgcgcccatcttcgatgccgccatcgctgacggttacaagcgcctcatggccccctcgctggagcgcgaggcccgcgccaaactcaccgttcgcgctcagaccgaggccatcaacgtctttgccaagaatctcgagggcctgctctcggcgcgccctgtgcgcggcgcccgcgtgctcgcgctcgatccgggctaccgcaccggctgcaaggtcgccgtcatggacgagaccggcaagctactcgaccacggcgtggtctaccccaccaagccgcgccacgacgtcgccggcaccaagcgcgagctcgcccgcctcgtcaaaaaggacggcgtcaacaccatcgtcatcggcaacggcaccgccagccgcgagaccgaggaagtcgtctcggagttcattgccgagcaggcgcctgggctgcgatacaccattgttaacgaggccggcgcgtcggtgtactccgcctccgagctcgcgagccaggagtatcccgacctggacgtcaccgtgcgcggcgccatgagcctgggccgccgcctgcaggacccactggcagagctcgtcaagattccgccccagtccatcggcgtgggccagtaccagcacgaccttgaccaggccgagctctcgcgcaccctgggccacgtggtggaggacgtcgtcaaccgcgtgggcgtcgacgtcaacaccgcgagcgcgagcctgctgggatacgtttcgggcatcacgccgagcgtggccaagaacatcgtggctttccgcgaggaaaacggcgccttcaccgatcgccgccagctcaagaaggtccccaagctgggacccaaggcatatctcaacgctgcaggctttttgcgaattagcggcggtaagaacccgctcgacgcaacgagcgtccaccccgaaagctacgaggtggccacgtccgtcttggaacgcgccggcgttaaagcaagcgagctcagccgcggcggcgtgcccgacatcgagcgccgcctgggcagcatctcggcgctggcaagcgacctggactgcggcaccctgacgctcatcgacattgtcaacgagctcaagaagcccggccgcgacccgcgcgacgacgcgcccgaggtggcctttagccgctcggcactttccatcgacgacctggagcccggcatggaactcaagggcacggtgcgcaacgtcgtcgactttggcgccttcgtcgacgtgggtgtgcaccaggacggcctcgtgcacatctccaagctggccaaccgcttcgtcaagcacccgagcgacgtggtgcgcgtcggcgacacggtaaaggtgtgggtggaaaaggtcgatcgcgaccgcaagaagatctcgctcaccatggtgcaggggaagtaaaccacctaaagcaagggtcccccctctcgcgacgtgcaaaatcgcgagtattctgcaatttccgccgccccgaacgcccctcagaggcaataaagtcaaaaacggcccccgttttagcatcatcagagccaaaacgggggctgttccgtgcttcggttaactggtaaaagcctttaccttgctgaatactctcaattttgcacggcgcaggcgggggtacctttgcccacggcaggatatggaagccaagcgccaacttgctggcaagctcgtgccggcagccccggcctttcctttgcctagcgcgacccccgcgaagcgcgtgagcggtagggaaaggaaaagccggggcgaacaacccgcggcgtagccagtgttcgcgttacggcaggatatggaaaccgagcgccgcgatatccttggcaaagccgcggacggtgtcgagcgagacctcgtacgggtcacggccgatgttcttgcgcttggccaggatgccgttgggcaccgtgatgatctggcaaccgcaggcctcggcctggtaaatgttgatgagctcgcgcgtggacgcccacaggacctcacagttgggcttgatggcggccttcttgaccgactccgtcataaacggaatggggtcgacgccggtgtcggcgatgcggccggcaaagagcgagatgatggacggcgtctcggtgtcaacggcctcgaccatctcgtcaacctgcttaggcgtaaagatggtggtgacgttgaccttgatgccgtcggccgacagcttgcgcaccagctcggcggtggactcgcccttggtggtcacgcacggaatcttgacgtagacgttctcggcccaggtagcgatctcgcgcgcctcgacctccatagtctcgacgtcatcggcaaagacctcaaacgagacggacacatcggtgatgtgggtcaggacctccttggcaaacgcgcggtaatccgtcacgccgcccttcttcataagggacgggttggtcgtgaaaccctgaacgttgccgttctcgtacatgtcgagcatgccctcgaggtttgcaccgtcagcgaacaccttgattgccatctgcctgattcctttcgcttgcacatgggcgttaaactgctaaacactttacctacgtttatcaaggcgtgagctgcggttttttatcttctcggcgaacggtataaacacctcagtgtttggattgataaatcgattgagcatgcaaaagcgaagagtcgcagtttgagcaaacgtcagaacgcgggattcattagatgaggccgaaatgctgcatcgctgtgacggtgccgtcgtgtgcgacatcgtcggtcacgtagtcggcgaccgccttgacctcaggcatggcgttgcccatggcgacagccgtctcgaccgcagcgagcatgcccaggtcgttgccggaatcaccaaagccaaaggtgcgcgcgttgccggtgcgacccaggtattccagcgctcgcgccacgcccacgcccttgtcgatgcccttggggctcagctcgcgattctggccaccggtgttgcacagctcaaactcgcgatcgataaagccgtcatcgttggctacgcgagccaaactgggcacattgaggcataccttgcccacgcgcagactgccgtcgacgcgcatttcctcggcgctgtgcaccacagaagtgccgatcagagacgactgctcaacgcccgcgggttccaaggcaaaagtagccacgttggtctcgaaaaaggcctcaatccctgccgcggccatacggcgtgcaagctcctcgacaatgtcctcgtcaaagcagtcctcgtgtaccacgcggccctcgacctcgagtgtcgctcccgccatggcaacgacacccgcaggctccaaagcacgcagaccatcggcaatcagccacaagggacgacccgtgcagataaatgcctggtgacccgcattgcgcaggcgatgaaacgcctcgatcaccgcctgcgaggggcgaaccgccgaaaagtccttgtcggtcatgttgtcgggatcgaacgacgtcagcgtgccgtccacgtcaaaaaagagcacggcagaatcggggcacgcatcaatcatatgggttcctttcgggggcgagagtaaacgaagcatccatcatataatggagcgacgcaaccagagaggtcacccatggaattttacgcaagctgccccgagggctttgagtccgcactcgccgatgagcttaaacgcctcgggctttcgcatgttcgccggctgaagggccgcgccacgtttgagggcgagctcgaagaaggctaccgcgcctgtctgtggtcgcgtctggcgagccgcgtgtttgcggtgctcgggcgctttgaggcgcaggacgccgacgagctgtacgatagcgtttacgacatcgcctgggagaacatcgtccgccccggcgccaccattgccatcaccgcccgcggcgtgaccgagcagctgcgcaacacgcgtttctcggccctgcgcgccaaagacgcgctgtgcgaccgcctggccgagaccacgggccgtcgcgccgatgtcgatgccgccgaccccgatgttcacctactgctttcgctgcgccagcgccgcgcgagcataagcctagacctttcgggcgacccgctgttcaaacgcctgccgcccgcagcgacccgcgccggcgagggcgcgcacgtgctgcgccccgactacgccgccctggtgctggcgcaggtcggctggaccgcgctatgcgagcgcgagctgacggccgacgattacgaaaatgaagcccttcccacgctgatcgatgcctcgtgcgccggcggcggcctgctgctggaagccgtgaacattctgaccgaccgcgccccgggcgccgcacgcgagcgctggggctttgagggctggcagctgcacaacgccgctctgtgggagcagctgcttgccgaggcgcgcgagcgcgaggcggcagcgcgcgaacgccaggcgcgcatcgtggccgcagacatcgaccccgccgctcgcaagaccgccgagcgcatggtcaagagcgctggctacaagcgttttgtcgacttttgcgccgccaagcccgccaccgtgctggaccatgcgggcgccgtcgccggtgccgccgtggtcgcagacaccaccgagaccccgctttcgctcatgcacgacgccatgacgctggtcggcgagctgcgccgcgcgcccgagctttccgcggcgccggtcgctgcgctcacccgcgatggccttatggcccgcgcgctccatgccgagcccgcgcgctccatcgccgtcatgcccaataacgaggaggcggctcttgaggtttggcactcgctcgaccacgccgccgcggcattcgaggctgcgaccagcataaacgccgaggaacagtccacggacgtcgaagacgaagccgccgcttcctccatgcccgaacctgccgccacgctcgacttgggcgacggcaagccgctgcccgtgctcatccccgggtccgagcagttcgccaaccgcctgcgcaagaacgcgcgcctgcgccgcaagtgggccaagcgcgagggcgtaagctgctaccgcgtctacgatgccgacctgcccgactactccgccgccatcgacctgtacgagggttgcccgcagacgccgggccgctggctcgtcatcgccgaatacgccgcgcccaagaccatcgaccccgcgctagcccaggcccgcatgctcgacattctggccatcgcgccgcgcatccttgatgttccggccgagcatgtgcacgccaaggcccgcatgcgttcgcgcggcggctcgcagtacggcaagcagggcgccggcaagggcggctcgggcgagcgcgccaatatcgcacgccgtcgtctgccactcatcgaagagggcggccttacctttgccgtcaactttgacgactatctggatgtgggcatcttcctggatcaccgcgtcacccgcaacctagtgcgcgagcacgccaagcaggcgcgccgcttcctcaacctgtttgcctacactggcactgccacctgctacgcggccgatggcggcgtcgaggagaccgtgacggtcgacctttccaacacctacctggactgggccgagcgcaatatgcgccagaacggctttgttggtccgcagcatcattttgtgcgcgacgacgtgctcgcctggattcgcgaccagcgccagacgcgcaaccgctgggacctgatctttgtcgacccgcccacgttttcgaactcgtccaagatgggccgccgcacctgggatgtccagcgcgaccatgttgagcttttggccggcgtatcgcgcctgctcgcacagggcggccacgccatctttagctgcaacctgcgcggcttccgccccgaggcgcgcaagctcgcgcgcgcgggcgtggtgctggaggacattacggcacagaccatccccgaggacttcgcgcgcaaccagaaggtgcaccactgctatatcgtgcgccgcctgcccatcgaggacgccatggccgaggtcggctttagcgccgaggaaattgccgagcgcgtcgaggagctgcgtaaccccgaggcccgtaagcctcgcgcggcagtgcccgcgcacgtgcagaccggcaacggcaagtccaactttgctggcaagccctcccccgccggcaagtccaaaaagaagaagttctacgccagcaagcccaagggcaaataacaaagttgcggtggaatacggactgttttgcctggaattaggcaaatttagaccgtatttcaccgcaactcatattgggatggcggatgccgacctatccctggatgaccaatcggtaaccaatacccacgtgcgtctggatatagcgcggatgcgcggggtcggactcgatcttcttgcgcagcgtgcccataaagacgcgcaggctcgccaggtcgctcttagttgccgtgccccaaatctcgtgcaggataaactggtgcgtcagtaccttgtcggcgttatgcgccagcaggcacaggagcttatactcgatcggcgtcagatgcagttcctcgccatccatcgtggcgatgccggcatcaaaatcgatatgcagctcaccggtatcgaacgagccctcggagacaacgccgcccgtctgcgcatacgaaaggcgcctgagcgtcgtgcgaatgcgcgcgagcagttcctcgaccgaaaacggcttggtcaggtagtcgtcggcaccggcatcgagcgcgcggattttgtccgcgtcctcgctgcgcgccgagaccacgataatcggcatgcccgaccatgcgcgcaccgactccaccaccttgacgccgtccatatcgggcaggcccagatcgagcagcacaatgctcggcgtctgcgacgaggcggcggcgatagcggcatgggcggtctccacagccatatggcgcaagccgtgcgcctcgagcgcggcaacaataagattgcggacggcggggtcgtcctcaacgaccaagatgagcggttttacggcagagttcggcacagcgctactccttatcaaacgaaacgtcggcggcaggaagctcaatcgtaaagaccgagccgtgcgggtccgccgcggcaacctctatgctaccgccatgtgccaacgcaatggaacggcagagcgaaagacccaggccaacgctgcggtggctgtcggccagaccatggttggcggtatagaacgactcaaagatccgctcgcgatcctcgggtgcgatgcccggaccatcatcggccaccgagcacgccacgcgtccatcgtcgacgctaatcgaaatcacgatatgcgaacccgcgggcgtataggtgatggcgttgttcaccagattgaccaccagctgcaccatcaggcgcgcatcgacgttgacgagcgccggctcatcgcacgccaccaccttaaggtcgtgctcgcgcacggccggatttacgtggcgcagcgcctcctcgacgatatcgtccatgagctcgagcgtggtcgacaggcgcataccgccaccctcgagcttggtgatggcgagcagattctcgacggtggcgttgagccacagcgcatccgagcgaatggatagaagcaggccgcggcgcgtctgggcatcgagcaccgcggtgccggtcgagccctggtcgagcagcacatcggcattacccgaaatactggtgagcggcgtgcgcaggtcgtgcgagatggagcgcagcaggttggcgcgcagctgttcgtttttggcaagcaccgccgcctcctcgcgggcctccatggcgcgggcgcgatcgagcgccagctcgccttcgctcacgatggcatcggcaagtgtccgctcctcatgcgtcagcacgtcgggctcggcaacgatagccagcacgcccaccaccgaggcggggtcgcccgagcgcgcgaagccgtcgcctgtgcgaaccgtcaggtagatgccataaaacgccgagccgccataggtggcatcgagcggcgttcccacataggcggacgccgagagccgcggcggcatctgcggcgccagttcgtgcaccggtgcggcatcgcccacggccgtgtatgtcgcacgcggcagcaggtcatcgccctcggcgtcggcgctgtaccacacgaccgggcagcccgaaagacgtgccagctgcgtggccatggcgtgaacgatctgatgctgatcggcgcaccgctgcagcatgcggttggtctcgagcaccatatgcgtgcggcggtcgctggcggcagcctgtgccaaggcgcggcgcagggccaacgcaatcgagctcgacacaagcgagaccacgaacatgatgaagaacatgccgggatagccgcggtcgataagcgacagcgagtagcgcgggtcgacaaacaagaagttgtagagcgccacggcggcagccgagctcagcaagcaatacaggcgactccaggtaaagaatgcgcacagctgaacggcgaacacatagacgatcatgatgctcggcgcgagacccggatggtcgagcagcgcgcccacaatcgtcgccgcgaccagcagccccaccgatacgcaggcgtcatacagaggagtgcggcgcgtcagcgttgtgcgccgccaccaaaagctatcggcaatatcgccgtccgtacggacgtccatcagcgtcccgcccctctctcaaaacaaaaaccaccacaaaggggacaggcacctttgtggtggtttcccttgtggtggttccaagtgtatagcctttgcaaccggcggtcgctagacaaacagcacgtgcgcgagcagggcacacacgcacaccgctccaaataccagtgccacgatcgaaattacgcgatcggccatatccatgttggcacggttcgtaaggaaccgatcttcggcggcgtcggcgcgtgcctcacgtaccagctcggcaaccacctcgcggccatcaagcatctttgcatccatgtttgcctccccggtctcaatcttgtccatcgaaaaccaactccgtgcaacccgtcggcgcctacggccgctcgttgggggccaggcgctgcatcttgttcacggccttgaacttggtgaacagcggcacgtactcaaagctcacgttggagttctccaggccgtaccaacgcgcgggcgtgccggcggcgcggcgaatgatgtacttgagcgtgatggccgtacgctcgctgggctccacatcgctttcgggcgccagaagcttacggatcaggacgaacttgaacgtgccgatgttacccggatccttgtagaccgagtagtcatgcgtctgcggcggcagctcgccggtggcagccaggtcctgaacaacctgacgcaggtaggcattgacgcgctggttgatcttgtagcccaggtacaggtgcacgcggaacacgtagtcggtgccgaacgtctcgaccgaataggcaaaggtgtgcggttcgtccatggtctcgacattcacgaaccaccaggcgcgggcacgcttgggatgcttgtccaagatcgaatagacgatatcgcggtcgatgtagtcggtatgggtgtccttggtcaggtacacgacgttgtcactcatgcgctcgtaacggtcgtcgtcgcgcaggcgcttgagctgcggcaggtagctgcgcagcggcagcagcgtaaactggcgctgctcgaccgccgtgccgttgtaccagcacaccataatgcccatgatgagtgcagccatgaggatggtgaaatagccgccgtggaagaacttggtgagcgagctcacgaagaagaagccttcgagcaaaaggaagaaggccgcgaagatccacggagcaaccttgagcttgcgctcctcgtgcaggtagaagaagagcagtagcgtggtgcacatcatagtcagcgtaatggcaaggccgtaggcggcttccatatgcgccgagttctggaacagcagcaccacgatgacgcagcccacaagcatgacgttgttgaccatggggatgtagagctggcctttggtctcggcagggtagaagacctgcatgtgcggcatgaggtccagacggctggcctcggacaccagcgaaaacgcgccggtgatgagcgcctgcgaggcaatgatggccgcgacggtggaaaggccaacggcaaacgggcgcaggcccggggcgagcatctggtagaacgggttgaggtcggcaatgcccatgagctcggggttggcagcgttgttcataagccaagcgccctggcccatataggaaagcagcaggcagcacttaacgaacggccaggtagcgtagatattgccgcggccgacgtggcccatgtcggagtagagcgcctcggcaccggtggtggcgaggaagcagctgcccagaatcatgatgcccgcgtggttgttggggctcaacaaaaaggcgatgccgcggagcgggttgaggcacagcagcacggcggggtgctgtaagacaaagaacaaacccgtgccgcccaggaataggaaccacagcgtcatgatggggccaaaggcgtgaccgatcttggccgtaccgatgcgctgtaccaagaagagcacgatgatgatggcgagcgtaatggcgacgacgcggccctggtcatcgcccagcacggcatgaaccgccgggatagtgcgcaggccctcgatggccgtggtaacggtaacggccggcgtcaggatgccgtcggcgagcaacgcggcgccacccagcatggcggggatgataagccacttgccgcagcgcctgaccaggctgtacagggcaaagatgccgccctcaccatggttatcggcgcgcagcgagatgagcacatacttgatggtggtcagcaacgtgaccgtccacacgacaagggagagcgcgccgagcacgaactcctccgtgacgcttccgatgccgccgttgccggcaacgagcgccttggttacatacatggggctggtgccgatatcgccgtacaccacgcctagcgtgacgagcatcgccgagatgctcacaggaatcgcagcgtgcgaggctgcctccttggccttttgttccataagccggtttcctcccaactttaatgttcgaagggattataggtaatcggcccatgttttaatgcactgttttcccagctagataaagatttatacagtctttaggctaccgcggcgatatgaagtgtgacaaagggactatccccttgtcacattcgtcattttccgagccagtttttgaaccaccactccatggagcggctcatctcggccataaaggggctcgtgtgcttgcgggtgtagatatccacgacgcgctcccccacctcgcgggcgtgcgggcgaaacatcgcatccatctcggccacctgcgcatccatagtcgcggcatccgcacggcagtagcgctcctcgtgcaccaggttcaccacggggtgcgcgattgccgggcgctccttacggggcgtgccgatgatgagcatcgacagcggcatggtatagggcggcagatcgagcagcgcggcaacttcctcggcgttctcgacgatgtcgccgatatagcagctccccagccccagggcctcggcggcaaccacggcgttttgcgcggcgatcacggcatcctgagccgcgatggcaaagtcgcccagacccggcgcgcggcggggcgccttgcccgtacgctcgacaaactcgggctcaaagcagcccacgtgctcaaacagatcgatccacttggcatagtcgaccacaaatataagtgcccagggcgccttggcgatcatgggctggtggtcgcacaggtcggccaggcggtcgagcgttgcccgctcgcggacgctcacgatggaatacatcatcatggcgcccgccgacggcgcgcggctcgccgcatgcaagatcgccgcccgctgctcgtcggtcaccgccacgggacggtcgtcgtcatcacgcgcgaaggcacgcgtggacgagcggtgttccaagatgtccagcgccgcgttgcccgtagtctcgaccggatagccgcccgcgtccacgcccacagctccgccgcagtactcggtgcccgtcatacaaacctgctcgcccatagctctatcctcgctaattctttaagaagcctttacgtttccgtgtaattcccgtccattatcgcgcaggccgccactacattgcgccacaccgccacacgtgcgcgttaatatggctggttgttgtgcgcagccaccaattgcagcgcatatcttggtaacaatcgggtaaacctccgctttcgtacgttttagtttgtgaggagtctcagcatgttcgctgccgccatctcgctcgtcggtcttgcggcgaccgtctaccttgtcttgcgcgaggccaaggccatttgcgctcagtcgggcaccgttgccaaaagcgctcttgggtggagcgtcgccttcggcctgttccagctctttttgaccatttggggcgccattggcctcgtcgcccaaaacgagccgctcgcctttgtgatgctcatcctgaccaacgccatcctcaccggctgcgcttgggccagcatcgcacgcgaccgcatcgccccgcgcgtctttgcgttcgccaagcccgacgcccccgcccccatcggcaagctcgcccgcctgcgcggcgcctttgtgggcaaaccactcgtcgccgccgtcctgtgcctgctgctcgccggcgtctttgcgctgctgggcatggaggtctcgtccaaccacgactttacctgggtctaccccctgtgcatcctgctcgagtgggccatcatcaccgtgctcatggtcggcctgttcttcctgttccagcgccacggcgtagctcccgcggtcctggcctttgccctctttgtcctgggcattgccgagttcttcgtcatcacgtttaaatccatgcccatccagccgggcgacctttcggccatctccaccgccgccgcggtcgccggcaccggctacaccttctcgatctcactgttctgcgtgctgtccatgggctttaccgccatcgccatgctgctgtgtgagtacgccggcctggtggcaccgcaccgtcagaagggcgccgccaacgccaagcgcatgctgctcaccaacctgctcgtcgccgtactgtgcctgggcggcgtgaccgcgcatgtcacgctcatcgactactacaacaccctcggcatcaccgtctacacctggcgcccgctcgagagctactggcgcgagggctacctgcccgcctttattagtgcagcgcagtccatcaagccgcccaaacccgccgactactccgtcgacgatgccaaggccacgctcaaaaagtacgccaaggcctacgacaagtccgacgcggccaagagcgacgagcgcgccgccgcaaaggagcagttcgatagcgagaagcccacggtcatcgccatcatgaacgagacgttctccgacctgtcgatctaccagaacatgcgcgccggctacgagggcccgcagtactttaagagcctgtctaactgcctcagccgcggcaagctctacgtgagcgcctacggcggcggtaccgccaataccgagtttgagtttatgaccggcaactctatggccaacctgggctcgggcgtgtacccctacaccatctacaacatggaaacgaccggtaatctggcagagcagttcaaatcgctcggctattccaccacggccatgcaccccaaccacgcgaccaactggaaccgcgagaacgtctacaaggactttggctttgaccagttcctgtctatcaacgatttccagggagccgacaccctgcgcggcatggtgaccgaccaggctacctacgacaagattcttgagctgctcgaccagaacgccgatccgcagtttatcttcgacgtgaccatgcagaaccactcgggctacgatacgggcctgctgccggtcgacaagcagatgcacctgaacatcgacacgaccgacctggacgccaagaccgtcgaggacggcacgctatccgatgtcgacgagtatgtctcgtgcatcgagcagtccgaccaggcgctgcgctacttcctcaacgccttgagcaagctcgaccgcaaggtggtcgtggtgttctggggcgaccaccagccgttcttcccgtccaagttcaatgacaagtggtttaccggcgaggacgacgctacgcatcaggagcgtctgtggcagaccgactacatcatctgggccaactacgacgttgccggctgcgaccagacgagcgaggtcgacgacctgtccaccaactacctgtccacgcagcttatgcagctgatcggcgcaccgctgaccgactaccagaaagcgcacatgacgctacgcgagtcgctgcccgccatcaactcggtcggctacgaggacgccagcctgcgctgggcgctctcctccaacgtcaccggtgacgatgccgccgccgcagccgccaccaaggcgcgcgaagattacgccaagatgcagtactacgagatgttccgcgacggcaagaacgtgtacaccgagcacttccagaccgaggctaacgagaccgaccccaacctggcaccgggtacgaccaagatcaagtagcgagcctgtatcccggttcgtctgcccggacggcgcggaacgtaaggttccctgctcggacagtcctgcgcaagacgaaggccacattaagtggccttctttgcgtgcggaactcgcgatgaaccttatatgcctccgcctggacagacgccctgttgttggagcgcggcttgtcatgggggtatccgcaacatatataagttgaaggccacgtcttgtggccttttttgcatccggaaaccgtgtcccagaattcacgtccggagtgggatgcagtttccgcttacggccccgttgggaaactgcatcccactccgattgcaaattccgggtcgcattttccaccagagccctcaaccggaaaccgcatcccattccaaaggcaaattccgggacacactttccgaaaccccatccatccggaaagcccgtcccactctgaatacatccagcgaacgcatgcgagtgtgtcgtccaggacggtctcgtcatcggggtaatggaaaatgtcaccccaaacgcctgccacggttgcgcctacaagtgtcaagaaaaaagcctcgagaacttcgaggctttcacatttgtattgttttgcacgaaggatcgcggacggcgaagctactcgcccagcacggccttcttggcggctgcggccatgttgtccaggtcctccttggtaggatggtcctttgcggcaacccagttgtcgagcagcatcttaaatcgggcgttgtcgggatcttgctcgagcatggcctcgtagcgctgcttgaccgcagggcccatcttgccctgacacatcgcccagcccgcaagctcggcatctccagccaaattggaggtcacgcggtcgataatctgctggtaatagctctgatcggccccaaagccgcaggtgccaaacaggaagacgcgcttgccgtgcaaagcggagagcaacgccgcgaccgaaggcgtgcacgcgcccttgtcgcaccaaaaaccgacgagcaccgtgtcggccgcgcaggcgccctgcgcctcgagcgcaacctgatctgcatccgcatcgtcgctcaacgccgcggcatggacaaactcaacacccgcagcctgcagagtgcgcttgatcgcacccgaaaccatcctggtattaccgctcttgctgttaaccaccaaagagcacgtcatagtcacgttgcctcgtatcccccaaaactaaagccactaatgcaatttattagatgactatcttagtactaacgtgacagatgtaaaccaccgtctgtcgattgattaatttgccccacgggcttgcttactgggcaaactggctgcggtagagttcggcgtagaagccgcctgccgctagcagctcgtcgtgcgtgccgcgctcgataatctggccgtcgcgcatgaccagaatgcagtcggcgttgcgaatcgtgctcaggcgatgcgccacgacaaagctcgtacggccggccatgagctcgtcgaatgccgcctgcacctgcagctcggtacgcgtatcgatgctcgacgttgcctcgtccagcagcagaatcgccggatcggtgagcataacgcgcgcaatgcacagcagctgtttttgaccctggctaaacgtgccgccgtcctcgccgatgaccgtatcgtagccgcctggcagctgcacgataaacttgtgcgcatgcgcgcgcttggcagcttcgataacctgctcgcgcgtggcgtcgggacagccgtaggcgatgttttccgccaccgtgccctcgaacagccacgtatcctgcaacaccatgccaaaggcatggcgcaggcttgcgcgcgtgtagtcacgcgaagacctgccatcaaccgtgatgtggccggcatcgatatcgtaaaagcgcagcagcaggttgatgagcgtcgtctttccgcagcccgtggggccaacaagggcaaagcgcatgccgggcttggcctcgatgcagatgtcctgcagcagcttgcggtcggacacgtagctaaagtccacatgctcaaaggcgacctcgccctgcggggcagcaagttccacggcatccgccgcatcgggctcctgctcgcgggcatcgagcagcgcaaacatgcggcgcgccgaggcatacgccgtctggatctgcgtaatgacgttggtgacctcgttgaacggcttggtgtactggttggcataggacaggaagatctgcacgccgcccaccgtaagcgccgcgggcacgcccgtgatcacgcccacgcagccgatcacagcgaccacggcatagatgatgttattgataaagcgcgtgccggggttggagagcgaacccataaactgtgcgcgctcgcccgcggtgtaaagctcggcattgagggcatcgaagcgctgctgggcgttgggaccgtaggcaaaggcgtcgacaagcttttgctcgcctacgtactcctcgatatgaccaccgagctgcccttgaatacgctgctgtgccgtaaagcttttgttggagagcttggcaatagcaccggctgcaaaaatggaaagcggcgtgacgagcaccaccacgagcgtcatggtcaggttgatggaaagcataaacgcgagcgtgcccacgatggtaataacaccggtaaagagttgcgtgaagccctgcagcaggccgtcacccacctggtcgacatcgttgaccacgcggctcatgaggtcgccgtgagcatggctgtcgataaagctgagcggcatgcggctgagcttgtcgctcgcctccacgcgcatgtcgcgcaccgtttcgtaggacaggcggttgacgcagtagccctgcagccactggaaggccgcggctcccaccacgacgagcgcgagtttggtgacaagcggcagcagcgcgtcgaagtccacctgcccgacggcaacgatcaggtcgatgccctcgccgatgagaatgggcgtgtagagctgcagaatcacggagatggcggcactcacaaacgacgcaacaaacgaaatgcgatgcggacgaacgtagcccatcagacggcgagtcaccgcacccacgggatagcgctcggggtcgccgggctggcgcggaccgtcgcccaggtcgttgaggttatcgttaccggacacgttggccgtcatcgtggcgaccgaaccggaggaagtgtacggattcatttagcagccctcctttgcgcaaatggatgccggggcagtcggggcggacgcggggcttagggtggacgcgggcgccggagtgggcgcgggcgctgtgctcccccgctggccctcaagctcctcgcggcgcagctgcgactggcaaatctcgcgatagagccgacaggtcgcatagagctcgtcatgtgtgcccaggccggcaaccgagccgtggtcgagcacgcagatcacgtcggcatcgcgcacggtcgaaacgcgctggctcacaatcaccgtggtcagcggcagcccgcccttggcggcaccgcgcatgctgcgctcgcgaatggcatggcgaagcgccgcgtcggtcttaaagtcgagcgccgacgcggagtcatccatgatcaatatctgaggcgaaccaaccaaggcacgcgcgatagtcaggcgctgacgctggccaccgctaaagttcttgccgcccgcctcgaccggggcgtctaagccctgcggcttgttgcgcacgaactcgctggcctgcgccatgtcgagtgccacccagagctcctcgtcggtcgcagcttcatcgcgccaggtcaggttgctgcggatggagccgctcaccagcgatgcgcgctgcggaacggtcgcgaccacacggcgcagctggtcgagcggccaggtgcgcacgtcgacgcccatcacgctcacgctgccggtgctcgcatcgtacaggcgcgggatgagcgagacgagcgtggacttgccgctacccgtaccgccgataatgccgagcgtcttgcccagcgggagttccagcgtcacatcgttgacagcattggccgcgccagcgccaaacgagaagctcgcatggctcaagctcagcgcgggaactgaagcgacattgcccggcttgggcagcgcgaccggctggttgccctcgtcagcgatgcccggcacgcaattgagcacctcgttgatacgcgacgcgctggcgctcgccttggtaaagaccacgaccaggttggcgacgtacacgatggaggtcagggtctgcgtcatgtagttcacaaacgccatgacctggccctgcgtaagctcgcccacgctgacctggatgccgcccacccacaggatggcgcacacgcccaggttcatcaccaaaaacgtgacggggttgagaatcgacgagagcttgcccaccgcgatggcagtattggcctggtcgtcggcggcctgcgcaaagcgctcgcgctcgtgatcttcgcgcacgaaggcgcgaaccacgcgggcgcccgaaaggccctcgcggcagataagcgcgatgcggtcgagctttgcctgcagctgcttgtagtacggaatgcagcgcgccatgacaacccagaacaccaggccaatggcgggcgtgcagatcaaaaagatgatgccgagcttaaggtcgatggcaagggccgcgcacatggagcccaccgctagaaagggccagcggatgagcatgcgcacgcccagcgccacagcgagctggacctggttaacgtcgttggtaatgcgcgtgatgagcgacggcgtgccaaagcggtcgagctcggcatagctcagcttgttgatgtgctggtagagtgcgccgcgaatgtcagtacccatgccctgcgaggtgagcgccgccatcttctggcaaacaagcgtaaacgagatgccgattacagccatggcggcgagcaccatgccgtagcggacgacggcactcacgtcgtgcgcaccgatacctttatcgatcatctgggcaatcaccagcggcgtcagcaggtcaaagatcacttcaatcaacttgcacgcagggccaatcaccatataccggcgaaacttaccaccaaaacgcctgagcagctcaatcataaaaaggcgctccctatcatcatctcaattcaatctgattcatgatagtacggagaaccctggagatgcgtaagcaactcgttacagatgtaagggcaacggtcactagcgcccaaggcacgtagcagccgatgttttggcaacgccagcgagcggcataacgccggggattcaattatcagataaatgtgacccttcaggcggttttggtcggctacccgcgggtgccggcagggcgcttggtagtcgagcgatcccgcaggcgaagccgaggaccagcgagacaccaagcgccctgccggcactcgcgggtagccgcggcaccaaaaaacgcctgcgcactcgatggattcggatgcccgacagaggctccttatggctgcttccttccggacctgaccagattcggaacatgtcgtcatccgaacccatcgaacgcgctaggcgctcgatatatcttacccgctcccgcccgatggggcaaggtagctaatttgggacggggctttttgactacttgggcaatcagatcgacaggtagtcaaataagccccgtcccaaaaagactggtctgctgccgtgccacaaaaggggcctatctactacgtttaggccgcaggggtcaaccatagccggctttttcgaaaatcggcaagctttctacctgcggttttaatttcacaaaatccgggatggtcaagggcgctcggctaaacgtagtagatggccgcatttcatggcggacggtccgacccaaggcccaaggcgaccagcctcggatagccattctcgaagttgcggtggaatagttcctgtttttgccgcctgagccgccaaacaggaactattccaccgcaacttatagggagttgggttttagaggcgggcgaggtcgtaggcttgggcggctgcttcaccggcgcagatgaggttggttgtggcttcctgggggtcgagcgcttggtcaagaggcatgggcctgcggcagaccggcaggaccaagtcgatgccctgaccatacaccgcatccaaattatccgcacgaccgcccacgacggcgactaccggcttgccatagcgattggcacggcgggccacgcccaccggcgccttgccggcagcggattgctcgtccatgttgccctcgcctgtaatgaccaggtcgacatcgcgcacgcgctcgtcaaacccaatcagatcgagcaccgtctccacgcccgaacgcaactcagcaccgagcgccagcagcgcggcgcccaagccacctgccgcgcccgcgccaggcacgccgagcaccgagccaaatgtccgcacgccctcgggcacgcgcaacaacccctgagcccgcaccccggtaatcgccgcatcgagcaggcggccgtagccgaccatccaactgtcgtacctgcccagcgcttcgacatcgtctgtcggcaggcccttttgcccgccaaacactgcaagtgccccacgacgccccacgagcgggttctcgacatcagagagcacgacgatacgcgcgctattcagcgcccgaagcgccggtgccaaatcgatactcgccacctgctcaagccccgcgagaccaggggcgacatcgcagccctgatcatcgaccacacgcgcgcccagcgcctgcagcatgccggcgccaccgtcgttggtggcactgccgcccagaccaatatagatagtctttgccccagcacgaaccgctcgaagcatgagctcgcccacgccataggtcgtagcggccaacgccgccggctctgtgcaaggcgaatacccaatacccgccgcctcggccatctcgattacagccgactcgtactcgccgtccaccagcatccgggcagacacacagtcgcccagagggcctgcgacttcacatgccacgacctcaccgccgcacgcggcaacggcatcgagcgttccctcgccgccatccgccagcggcagcgcgcttacctgggcatcgggccacacgcggcgcacaccttcggcaacggcctcctccgcctgcgcgctcgaaacgctgcccttaaaggagtcgatcgccagctgcacacggcggggccggcggcacgcggcaccaaaatcgaccgccccaacggcagtatcttcgacacccgcaagcgcctcggcgtgggcggtatgcgcctcaagatcggccccacaaccgcagccagcaccatcggtgccacgcagcccactaaaataaccgctcagcaccgcgcggcactcgtctgccagcacgccggcggtcacattaaaccgatgattcaggcgcgaatcggcattgaggtcgtatagcgaccccagagcgcccgctttagcatcagccgcgccgtacacgcagcgccccacgcgcgcgttaaccataagccccgcgcacatgcagcagggctcgagcgtcacgtagaccgtacaatcggaaagacgccagcgtccaagcgactgagcggcggcgcacagggccgaaaactcggcatgcgccgaaggatcctggtcgagctcgcggcgattatgcgcccgcgcgacaatctcgccgtcgcgcaccactacggctccgatgggcacctcgcccaccgcagcggcggcgcgcgcctcggccagcgcctcacgcatgaacttctcatcgatttcggtgatcgtcatcgttcgccttccctgttgcaaatccaaaacgatgctatcattacgactcacggagagatggcagagcggttgaatgcggcggtcttgaaaaccgttgagcgcgagagcgttccgggggttcgaatccccctctctccgccactcctagtgatgcaccggtgtcatggtccgctcaaacagtgcatcgaccacatcggctatctcaggtcgacgctcaagatcgtggcccgattcccaccatatcgtgaaaagtcgaataataccgccggcgacaaactcagacgtcgtctcgagtgacacgggggccagggcatcctcggcaagcacgttcatcacacgctcgcggatggagcgggcaatgcggtcgcaaataacgttggtcaacatgcccgacatgctgcttgccaaaatgttatccatgagccgctcgtgcgccagaatcaaatccatggcatcgtccaaaatcgcgtgccgaagcgcgcgcacgtcctcggcagataccgcgccggcctcatcgggctgtttttgcggcaagcccgacatgagctcatcgatataaaaggcaaagtaatcgttcttgtcgcgaaagtgcttgtagaacgtcgtgcggcgaatcatggcgcggtcgcacagcatggcaaccgtcaggtcctcaaaacgatgctcctcgagaagctcggtaaaggcatcgaacagggcgcggtaggttttcttgatgcgaaggtccactggtatcgccatcctcagggcaaagacaacactcgtcaatctgtcgcatatcttacacctgtacctcgcgcgctttgccccggtgccaaccccgccgaaaacacaacgcttaccggaaagttcggcacgacaaaacgttgcgggtatactagtagcgttataccaacggcagctggcgcatgccgccgcggccattcgaaacggagacatcatgcttcccgtcatcatcggcatcgttgttgtcattgtgattgcctgcgccatcgccggcatctacaacaacatggtcaccaagcgtaaccgcatcgataacgcctggcagaacatcgatacgcagctgcagcgtcgcaacgacctgatccccaacctggtcgagaccgtcaagggctacgccaagcacgagcaggagacgctctccgccgtgatcagcgcgcgtaacaccgccgtcaaggccaccacgcccgaagccaagatggaagccgacaacgtgctgaccggtgcgctgcgtcagctcttcgccgtagccgaggcctatcccgatcttaaggcaaacaccaactttacgcagctgcaggcatcgctcgaggataccgagaacaagattagctatgcacgccagagctacaacgattgcgtgctcagctacaacaacgccattcagacgttcccggctgtcatctttgccggcatcttccagtttaaggagcgccagggcttcgaggccgccgaagcagcccgccaggccccgaccgtcaagttctagtagtttgacagcgcatccttaatcggccaaatgcataaaccgccccgtcgaatgcatactttgaactgcctcccatttcttggacacgagaaatgggaggctttttatgcgtatcgcgatacgcataaaaagcctcccatttctcgtgtccaagaaatgggaggcagttcacggcgacgggcttttttcttccccaacgccgggattcgaaccccgagggcattaaatcacactgtcgtccaagggcctgtgggcaaaaaatagcaaatatgagtactgtcaccaatttagtaacagcgatttcatgccatcagaaggcgatttagacgccaggggtcctacgcgaaagaattgcaggcgtttatcagctaagtacttgaacatatgttgtgtaacactgcatattttgcaaaaaaaaataatgctacaggacttgtgacagtactcatatttgacgttttttgtccacgcccccttattgcgtgggcgaatcaggtgcaaaacgggcttcaaagcgtccttcgcaaacaaaaaccggggcccgcatgatgcggaccccggctcaataccgtgacgatatgtcagttacgctctacacgtagaacaggatgtcgtcgtaagtcgggaccggccagtagtcggcagccacgatctcctccatggcatccacggcggcgcgcagcgcatccatagcgggaacgacctcgtgcgcgtacacgttggcctgctcctggttatcgagggcctcagccttctgatgcacggcgtcaagcgccttgatggagtcgttgatggtggtgatgccgttgcagagcttgttgagcgtgttctgctcgcactgcatggcggcctcagcaccggcggcacgaatagtctcaaggcccttagcgaccttggtggcataggcggtaatgaccgggcgataggtacgacgcgcctcgcgaaccatcgtggtggcctcgatgttcatgagcttgttgtacttctcgagcttgcaatcgtagcggcactgggcctcggccttggtcagaacacccgtctcctcaaagagcgcaatggccttatcggaaacaaaggcgggcagggcgtcggccgtggtcttgttgttggcaaggccgcgcttctcggcctcgacgggccactcgtcggagtagccatcgccggagaagaggatgcgctggtggtcggtcaggaccttcttgcagtactcgagcgcggcgtcctggaactcatcctcgggcgtaccctcaagcgcgtcggcgaaggacttgagcgacttggccacggcggcatcgagcaccaggttggagtcggagacgttctgctcggagccgcaggcacggaactcgaacttgttgccggtgaaggcgaacggggaggtacggttgcggtcggtgttgtcctgcatcagtttgggcagagtatcggcgcccaggtcgagcacgccgcgcgtggcatggacagaagccttgccatcgatgatcttctcgacgacctcggtaagctggtcgcccaggaagatggacataatcgccggaggagcctcattggcgcccagacgatgatcgttgccggccgaggcaacagaggcacgcaggagctcctgatagttatcgacggcctcgatcaccgcggtgaggaagacgatgaactgcaggttgtcgagcggggtgtcgcccggatcgagcaggttctcggactcggtgccaagcgaccagttgttgtgcttgcccgaaccattgatgccctcaaagggcttctcgtgcagcaggcagaccaagtcgtggcgggaggcgatgagcttcatcttctccatcatgaccagattctggtcgatggcctcgttgacctcgccatagacaggggcgagctcatgctggcagggagcgacctcgttgtgcttggtcttggcgggaatgccaagcgcccacagctcatcgtccaggtccttcatataggccgagacggtggggcggatagcgccaaagtagtgctcctcgagctcctggcccttgcagggagcggcgccaaagagggtgcgaccggtgatgaccaggtccctgcgcttgcggtaagcgtccttcttgatcaggaagtactcctgctcatcgcccacggaaggaacgaccttcttgggggtcttgccaaacagcgccaaaacgcgcttggactcacgcgagagcgcggtcatggagcgcagcagcggggtcttcttgtccagggcctcgcccgtgtaggagcaaaaagccgtggggatgcacaggacatcgtccttaatgaaggcagggctggtgggatcccaggcggtgtagccacgggcctcgaaggtggcacgcaggccgccgttggggaagctcgaggcatcgggctcgccctggatgaggttcttgcccgtaaacttggtgatggcggtgccgtcgtggttgggctcgaggaagctgtcgtgcttctcggaagtaatgcccgaaagcggctggaaccagtgcgcgtagtgcgtcgcgcccttggagatggcccagaccttcatagcgtgggcaacagcgttggccacatccaggtcgagcggctcaccgtcctcgagggttgcagcaaggcgcttccaaatgtccttggggaggtagtccttcatgacttcctccgagaacaccatggtcccgaagcggtcagtaagttcggccatacggaactcccttcgtatcggcaccgcgtgagaagcggtgttgattactaacgaacgagtcatagcttagactcggcgtgtttccgcaacattaccgttatgttgctgtcgcgaaaccaatcaatgaggttaccgcatcgcggcggcgttgccaccctcaacagccaatcaactgtataaattgcagacctttccccatggtttaagggtagtcaatttgagatggggctctattaactggtatttcacatcgaataccagtctttatagccccatcctagattgaccgccctgttatagggaatgccgatagcaaagcattttcgattggtatccccaaatagcgagtgaaactccgccgtgacacagtggtgctgtagaatccttacaacacatcacactattacgtatctagaggagcacgatatgcgcgtcgacgaggtttttaagcaggcagcatcccagggcaccgcacccgtttcgtttgagatgttcccgcccaagggcgagctcaccctcgacacggctcgcgaagtggcaggcaatctgtgcaagctttcgccgagctttgtctcggtcacctgctcggccggcggctcgggcaacggtgccaccaccgcccccatcgcgcatatgatttcgagcgaattcgacacgccctcggtggcgcacctcacctgtgtgggccgtacccacgccgatatcgccgccaagatcgatgagtaccgcaccgccggcgtgaaaaacatcctggccctgcgtggagatctccctgccggcgcgaccgaggacgacaagcccgcctccgactacgcctacgcccgcgacctcatccccgagctcgtcgacgccggcttttgcgtgggcgccgcagcctaccccgagggccacattgcctgtgaggatctcaacctctcggtcgaacacctcaagcaaaaacaggacgccggcgcgagcttctttgtgacgcagctcttctttgataacgagtgcttctaccgttttcgcgagcttgccgacaaggccggcatcaccgtgcccattaccgcgggcatcatgccgtttatgggcaagtcgcagatcagccgcatggtctttatgtgcggcgcgtcgctgccctcccccgtcatcaagattctcgccaagtacgagaatgaccccgagagcctgcaggcagctggtgtagattatgccgcccgccagctttgcgacctcaaggagcacggcgccgacggcctgcacctgtacactatgaaccgtcctgcgatcgccgcgaccattatggagcgcctggggtaatggaaaaaccgcacatcgatacaaccgctgtcgaagtgccggccgaccttgcgtcgccggcgctttaccgtgtcgatgctgcgcaccatccccgtgtcgaccgtgccgagatgctgcggtatctgggttacggcggccagcagattgagcccgaactgtcacgacgtattgagcttgtcgttgaacgtctggaactggacattgagccccgtggcgtgcgccgcgtatttgccgtcgatgccacgggcgtggacgaacaaagtgagccttgcattcgcttggtcggcaccaatgttgagctgcgaggtcgcgatatctatcgacatctcaaagatgcccgctttgccgcgctcatggcatgtaccctcggcatggacgccgagcgtcgcctgcgcaccacgggagcccaacatcccctggagggcgccgtgctcgacgccgcgtgctccgcttacgtggaagccgccgttgagcaaatggaccagcaggccaagacggacgccgccgttcatgggctcgccggcaactggcgctttagtcccggctacggcgactgcccgctctcggcccagcgctcgatcgtcaatacgctcaacgccacgcggctcatcggcctgaccgtcacgcccaccagcctgcttatgcccaccaaaagcgtgaccgcggtgatcggtctgtttgacggcgaggtccacgacgcccagagccgccccacctgcaatatctgccgcatgcgcgagaactgccgcttccgtgccgcccacaccacctgctattccagccattaggagcccccgatgtttactccgcttatcactcatgattctgacggcactgcattggcggcacccgttgatgccgcacgtcgcaacggtgccacgtacaagacgcgcacgatcgacgatctgcgcattaaggacgatcgcctgcgtgcggccatagagggcacggggcacctgctgttcgacggcggcatgggcaccatgttgcaggccgctggcatgaaggcgggcgccctgcccgagctgctcaactttgaggagccccaggtcattaccgacattcagcgccagtacgtcgaagccggctgcgacgtgatcaccgccaacacctttggcgccaatgcccacaagctcgacggcgccgccaccgtggcagatgtctttgccgccgctgtcgcctgcgcccgcgcggctggtgcccgctacgtcgccggtgacatcggccccatcggcgcactgcttcgtcccttaggcaccctcagcttcgacgaggcctatgacctctttgccgaggaagtgcgcgccggcgtcgccgcgggcgtggacctctttattatcgagaccatgaccgacctggccgagatcaaggcggcggtcctcgcctgccgcgagaactccgacctgcccgtctttgccaccatgacctttgaggaagacggccgtaccttcctgggcacgagtcccgaggtcgccgccatcacgctcgacgccatcggtgccgacgttttgggcatcaactgcagccaaggaccggccgagctccgaggactcgccgcacgtatgctcaccgttaccgacaagcccgttatggtgcaggccaacgcgggactcccccatgtggacgacgacggcaacaccgtctttgatatccaggcccccgaatacgccgaggccgtcgccggcatgatcgccgacggcgtgagcgtcgtgggcggttgctgcggaaccacgccggcgcacatggcggccttgcgcacgcttatcgacaaccacacgcccagcccgcgccaccgcaagcccagcatgtcggtcacaagcgcccagaccgtggtggaccttccctgcgacggccacaagatcgccgtcatcggcgagcgcatcaaccccaccggcaaaaagcgtctgcagcaggccctgcgcgacggcgatctggactacgtcgtgagccagggcatcagccagcaggaacagggcgccgatatcctggacgtcaacgtcggcctgcccgagatcgacgaggtcaagatcatccaacaggcgaccgaacagctccagggctccacgctgttgccgctgcagatcgactccaccgatcccgccgctgtcgaggccgccgtgcgccgctacgccggcaagcccatcatcaactcggtcaatggcaagcagcagatcatggatgagatctttccgctggtcgcccactacggcaccaacgttgtcggccttacgctcgacgaaggcggcatccccgataccgccgaggctcgcttcgccatcgccgagcacatcgtggccgaggctgcccgttacggcatcggcccggaccgcgtcctcatcgactgcctggtcatgaccgcctcgaccaaccagcgccaggccgagcagatcctgcgcgccatgtccctgtgcaaggagcgcctgggcgtcaaatgtgcgctcggcgtgtcgaacatcagctttggcctgcctgcccgcccgctgctgggctcggtctttttggctgccgccttcggcgcgggcctggacgcccccatcatgaacccgggttccaagcgctttatggataccgtctacagctatcgcgtgttgagcgttgaggacgagggctcgaccggatacatcgagcgctatgccggctggaccgatccgtacaagatcgccgccaacccggcagctgctcaggccgcatcgagtgatgccgcgcccgctgccggcaccgccggcaccgacggcaacgacgacccgattcgtcgcatggtcgtctcgggccgcaaaggcgagatcgcgggcgagaccgagcgcctgctagcggatcacgacgccatggacctcatcaacaaccactttatccccgccctcgacgaggtgggtgtcctctttgaccagggcaagttcttcctgccgcagctcatggcctcggccgaggccgcgcgcgtgggcttcgacaccatcaagcgcctgatgcccgccggcgagatcgccgacaagggcaagatctgcgtggccaccgtcaagggcgacatccacgatattggcaagaacatcgtcaaaatgctgctcgataactacggctataccgtctttgacctaggccgcgacgtcgatccgcaagaagtgctcaagaccgtcaaggagcgcgatatcaagctcgtcggcctctcggcgcttatgactaccacggtcgtcgccatggaggaaaccatcaagctgcttcataccgaggtgccaggcgtcaagatcatcgtgggcggcgccgtactcacccccgaatacgccaagcagatcggcgcggactactacgccaaggacgccgccgagagcgcgcgcatcgccgaagaggtctttgggcagtaacacaacggaaacaaccgagcaccaaaacgtgccgcatgcgccacttggcacgtgcagcacgttagaatagataagattatgctcgttttggcagataggagcgcaaggatggcgatcacgcccgcagaaatcgcggaaacccgcggcatggttgaggagcagaacctcgacatcaggaccatcaccatgggtgtttcgctcatgggttgcggtgacgagaacctcgaccgcatgtgcacgaagatctacgaccacgtgacgcacacggctgagcatctggtcgagaccgccgagaacctcgagcgcgagtacggtatccccatcgtcaacaagcgcgtttccgtcaccccggtggcgcagatcgccgcgtgctgcaaggatgaggacctcacccctatcgcgcatgccctcgaccgcgcggccgagacgctcggcatcgattacctgggcggcttctctgcactcgtccagaagggcatcggcgacgccgaccgccgcgtcatccagtccatcccccaggcgctcgccaccacgagccgcgtttgctccagcgtcaacgtcgccagcctgcgcgccggtatcaacatggacgccgtgctcatggccgcccagaccatcatcgatgctgctaaactcacggccgaccaggattccgtcggcgcttccaaatttgtctgctttgccaacatggtcgaggactccccgtttatggcgggcgccgtccacggcggtggcgaggccgacgccgtcatcaacgtaggcgtctcgggccccggcgttatggccgcagccctggaaacgctgcccgattccgcatcgatgatggaagtcgccgagaagatcaagcagaccgcctttaagatcacccgtgccggcgagctcatgagccgcgaggccgcccatcgcctgggtgtcgagaagggcattgtcgacctgtcgctggctcccacgcccgccatcggcgactccgtcgcgcgcatcctcgagatcatcggcgtgggcacctgcggtggcccgggcacgacctgcgcgctcgccatgctcaacgatgccgtcaagaagggcggcgtcatggccagctccagcgtgggcggtctctcgggcgctttcatccccgtgtccgaggacgccggcatgatcgccgccgtcgaggccggcgcgctttcgctcgagaagctcgaggccatgacctgcgtgtgctccgttggcctggacatgatcgccatccccggcgacaccccggtcgagaccatcgccggcatcatcgccgacgagatggccatcggcgtcatcaacaacaagaccacggccgtccgcgtgattcctgctatcggcaagggcgtgggcgactgcgtcgagtatggcggcctgttcggccgtgcgcccatcatgccggtgaaccccaacgccggcaccgtgcttgcccaccgtggcggacgcttcccggcgccgctgaactcgctgaagaactagctgagggggactggcgaggagccccggggagggcaaatatataaggtcgcctgctcggacagtcctgactcgcacggagagcacattaagtgctctccggctcgtgcggaactcgcgatcgaccttatatatttgccctccccggggctcccgcacaacgggacctcggttgggttctatccctttggcagtcgcttcgcttctgccctactttactggtatggcggtttggcgttggatcggttctttctgatatatgctggttgcggctcttcttttgggaggagtcgcttttttgttgtgagggggatggcccgtggctgatgatttgattcgttctgagctgctttctgcggattggaatggcgaatggatgcgtctgcaggctggtcggcggcgggctgatgattcttttgagtgggataaaagggctcggcattttcggccgttggagactgccccttatgctcgggattttataaagctgttggcgttaaagcctggtgaatccgtgctggatatggggtgtggggctgggtcgattgctattccgcttgcgcaagacggacatcccgtgattgccgctgatttttcccctgccatgttgggcacgcttgatgccggcattgagtactacgggctcgaggggcgtataacgccgcttgagcttgcttgggatgacgattgggatctggttggaccggtcgcgaaagcggtggatgttgcctttgccagtcggtcggttacgacgaccaatctaaaaggtgcacttgccaagcttgaccgtacggctcgtcggcgttgtgctgtcacgatggtcgccaactccagcccgcgctatgacctgcacctgatgaacgccatcggcgcctcggttacctgcagtaatggctttgtgtatgcttttaatatcctcgttcagatgggtgtcctgccgcaggttacgtactttgaatcgccccgtcgcgataccttcgacagccttgaagcgggtgtggcggacttttctcgtatgctcgagcatggcaacgaggacaagatcgactgcctgcgtgactacatcgctcaacacatgattgagaacccccatgccggcgagccggggtccaagggcgtgccgcaggggcgctatatgctcgatcatgtccgcaaggttcgttgggcgtttattgcatgggagccggtctctgcgcccagctcatagcctgttcacagcccgcaccgcccactcactcggcatccgcattctttttgaactgggaaaacgcgctccacaccgcgccgttcctgcgctatcgtgggacagctcacgtagattaaggccccgtcgcggggcgccccatacatagaaagcgagaacccatggcactgacaggagcacaggtcaagcagcttcgcagcatggcccatcacctcaaccccgccatcatcatcggcaagtccgacgtcaacgagggcaccgtcgagcagacggtcgcctacctagagaagcacgagctcgttaagtgctccgtgctcgatggctccagcctttccgcccgcgaagccgccgaggagctcgccgagcgttgccacgccgaggtcgtccaggtcatcggccgcaagttctcgctgtatcgcgagtcctcgcgcaaggacatcgagaagatcaaactcgtctaggagccaatgatccggcgagccaacacatagcaagcttacgggtgcccaagtacttcgggcgcccgttttttatcgttcgaccagcacgcgattgagccgcccctccaccaagcgctcgtataggcgccgcgtctcgggctcgggcacgccattgacctgctccctcaggtggtgcatatgcccgctgtacagctcgacgatatcgcgccgtcgccccgccgcactgtagacgcgcatggcgcagcgcaccatatcctcacgcgccgtttcctgtcgaagccccgactccgccagccaaatcgccgactgcagatcgttttcttctagagcggcatttgctcccttaatcatgcaatcgatgtactttgactgcataatgcgccgcatgcgcaaaaagtaggtgggattacagccattgggaacatacaacggtccggcataaagctgttcaatcttaaggcacaactcgaccagatggggcccgcgcgcacccgtgcgatttcccaaaacctcgcggcttatctggtcaaacagccgtacatcggtcttgacgtagtcgccgttgagcccaatgcattcattttggatgagcacgcatgacttgccatccggcgtcggccccaaagccgaccgcaagcgcgatatcgtcgagtacaggttgttgcgggcgctattgaactcggcatggggccacagctccatggccagcgtctcacgatcgacgagcgcatccatgcccagcgcaagccgctcggcaagtgtcgccgccttcttgcggcgccacattttgtccgtgatgggaaacccgtcgcgctcggcgcgaaacgccccaaacatacgaatctcgatatggtcgatggtatcaacggcttcaacctcgccggcctggaacaggcgctcgccctccccttctaaatcgtcgcgcagcgaataccgcgacagctcgcgcacgggaagcttcttgcgtatcctggccgccggctcgcccagacaatgcatggcaaggcgcgcaaagagccgatacgatggctctagaattcccgcacgattcatggacatccaggccgcaagatcgctgtctcggcccgcacaggccaaatgcagcgccaccatccaggcttctgcgccaccaacctgcgtctggcttatatcgagtagctccgcttcctcgcgtaccgaaaccatcgacgtgttacgcagatacgctgcgcgctccagcagcaatgcgttatcgcgcatgtacgcaatcgactcctcggcaagtttaagcacttggaccgcacggaactttgcattaaccggccgtccctctgccagcgactgccaaccttctagcaacaggccaaacagctgaatctggttgtcgcgcatgcgcacggcaaaacgatcgagctcgttgaacgccgcatcgtcggttaccggcaagccggaaaggagccgccgtgccgccaacaccatgcgcacccagatagccatcgccttaagcccacgtacgtcgagcgcctcccgcaccaccgtcatctcgtcgtcgcgctcgtcggttcccgcaaacgacccatcaaagagctccaccagcatgctatcggcccgtataacaatccccgcgatgtcgagctcgcagtcgtaggccctgctcgttttgagctgctgtagaacgccgccgtcatttccccgctcggtcagacagcgcttgacctcgatatgcgcagacaacatatcgagtgcggtatgggatgtctcgatttctggcacggccagattcgtaggaagcccaagcccgttgtccccatagcaaacagccgtcagtgtctgggccaccctccatgaaacagggtctatttcgcaggccgcccgttcgcccccgcgctcgatgaccgatgccatatagcgggcgagctttgtgttggacacgctgaccgctgccagatatacgccaagcgcctcggcaggcgttggctctggagccggatcgtcagcgtcgatcgtgcccagcgctgctcggcagatatcggccccgtgccccgtcagagcaaaatcgaccccatactgcccagcaagttcaagaaccgcctcacggtccaaaaaggcgtccgccaggcccatcgccgcatcgcatcggcccgccttaagcaaaatccgggccgccctcggaacaagttcggggcgaacctcggccaccaacttacgcaagcgcaagcgtccgttatcctccgtgcccagacacgtaaaactccgctcggcgggatccaagccaaagatcgggtagtcgcgtacaaagtaggactggtcgaccatcgacagcctcaccccgcaagcctcgagttctgcgatattgccctcgcccatcaaaaccatgagacatgccacgcaaaacagcgcattattgtcgagcgaagccagatcggcaagtgccgcgccatatacgttgacaatctcgttttcgagcagaccggctacgtcgccttggccatacagacccgtctgcaatgccgaaacgagctcgggcacgccctgcgtgagctgataaaagtcgagcgatgtgctgatcgaaaacgccgatgcccacgccgaatactcataggcatgcaccttgagcatctgcgcattgatcttaaccgaatcgcccagcccatgaatcagctgacgatttgaaggacggcaggagataaagacccctacccccatagcgcgcaggccgcgaatcctgtcgatgaggtcttcggtatcgcgctgatcgaggtttggcacattatcaatcgcgatcagggagtgcggtttgtctttgagttcttcggtgaccacctcgagctgcataaacacctcgcgcccagtggcgcgatcggcctcgataatccgcacggggcctcgcgtcgggtcgcatttaacctcatgggtgtactgcagcagcaccgaggtcttcccaaacccgtcgggcgcataaagaaccacgatgccggcctttcggcccttggcgataagctcattcatcaagcgttcgcgtcgcaccatatagcctccgcccagcggcatcagctcgaggtcgtctatactgcccaaatcgtttaccatgcccgctcctcaactcgaccgtatggacactgtaaccgcaagaccatacaagccgcgctatgaatagagcgaccttgtgttttaggttgtcttttggtacgcaagcggcaagtttttgtacagcgagggccgattgttattaatcccccgactaatcggtctttaagcaggtaaatggcttgtcagcttgtcccatctaagcggcagtgtaacgcaaatgaacaaggttcagccatgtcattcaactcgcctagcacccgctaccgtctgcgaccttttagtggcatttttgcatagaatctggtatggaatgaatcaagctgttgggcattcgacattcgtcaagcttgcagcaagattttggtcaagcatatgacaaggacagcaaaaaggcccccgcaaagcggaggccttcggcaaagctatgtcgaggtgacgggctcgcgctactcgcagagcgaaagggcggcctcgtcggcgactacgacgcagttggtgtgcagctgcaggatcgaagccgggcactcgggcgtaaccgggccatagcacatgtcgcgcacggcctgagccttggcctcgccgttggcgacgaccagaatcatgcgggcatacatgatggtctgggtgcccatggtgtaggcctgacggggcacgtcgtcgatgctgtcgaacaggcggctgttggcctggatggtgctctcggtgaggtcgacgcagtgcgtacccttggagaagtgatcgtcgggctcgttgaagccaatgtgaccgttgttaccaatgccgagcagctgcagatcggggtagccggcggcagcaacgatcttgtcgtactcagagcaggcagcggcggcatcggggttagaaccgtcgggcacatgcgtgttgttcagatcgatgttgatgtgatcgaagaagttctcacgcataaagtagtgatagctctggggatcgtcgtgcgaaaggccacgatactcgtccaggttgtaagtgctgacctcggcaaagtcgacgtcgcctttctcataccaagcggcaagctgcttgtaggcgccaatcggggtggagccggtggcaaggcccagcacgcaatcgggcttgaggatgacctgcgccgagataatattggcggccttgcggctcatatcctcgtagtctttagctttaatgatcttcattacgcgtcctttctcgtacaagagaggcaaggctcccttacaagcacttgcccgcggcccgcgtcggccgcaaccaacgtgtgcggccaccagggcgaggtcgcgtaatgtatgtgtctcgtgtctaaccgcgtcgaggcccctgcccgtccacggtgacccaaagccttttagcttcggacaaatcccatcttgccacggagggcgtcctctttcaagagcgccctccgtaaacgtgtttgaattgtaggctaatggccacgtgcacttgctagcgctcgcgagcaacgatgagctggtccatctcttcgacatgcacgccaacggaacccttgatgctcgagaactcaacggagttgcacaccaagatgggaaccgtcacatcgtagccctcggcagcaattgcctcgcgatcgaactcaatgagtacatcgcccttatggacgatgtcacccacttgcgcatgtacggtaaagtgcttgccctcgagctgaacagtgtccaaaccaacgtggatgagcacgtccaagccatcgaccgtgttaagcgcaacggcgtgtcccgtgggaaaaatggcctcgaccttggcatcagccggtgcaatcacacgcgttccggtgggctgaatcgccacgccctggcccaaaaggccggtggcaaacgtctgatcgtttacctcggagagcggaatgacgtcgcccgagatgggagcatccagcgtaaggactcgaccacgcataccaaaagaccttaggactttagtgaacatgctccccctcggacataccgattaaccaaaataaccttaacagtttaccacttggcacccgtttttgaccattagggaagttcgcgcttgacaacctcgacgatgtcgtcgacaacgcgctgggtcagctcgtgcgtctcggcctcggccatcacgcggaccagcggctcggtaccgctcgggcgcaccagaatgcggccgcggccgtcaagctccttctcggcggcagcgacggcatcccagatgggctggcaatcgtccagaccagccttgttgtcggaatgcacgttgacgagtacctgcgggtacttcttcatgataccggcaagatcggtgagggtgcgaccggtgcgcttgagcacggccagcagctgcagagccgtcaccaggccgtcaccggtggtgttgtgctccaggaagatgatgtggccggactgttcgccgccgatgacggcgccgtccgcgagcatgcgctccagaacgtagcggtcgcccacggcggtctggaccatctcgaagccctgctccttcatagcgatggagaagcccaggttgcacatgacggtcgagacgatctcggagttggcgagcttgccgcgagcggcgaggtcagaaccgcagatagccaggatgtagtcaccgtcgatctcattgccctcgctgtccacgaacagtacgcggtcggcgtcgccgtcgtgggccaggccgatatcagcatgggtgcgcagcacgagctcgcgaaggggctcgaggtgcgtagagccgcactcaacattaatgtcggtgccgcaataatcggtgttgatggcatggaccgtggcacccaggcgctgcagcgcggcgggcgtggtctggcaagaagcaccgtggccgcagtcgacggcaacgaccaggccgtcgagcctcaggccatcaagcgtatcgatggcgtggtcgacgtatgccttgcgagcgtccttcatcttgatgatgtggcccacgccggcaccggtcggcagcgtgtcggcagccatggcttcctcggacatgacccaggcgctgatctcttcctcgacagcatcgggaagcttcatgcccttgcggctaaagaacttgatgccattaaactccggcggattatgcgaagcagagatgacgatgccgccatcgagctcgttttgaacggtgagcagcgccacggcaggcgtggggatgacgccgcagcagtgcggacggccgccctcggccataatgccggcggtcagagcactctcgagcatggtgcccgaaagacgcgtatcgcggccgatgcagatatccggaccaagaaacttggtcgccgcgcggcccagacgaaacgcgaggtcgcacgaaagatcggcgttggcgacgccacggacgccgtcggtaccgaagatgttctggggcataggattgctccttccctagcaggcgatatgcaaccgcccaccctagtcgaaaaagaaaagcgggacccgccgaggaatcggcaggccccgcttgtacattgtatctcgaaaggagataaaaccttagcgcttggagaactggggagcgcggcgggccttcttgaggccgtacttcttgcgctcgaccacgcgagcatcgcgcgtaaggaaaccggccttcttgaggtcagcacggtagtcgccagcgttcagaagagcgcgagcgatgcccaggcgcagagcgccggactgaccggagatgccgccgccatcgcacagagcgataacgtcgaactgaccggcggtgtcggtcaccttgaagggagcaagggcgttctcaacgagctgatgacggccgaaatactgctcggcgtcacgcttgttgatggtcaccttgccggtgccggggacgagacggacgcgggcgacggcgttcttacgacggccggtaccctggtagacaacggtgttctcagccatctttaagcctccagctcaatcttcgtggggttctgggcagcatgcggatgctcggcaccagcgtagaccttaagcttggtcatctgggcacgaccgagggtggtcttgggcagcataccgcgaacggcgcgctcgatgaccttctccgggtgcttctccatagcctggcggaagctctcagccttgaggccgccgttgtagccgctgtggcgataataggtcttcgtgtcggccttgttaccggtaagctggaccttatcggcgttgatgacgacaacgaagtcgccgcagtcgctgttgggcgtgaactggggcttgttcttaccgcgcaggatcattgcgatctgggtggcaagacggcccaggacagcaccatcggcgtcgacgagaacccagttgcgctggacctcgccctgcttggcgtagtgagtcgatttcgaaatcacttagactcctccatgtacagtacgtgttgttacagagattcacggggctctgcaagtaacccgtccatattaccccgctcgccgtacgagtcaacaggtattttggctccgaccagagtttctgcacatgtcatccatgggtcatgatgtcgcgacactagcgctcgacaaatgcctcgatatctcccagcaagcgctttgcctcctggcggccctgaatatacaggtcgaggagctttgccggatcgtgctcgacatgaccgacctcgaccggcttttgcggagcaacgaccaacgcacggccctcgcgctcatacttccacaggtgcatgcgctggatgttgtaacggtcgtgacgcgtctcgattccctcgagcagataggggtagtcggcatagcgggcgcgcgcggcaggcataaactcgtagggctttttctcgtacgagcggtcctgcgtgacgatgacgaccgcacggtcgaagcccgcctcctccagcacgtgctcgatggggatcgaatcggctacgccgccgtcgacgtatttgtgcccgtcaatctcgactggcggcgtcaccagcggcagcgaggtcgaggcacgcacggcgtcgaggtcgagcacggcgcttttaaccgggaggtacgtggcggttccaaagagcatgtccgtcgcgacggcgtacatctcgatgggactggcgtcgaacgtctcgttgtcaaagggatccaggcggtcctgaacatcgttgaagataaagtcgtagccgacgatggagcccgtggacgcaaacgatgcggcacccatgaagcggctatcgttgcagaaagccaggttgatgcggttggcacgaccgatctggtgcgacttgtagttcacgccgttgagggcgccggccgatacaccgtagacagccggaatctcgacgccagcctccatgaggacgtcgagcacgcctgcggtaaattgcccgcggaagctgccgccctccaaaacgagcgcgaccttgccagcgttctttgccttatcttctgcagtcatgttgacctcctgcgattgcgttttggctttcttctacccagttttgggatggcgagcgcgcagtttttggagttgaggagggcggagcggtcggcgggaaagcgtgtcccgttctcagagcaaattccgggtcgcattttccgctgagcccgtcatcaggaaaatgaatcccatttcgagcttagattccgggatgcgctttccgcttgatgtgtcatccggaaactacgtcccagtctgagcgcggattccgggacgcgctttccgcctgggctgccatcgggaaagcgtgtcccggtctgcgttgccgtagcgttttctttacgcccgcgccctgcacagagttcgattctccgcgggtgggggggatccgttgatgggttgaaaccggggcatgacgcccggtcggcatctcatctatatctggctgaggctttgcgcggagaatccgcgtatttgcttcgcaaatccgcaccggcttcggccgcctgccggcgtcctcgcccgcgggctaaaaacgcttacgcgttttctttacgcccgcgccctgcatagagttcgattctccgcggtatctgtaagtaataaaaaagcaggtagagacacttctctacctgcttgtaactattggtggaggcgcggagaatcgaactccggtccacgaaagccccctgattggcatctccaagctcagtcgctggtttagtctcggacgctttgcgcgcagcgacacgctcgcaacgtcctaaccggttcggtcttagcctgcgtcataccgattacgtgcgcaggagcattcccctaatatgacgtcgcaccggtggcggggaaatcaccgggttgacgcgccgctataaattaagcagcgagagccataggctcaaaagaagagttgttgtcaattcaatttgacggtacccctgtttaacgaggcgaggagacctcggcttgcttcctctctcagagctatcgtgtcgaaaccagtcgcccccgaatgtcgggaagtctggatggcattgggcacgagcacccaacacccgtcgacttttcaaggaacatgcagggcgagccccgcttgtggagtgttatcttaccacgttctgaaagcggacagctgttctatgcacgagctgtgaagaccccaatgtgcgccgcacttcgcacttttgctaccgatcgcgtcacgtatattttcgccaagcaaaattgacccgtcgaaaggaccgttatggataccaagcagcaactcgtcaatgccctcgcaggcctgggttcaaccattaccgaagctatggatgtcatcgaaggctttgtcccctgcggacatcccgccctcacggtttcgaacgcccttgttgcgctggacgctgacgatgatgcagctctcgcccagcagcttgagaccgtcgagggctttatcgaccacgtgagtgagaaccgcggcgtggccgcctaccacggcatcgaggtcgagctcgcggggcccaaggccgatctattcgcagcaatccgcgaggtaggcgcccttatgcagaccgcaggcgtcaagaacacccaggtcaacgagtgggtctaccgcagtctggcagcactcgacagctccgacgaaaaggcagccgagcagctcgcagaaagccccgccatcatggccgagcttttgtaaatagcagacgcgggtccccttggcgcatcgtcgtccaagaggcccgcaaacagttcgcgtcaaccgatagccgcgtcgccgcgttcggccaaagcaagaatcggcatcatttggcgcggggtctttgctgcaagatcggcatgttcgagcagcttgcgatcgttagtcaccaagtaatcgacctgtgcgcgcttgcacgcagcgagcaccaagttgtcctcgtaatcgcgatggagcgctaagtatttgtcggcaagccaaaggtccgacgcatctgcacccacggccgtggcgttttcggtcatgttccgcacaaacgccaacgccgcatcaccaatcgcgcgggcagaagcctcgtcgagcgctcccccgctggcaagaacgcttcgcttcagctcgtgttggacaacgtacagcacgtccttagcgatatgcaccgggaagaacagtaacgcccccgtctccgtcgcccgcccaataaacgcacgcgcagcaagcgactcggcatggtcgacgcaaaacgaatcaacccatacgttggcatccaccatgatcttgagaggcgccccactcactggatcatccccttttggcgataatgctcgtccatggcttcggaatagattgcgtcccagtcgcgatcgtcggatacgggcgacgtagcaatgcccaggtccgcataaagctgatccgccgccgcccatgatgcggcgaacggagtatcgtgcgcgacggtctgccgccggtcgtcgacggccgcaagcacttcctcgcactgcccgccaccctgcgcgaccttggccaccacctttttgatgagctcgggcagcgaggcgcccgaaagccgaagcgcttcctccgcatgatccttgacctggcgatccacgcgaacgttcacctgcgccatgccgctaacagcacccacgtcgatcccactcccttcaattgctagccttgctagcaccaatatataaaaaagctagcaaatggtcaaatgcaaaaagcctgcgcccggacgacaccgatgccgtctgggcgcaggccagataacgtggacgaacacgtctgctaacgcaggtaagccttcgcgttgctcaggctgtaggcaatcgtcgagccgttgtgcagcagtgacgacgtctgcggagtgatcatgccggtaatgcccaatgccaacagcgccgagttggtgagcatcaccttggaatacgaactcgtcagacggtcgataagcccctggctcatgcggcgcaggcgcacgattgcagccagatccgtatcggtcaggatgatatcggcgacctccttggcgatgtcgcttccgccgcccatggccagacccacatcggccaggcccagcgccggcgaatcgttgacgccgtcgcccaccatggcaacgtggcgcccctcgctcttaatgcgctcaacataggcgtacttgtcctcgggcagcagttcggccttaaactcgtcgacacccgcctcgcgcgcaatgcgctcggccgtgcgctccgagtcgcccgtgagcatgaccacgtgcttaacgcccaacgcgtgcaagtcggcgatggcctcgcggaccccgggcttaagcgggtcctcgataccgagcacgcccacaacggtgccgtcgaccgccagatacagcggcgacagaccctgcatctgggactcaatgcgttccttgatgtcggaatcgagctgcgcgctctcgtcctcaaatacaaagtgcgcggaaccgatgatggcgcgacgcccctcgatggacgaagcgatgccgtgcgccacgatgtactcgacggcggcatggcgctcgcggtgctcgagcccgcgctcgcgtgccgcattgaccacggcgcgcgccaccggatgcggaaaatgctcctccaagcaagcggaaaggcgcaggacctcgtcctcactccagccatcggtggtgagtacgcagacaagacgcggctgcgcctcggtgagcgtgccggtcttatcaaacacaatggtgtcggccttggcaaacgactcaaagtacttcgcgcccttgaccatcacgcccatcttggcagcatcgctcatagcagtcatgacggcgacggagcccgtgagcttgagtgcgcacgagtagtcgaccatcagtgccgctgaggtcttgatgaggctgcgggtggcaagcgcaaccaagcccgcaagcaggaagttccacgggacgatcttgttggcgaggtcttccatgtgcgactggccctcggacttgagcgagtcggccgtctgcacgagtgagacgatcgagcgcagtttggtctgcgccgtgttggcgcgcacgcgcaccaagatgctgccgtcttccacgacagtgccggcgaacacgtcgtcgcctgcgctgcgctcgacggcaagcggctcgccggtcagggtcgcctggttgaccatagcgctcccctgctcgacaacaccgtcgatgcaaatggacatgccagttcgcacggcgaccaagtcgccgggctcaagctcggtcgcggcaacgcttacctcggtgtcgccgacgaccttttgcgccttgtcgggcacatcgagcagcgagttgatgagctcgttttcgctcatggcgcgggtgtagtcctcgagcagctcgcccacgttgagcagaaacatcgtctggcccgcggtgtcgacatcacgcttgacgaacgaaatgccaatggccgaagcgtcgagcacgggaacggtcaggcgcggctgcgccagctcacggagggcggcgcgcaaaaatgccatgtaaccggccacgacaaacaccgcgcgcaggggcgtgggcaagaaccagcgacgtgcgtaatgggcaccgacgagtgtcgccaggtccataacgagtttgtgcttgcgcggctcgagttgcatcacgtagcccgacttggcatcggcgatagcttgagcatcgagtgcgcctagggcgtcgagcacgcttgcgcggcgcggctcgtcgtactccaacgccatctggccaatgcggccatacacgcgcaccttgtgcacgccatcgatgtcgccgccaagcttaagaagtgcgtcgagatcgctctctggcacaggacccgccaattgaagacgggtcctgccggggatctcgctaataatcgagaatctcatagtttgtgcctgggagcgttactcggctgcctcgtcagcagcggcctcgctctgggtgatgtaggccgcctcggcaaccatgtcgtcgacattagccttggcctgctcgaccatgtcctggtagcagttcttgacgcgcataccgcacgcgatgccctgcacgcaggcattcttgaccggagcgctggtgagcagcttgatgccggccgtgccaagcagaaaaccgccaccgacaagcagggtattgaacgtcgacttcttcatgttgcttctcccttttgccgcattggacgcggcacggtgcctcagcacccgagtaaacaagtttgctcgagcacacttttggaaaatagtttagtttatctaactattaagttcaacaaaggttaactttttggaaatcttgatgcgcgatgtgaccaaagggacagcccctttgccacccgcacaaaaaatgagggcgccaacggcaccctcattcaccaaattccattcagcccgcctgacccgaacggccgagtcgttgtagaacccgggagccccggcagggcgggtgcttcctcaaaatgagttccgcacgcaaagaaggccacttaatgtggccttcgtcttgcgcaggactgttcgaaattttgaggaagcacccgccctgccggggctcccgggttcccgcttacgagagcgacgttctcagcaactcgttgaagagcttcgggttgcccttgccgcgactcgccttcatgcactggcccaccaaaaagccgatgaccttttggttaccgtcacgatactgctgcgcctgatcggcacagtttgccagcacctcgtccacgatcggctgcagcgcgccggcatcgctcacctgacgcatgccgcgctcgtcgacgatcttgttggggtcgtcgccggtctgggccatggcctcaaagacctcgtgcgcctggttggagctgatggcatcggtcgccagcagcttggcaagggctgccacctgagccggcgcaataccggactcggtcagcgagacacccgcgcccttaaggtaggcgatcatctcgttgaccagcaagtttgcaaccgtctgggcctccttgccagccataccggcagcggcggcctcaaagaactcggcaaactcggggtcgccggcgatctgctcggcgtcggccgccttaatgccaaagtcggcctcaaaacgggcgcgcttggcatcgggcagctcggggatctcgccacggcagcggtcgatgaactcgtcgtctaggtcgaacggcgccaggtcgggatcggggaacaggcgatagtcgtctgccgtttccttcacacgcatgaccacggtgcgcttgcggctgggctcccagtggcgggtctcctgatagatgatgccgccttcctcgagcacctcggcctggcggcaaatctcgtaggcaaggccatcgtgcaggctcttaaacgagttaaggttcttgagctcggtcttggtgcccagcttggtctcgccgcggcggcgcagcgacacgttgccgtcgcagcgcatggagcccttctccatggagcagtccgaaatacccagcgtcacaaagatgcgacggagcttttccataaacagacgcgcttcctcgggcgtacgcaaatcgggctcggtgacgagctcgatgagcggcgtgccgcagcggttgtagtcgacgagcgactcggcagcggccgtaatacggccctcggcaccgcccacgtgcaccatcttggcggcgtcctcctccatatggatgcgcaggatgcgaatgggcaccgtgtaggaaccgtcctcgcgacgctcgggcatctgcaggttggacgcgtcatagctggccaggtggccggcacgctgattaccctcgcgcatggtcgacgtcatggacgtggacaggccctcggcgttggccgaggcgctcgccaggctctgggcctcggcctcgccaaacgcgcagtcggggcgctcggcggcaccgcgaccggtcacgtccagatccaggtgaccgtacatggcaaaggcgaccggaccctgcgtggtctggaagttcttggccatgtcgggatagaagtagtgcttgcggtagaacatcgagtggcgctggatctcgcagttagtggcgagaccggccttgacaatgctctcgatggcgcgcttgttgggcaccggcagggcgccgggcaggcccaggcacaccgggcacacgttagcattgggctcgtcatcgtggctgagcttgcagttgcagaacatcttggtatcgagtgcggtgagctcggtatggatctccaggccgatcacggcctcccaatcctgcaggacctcggaaagctccttcattacagctcgcctcccttcccggcaaaatcgggcgcgacggaaagcgcgggcgcacccgtggcggcatcggcaaagccgcgctccagggcgcgggcaaacgtgagcagctgacggtccttaaaggccggacccaccagctgggcagaaacgggcagctgagtatcctcgcccagacccagcggcaccgagataccaccgttgccgcaaatgttgagcgagatggtgtacaggtcggagaggtacatctgcgtagggtcgctgatctcgccaaacttaaaggccgtgcgcggcgaggcgggcatgaggatggtgtccaccttggcatacgcggcgtcgtagtcctgcgtgatgagcgtgcgggccttttgcgcagcgtagtagtacttgtcgtacacgcccgagctcagcaggtaggcgccaagcatctgacggcgcttggcctcggcaccaaagccgtgggcacgcgaaagcgagctctggtcggacaggttggcgcagccctcctcctgatagccatagcgaatgccgtcgaagcgggccaggttggagaacgcctcggccgggccgatgacgtagtaggcggcgatagcggcgtccaggtgcggcagatcgacctcgaccagctcggcgccctggttctgcagctcctgggcggcgcgctgaacagcagccttgacctcggacgtcaggccctcggcttccataaacgcggggatgatgcccacgcgcttgccctcgatgctgtcgttgaggtgatcggtaaagtcgacggcgcaatcctggctggtgcagtcgtacggatcgcggcccgcgccggtaagcgcgttcatggccagcgcgacatcctcgaccgtacggccaaaggggcccacctggtcgagcgacgagccaaaggcgaccacgccgtaacggctcacggcgccatacgtgggcttaaagcccaccacgccgcacagcgacgccggctggcgaatggagccgccggtgtccgagcccagcgagagcgcgacctcgcctgcggcgacggctgcagcggagccgcccgaagagccgccgggcacgcgctcggtatcccagggattgttggtgcggtggaacgccgagctctcggtggagctgccaaaggcaaactcgtccatgttggccttgcccatgggcaggcagccggcatcgagcatgcgctggacgcaggtggcggtgtagacgctctggtagttctcgagcatgcgggaagcgcaagtggtgcgcgtgcccacgaggttcatgttgtctttgatggccagcggcacgcccgcaagcgggggcagcggcttgcctgcggcgcggtcggcatccacacgcgcggcggcctcgagcgcaagctcgggcgccacctgcaggaatgcctggaccccgccctcgcgcgcctcgatggcggcaagggaggcctgggccacctcggtagcggtaaagtcgccggcggcaacgcccgcggcgatctgggcggcggtaagggaatcgaagcttagcgccattactcgctctccccctctcccaaaatggacggcacgcggaagtagcggtcgcgcgcgctgccggcgttctcgagcgcaacgtcgagcggcaggtcgcgctcgggctcgcgcaggtcatcgcccatcacgttggacaggcttccgatgggatggaacgtgggctccacgtcgggcaagtcatattgcaagacgggctcgagcatctggacggcgtcgttcaggtaggacgtcatctgggtgagctcgtcatcggtcagtgcgatctttgcgtactcggcgatgccgcgcacgtctttctcgctgagtgccataggcgctcccttccgcataacagataaaccgctctagtatacaaggcaacgccgcttggagcaggtgctttacctaaatgcagcgaaaacgtaacgaggacggcgggctggcaggcggcgggccggcggttctacagcgaaaccgcaccgtccatagcgaaagccgtactgcccacaacgaaaaccgtcccgcccacaacgaaaagcatcccgtccgaaacgaaaagcatcacaacattcgacgcttttcgtcaaaatcgagattttcatcgaatgttgtgatggcttggaagtcccgaccaccacaaaggtgcctgtccccattgtggtggttctgaagaatgtcttatgccgaggccttggccttgcggcgcctgcggaccgcgtggatcacgatgtccagcagcaacagcacaatggctacgaccacgatgagcacggcaaactcgcgcttgccccagtggcggccggccagcgacttttgcttgtcgacgtccttcttgttgtacttggtgcgcacgcaatgcaccagcaggcgatggtcgttcacgccgtagggcgtgcaggtgacgagcgtcaccttgtcggcaccgggctcgatggtcagcgactccatctcctcgggcagcacgacctcggagtccaccatcttgtaagcgagcgtcttgttcatggtgtgcagcagtaccaggtcgccgggctccagcgagtggatgtcgtcgaacatgctcaggttgcgcatgcccgagtgcgcggtgagcacgcaatgcgtcgatgtgccgcccaccggcaggctcgtgccctccaggtggccgacgcccgccataaggacttcttcgctcgtgccgtggtagatgggcatgctcacgtcgatggaggggatctcgacccagctcatcatggggtcgcggtcaaagatgagctgttgagcgtagggctcgatctggtcggcgggaagctcggtggcctcgcccgccagccgctcgttaaaggagcgcgcctggagcaggatgcgctcgcgctcctcggcagacagcgcgtccacggtgctggacaccgtgctgatctggttgaacacgcccgaggcctcgagccggtccaagatccacggccaggtcataaggcccacgccaataaggatgatgacgatggtgatgagccgatcggcccagcgcggcagtcgcttgcggcggcgcttgggctttggctgaggttggggctgaggacttgagccaccgttgtccgcggcgttattgctcttcatatgtttggcgccctgcaccatcgccggtcactcctttacagctcaggttgtctgaacaaataatagccgattggaaggctcccccgccgggcataggcccgtatttgagttttcaaaatatcgcgaatcagcagagcagttcgggatacaatgtcaataggaaacgacgcatcccgcgtaaatgaaagagagcgcgggcggcctagttttctggttttgttaaatgcccggaatccgacccccgggcattcttatttgcgcttgttgcggcgcaaatgccttccaccgtccgcactgcgcgtgcgcctacggaccttaaaccgaacttcatgcgagtcaagaaacgcgatgacggatgagtccgcatcggacggtggaggctgcctgtgttatccaaaaagaacggggcaaactccagtgcggagtctgccccgaaaagagaatggcaaagcaagaacgtggatggacgagaaaagtgtccgcaagtctcatggccattacatcccacctgccaaagggatgggtaagcgagcgttactcctgctcggactcctcagcctgcttacggctgcggatgaggtgcgccacgccgatgcacagcaccgcgccaccagcgatccaagtgaaggtcacgccattgaggccggtcagcgggaggccggagcccttcttgttcctgacggtgagggtgacagtaccgccattgatgctcggagtatcaacaaggttcgaaccgttcttacctgtagtgacgctcaacgtgttgtcaccctccgccttatcgaggcccgcggcggtaatggtgaaggtaaagtcatccagcgtgttgtagccagggttactgccctcaacctcgtgcaccgtgtaggtgccagcatcgaggcccttgacggaaatctcaccctgatcgttcgttgtgaactcatacttactgtccccgagggagccgttcttctggacgcactgggcagtcgttccctgagctacgtcctcgtcgggcgcagtcgcctggatggtgaactttacgcccttgagcttctggtccgtatccacagagtcttccttgacgagcttgagagcataggtgtagtcgcgcacggtgtcgggcacggactcgcccttggagtcgtggccggggttgttggagtagatgagcttgacgctgttgtcgttgccctcgccaccgacaacgacgttttcggccttgtcgggatcgagcttggcggtgtaggtgacaacgaccttagaattcggtttgatggttacgcccgaactcttaagatcgttgaacgtgaccgtcaggaggttattgccgttcgcctgatcatagtcaacaatgtacttgtcgctagcaatcttagtcccgtcgaccttgacctcaacggaagtcttatcggcggtcaagccggcggacagctcgtcgtggaactggtagtaatacgttttgaacgtatcgacgttcttggcgacggtaccggtaagctgatagttgaccggctggcccatctgcgagtcgcccttgtcggcccaattgctgacggacttgtcgtccttaattttcttctcgaccgtgggaatatccgtcttctcgacaaccgccacggccttgccgcccacgacggcgaagatcggcgaggtgccggtctgcttcttatcggcgtaatcgtccttggttccaatcgaagaggtatcggtcaggaagaggtagtagcccttgctcgtggcagtaaagggggtgccagcatcaaaaaccacgccagtcgcgggtacgtccttctcgacagccagggcaatcttattgagaagatcgtccttcttcacgaccgtggtaggagtggtatccatgatcgcctcagaaaggtagtcggcgacctcctgcgcggtcgacgaattggtgatgcctggcgcgttttcagacgtaaggacgccgcgaacggcatccctcgcttggtcgctcgcccagtcgacgttggacgcgaccttctgcccgtccttgtccacgacatcggccttaaagatctgatatgccttgaacttggtggctccattgttctcgttctgcgtgatcgtgatcgtatcgtcgccctccgctgcaaacgccatggtcaccggcgccataactccgccgaagctcagcgctgctgtgaggccggcggttactgccaggcgtgcgatgttcttgttcatgctcatcttcttttcctccgttttccggttggttctcattcgatcggtcatcatctgtctgtgtcttagcatctgcttcgctacgtctcgccccgctctctgtggggctgccagctactctttatggctgccacctccccgcttgatcaggagcgcgaccacgatcagtgcagctccggcgaccgctgcggcggccacggcgtacattgccatatcgccagtcaagggtataaagcctccggtggtgatgctagggggtgtgccggtgggcgtattaatgatcgacgcctccaggctgcccgtcgacccgtccgcgctgtcggcgcgcaggggcgactcggccgtaatggtgagcttgggcttggcggcagccacctggtcgacgtccaggccctcggccttgaccgtcacggagcgcgtgccctcaaaggcggtgtagcccttgggcgccttgagctcgcggacctccagcttgcccgagtccacgcccgagacggtcacgcggccgtcctcgcccgtggtaacggtggccttgccttctgcatcccacgtgccatcggccgccagcgtgcgaccgcggtcgtcggcgatgctcagaaccgccccgggcagcggtttgtcgccgtcgctgccgcgcttggtgaacgcgagatcccagatgtaggcgcacgcgtcatcgctcggcgtgcgggtgaagccggcgtcgccggactggtcggcaaagggagagcgcgggtagcgcaggtagacctcgttggggttgcccttcgcgatgccgtggttgcatacgctgttgagcggcgcattgtacacggcgaccacgcgggcgcctgcggtgaaggtgtcggtcccgccgagcgcggcaatcaggtcaccggtgcatacggtgaaggtcttgccgtcgaccgagaccctgcactgggccgtgatgtcggtccagcccttcgcgggctcggtgccggcgcgcccgtccttgccggccgagacggcgccgaagccaccgtccgcgcccgccgccacgtacacgcgcatgctcgcggcgaccttggaggggtcgagccccgcgctcatggtgtcgacgaactgcaccgcataggtgtcgtaggccgtgagccccgccgggaccgtggccgagaggcgccagtacaggtcgtcggcgaccgtggcgtcggcggccttctgccatgcggcggtgctgtcctccagcacgtgcttggacaccttgggcgtcgccgccttgggcttgacggtgacggcgctgccgcccaccagggccatgatcggcgcggtgccggcctcgccctgggcgatggcgtcgtcgtcggcgacgatgagccagtagccgcagggcagctcggccgccgtgctcgcattaagggccacggacacggcaccagagctctggagggaacgagcgagctgtgcgctcagcgcactcgtaaggtgggaatcggtgttgagccactcggcagcttcctgcgcggttgtctgggatttggacatgccggcgctgtgcagcacaggcagcgcggcgtcgcgcacggcatcgcttgcccaggcgaggtcggtggcgattttagcgtcgttatcgccatcgatgacgttggcgctaaagatctggtaggcgtcgtagctgctcgccacggtgccgctcaccgtgatggaaccggtcgaggtcggcgcggcctgcgcggatgcggggaacacaaccgcgcaggtgccgatcacgagggcaagcagcgcaaacaagatcgggaaggagcaaactttcttattcacgacgctcacctcccttcgcattcgccttgcgacgaatgtgcatccaggccgcagcagcgcaaagcaccgccgcaccggcaaggtacgtcagcgtgacgcccgacataccagaaaggggcaaagaggttgagtaggtgttggtgaaggtgggggtggacttgggcttggtagtatcggatccatcgttgtaatccacgggagtctgcctgccttcgtcgatggcattaccgtcagcatccttgatctgggtgtaggtcaccttcgtggcagtgatcgtgccatctttctgatccgtcatcgtgacatcaagcttatagaccgactgatcgaacttgtaatgcgagaaaattgaactctcattcttctcgcgcacgtagtacgtgaaggtcttggaagcgccacggcccgtaggatcaccggcagtgaagggtttcttcgtgatatcagagagcgagtacttaatcccctcaccagacgcatttaagaacgaaagcgtctgggacttgtcgccatcgacccgagtcttaaccgtctgagcgctgttgaagtccgggttatccgcaaactcgagcgtaaactccttcatctcgccacccttaacgaccttagtcgccttgggaatccaggagccggtagattcgtacggagtgtacacgttggtgaaggtctttttcccattggagccagggacggaataatagccgtcagaatctgcctgcacaggacgcggctcgctagttgaaccaccggagtgcttggttacagtcatgccattaatcgtgtagttatgaactctgagatctttagtcgagttcggatctttctgcgtcggaacagacatgagcacagtcgtgtggtcctcggccgtcaccacaatctcgtacacggcagagtcgtacgtgatgttgtgatcattgccagcatcttcaaccaagtagtatgtaatctcgtcagccgtaccgctcgctgcaaactgctcaccaaggtcaaacgtgatgttgccgttagcgtcattcttgacacgctcaacaaagttgcagccaccatcgttgaatgtgccatttttccaagaaggcgccgtcgcagtagccgaatccttgcgataaaccgcgaaggaaaactgatctggggcgggcgtttcttcttttccggtttgcgtatttttcaacgccttggtcgccttcagcttaaggctcgggtaaacatacgtatctgctggctgacccaagtacaggtcgccgttcgacatgatgccgccgccatggttccaggaatagttgccagtgatgaaggttgtggcaagaccctgcgcagccgtcgcagcatcatctccggcattaacacccgaagacaagccgatactattcttgacctgaacaccaccattagccggaatactaatcttcttttcaagttcaatgcttcccgaaaacttggcgtcaccgccaccaagcatcttgccgatcaccgctgcgattggatcgctgtgtcccgttgcagcaagaaagaaatccgcatggccgttcgtgcgaaatacatctttattgtaggcatcaatatcttggttcttgccgtgaccgccgccagaaagatggggcgtaccgttattgcccgcattattagctgaatcgtacgtcgtgtcatatgggggtgcggacgatttcttggaccgcgcctaggcgtatccaagcttcctgcccctcccgtctcctgcgcccctcccggaactgtccacatcagtgtagccaatccaggccggtgtggccggcgagcacgcccggcgcggccctcctcccgctgttcccgtggggcagggccctgaacccgtgtgccctgaccgtcctcgcgcgggagcgggtgagccccgtcctcctgcagaactccgcgaggttgcatgcctgcgggtcgaacccgtcgccctcctccgcggccatctcccggagcgccgcgtctataatctcctgtaggtcatcgtgtctctcgttcacctcaatggtcctcctaacgccggcgtgttggcaccaccagcgtagtggcggcggggaggcacggtggccattattcggtgaccgggattggtcaaaatagtttgactattagcggctaaaatcgcccggcgctaacagaatattggaagaagcgagggatcgctcgcatcaatcctgatctagaagagacagtgaatactgactcatccatccgcaaccggcgtcatggccgtatcgaaataatcgccatccaatcgaaacgaaattcatatctcaatgctaagtttgaccacaaagactatgaaccaaacggaagtttaaagcgaaagctatacgcgcgaagaattgttatcaatgacctcttcggcaacacatttaactaaaggaatctcataggaaagtgcgcgatcgtgcttaaaaggaataaacgcaccgaaagtttgttttttactgtgaacaatcgcatttcttactttataaattcgggaagctattaatccagctacattatcggattcccaatctataactggagcatcagattcaaattcaaccccattgctcgaataccacacagaccaatcgaaacgatagcgacgtagggatttcattagccgaggcacatggacacacgactcaaccaagtattcaagctcacgtttttcatttccaaaaccaagttcgctcttatgggatatttctttttctaacttactaacaatcgaatacagatgctgatcgttgtatgcaaattcaaccgactggagctcgtttctcaacaattcggtcgtcatttttcgataggcggaattaaagtaaaattcaatcgaatgatagaaggacaaaaactgcaaatatgggcttctcgaagacacgccaagacaaaaatgattaacagcgctgtcgtcaaattttacatccggaacacaatcaatttctaacttcgcaacagatagcctcccgtaacttcctttttctaaaaactcatcaagcgatgaaattagcctcagtggcctatctaaacaagagatgtacttaaattggaaggaagttgctcgttcacgaagttgtttcgcttttctaaaccctttggtagttattcgtaaggagagaatacctgtgatttcaacaaaagcagatgtccaatcatcaacattatgagatacggttcttccaccggtggttgaatgcgatctcaggcgtcgcaaaaaaggatttctgcctctgaaagtattgccgtcaaaacaaccttcatttaataacattaatataatacaaaaaatatatgtaacgctcgccggacccattctaaattcagcatctgcatttaccgatttacatgaaatttgatctgtaaaatgagttgcatataatccggatatatcgaccatgcactcatagttcttaccatttgaaaaccattccataccatgaaaatcaccaatggcctcaaccgctttatcatattcgtgtttcaagtcgtcgtcatttataataattgtcttctcaaaatccgaaatctcggggtcaaactcttcttcaattcgataactgagatttaaatgacatgtcaaatcatcactggcgttatttggagagctcttgattcccatgatggagcaaaatacttctttgaaagaaacgtaatcgacaatatccataagatacctcttaacacttatatgacacttgttctcaatactatatctgtcaacaatttttaatgccatgaatccttcttttttgtttgagggaggaggtggtcaatttggagatattcatttccaaactaatgtaccatcgcgtggagtcgacagcatttccaccaaaggcgtgatgggtttcgtttgccgcgaaaataagtaaacaggcgctcttaggagcgtggcccctacttcctctcaaggagaaaacataataattgggacgattcacagtcgacaggcaactaagccgtatcacaatttgggggcacgcataggagtcaccgatattctcaaactaaatattgcatcgatacctaagcagatgaagtaaatgatcgactatcgaaagcaatatactcctagagtcggagctatgcccaaatacttggctggacaaggcgaaataccggtatcaacggaactcaagttgagtatttgctcgcttgagcactgctgaatatcgcgaaacagcaccgccgatatcgcgcctgggcaccggggccgacactggccccggtgcctttttatcgctaccggtctatccgcggcgctgccgcatgttggcctcgcccatgtcgaaccagaccgcgctgtgcacgatcctgtccacaatcgcgtccgcgtgtaccccgccgccgagcctcgggtgccagtccttcttcttgaactgggtgcagaagacggtcgaggccgtgccgcacctcagctcaatcagctccagcagcatcgacctgaactcagtgtccggcttgtccagaagccactcgtcgaccacgagcaggccgaacgcgccgtacttgcggacgtgcttgcgctcgacacccggtcggattagccttccccactggcgcctcagtatccgttgaatcgatccaaaccaccatactggtcatggacgtgtccgtatcgggcatacgcgtctcgaccgcagcgttttgccccacaagcgctaccaccggggttccttcggcgccaatagtctcgcccacatagccgatcagctccaaatgatcagcatcgagcaaagcccggccagcacccgagacgaccggccatgacggtagcgatgtccataaacaggctttccgcgcgagcgacataagaaggcccgccctgcaaaacgtatagataggccatagcaacaagcaaaatataacgacgacgatggtttaacaagacaacagatatgaccgttccgatcctcaatacgaaccaataagccacatgggagaatgcgaaattcactgttgacaagtctacataccagctaatatagcaaataagaacgcaaattttaataaaatccactagcagcccgtcgatgggaatccaaaagagcggcacataacgcaggaatccaaagacagagacaagaaaaactattagatacagatgtagcttctggtccaacgcatgcaaagccggaagtataaagggcagcaaaaatacaagccttcgattgaagctatctgttaaacagccttgtttatggagtattcgactttccccgcaacaaaccagattgttatggcagcaaagcagccgaccgtagttcttccaattggatagaaaaagatattgtagaaaaaactaataatacctcgacctagaaccgttcgagaatttcctcggcattatctcgcagataaatatctagatccggcacggcaaactgcacgtagcccctctgtggtgcctgaataacctctctttgtagcaatttggccctaatagagctgatctcattggtctttttacccatgcgcctagcaatctcggctgatttggactgttgtttatcctcgcacatggccaaaaggtatttgatatcgttgagccccagtccagaaatcgcgggctcgtgaacaacatcgtgaaaacgagcctctgccagcgcaatgccttcagtgacgtcgcgctcgctcacaatggcacttttggcacgatgcaagttggcgcgctgccaaatggaataaccgaccagttgcaccagataggcatagcccttagtggccttagcggctctcgacaggagattgtcctctatggtcaagccagtcgcgacaaagctatcgcccatagagagcgctacctccacctggttgataggcgccagatcttcggggagggcacgacgcaagaacgtaagcgccttgccgttaataagatccataacaccggcgggtaaaccggcaaaggcaagtgcgatatctactctttcccctatcaaaagctgaaccgtagacgcaatggcacgcatatcgtcaatcggagcgtcctgaacttcatcgatggcaataaaaagacccttggctgacctcgctgccgagcttagcaactttctaagactcgactctttgggtgcaacatcgactttcgcggaaacaaagccggcgtttacgccgaccgaagcattagtcgcaagggaagaatcagcaacctgatccctcaggtccagcaataggttagggccagcagaaacaatagcggtcttccatccaagctctcgcgcacgatccctaagatcgcagagcaaaacagtttttccggagcccctcggtccagcgatgcgcatgagcctcgcaggtgcgccaattcccgcattcaaactctcggtaaactcaagggcaatatcatcacgaccaattatgcgcggaggctcagcgccggcagtaggacgaaacgggttatggaatacagtggcgctcacttgtttgcctctcaagacaatcgattattggtcaatcttagctttaaaagtttatcgtagactatatcgaattatatccagttgtataagtctgtataaacgtatcgcggaagtatcgagctatcgtgatgcattgcagcaaatcgcctagacgctgctttcttctcagctcatatcgaaagtaagttgaggacttcctaaaacccattttctaaagcgagaaatactcgctctcagcggataagttcgaccccaaccatggatcgcccgtcaggaagaactcaggccagcgctgcatgaacagtgcttgctcgcgtttccagcggcgcatcttttcctcgttggcctcttccctgccgcgcgaggtgaactcgtagtgatacagctcggcatagggcgtaaagatggtgcgatagcccgcctcccacacgcgcaaacaaaaatctgcatcgttaaagccgacggcgaattcctcgttgtagcctccgacttgctcaaacacgtcgcgacggaccatctggcaggcgcccgttacggcgctaaagttgcccggacgcacagcacgggcaaggtagccctcacgttttgccgagaaatcctggttggcatgggcaagcgcgccgcgcacgccaaccaaaatgccggcatgctgcaccagatgatcggcaaaatagagcttggcgcccacaacgcccgcgtcgggacgctgaagatagcccatcatctcctcgataaagtcggatgagatgacttcagtgtcattattgagaagcagcaggtaatcgcccttggcatgctcaacgccaaagttaatgatctgggagtaattaaactcgcccggccaccactcaacgcgtgctgcacccttgccaccagacgcagcggctacgcgctccggcagggtttcgtaatacgcaaaggtctcctggtcttcgctgttgttttccaccaagacgatctcgtagttggcgtacgtggccttctgggcgatcgacatcacgcaggcatcgagcgtctcgacgtggtccttggtgggaatcacaatgctcaccagcggcgcagactccagcagcgcatagcgcatgcggtagacaaacggcgtctcggactcctcgaccgttccgcgaatgcccagcgagtcaaagtgacgctgcagagccaggcgtccggcctcgatagcatatggcttgctatcggcagaacagtcggcggtagagccagggagcacgcgccagtgatacagcacgtgcgcaacgtgctcaaagcgcgcgcccgccgcgaggcagcggagcgtcaggccgtaatcctgggcacccgcaacgtcttctggcgacacgccaatgcgatcgatgagcgccttctccaccattagaaaatgagtaacgcagttatggctatagagcaggtcgacgttgagctgcgtcttaaagaccggctggccccactcccccgttttctggaacatgtcctcgtcgcagaacaggacctgggggcgctcgccctcggccgccttattcagcgcggaaacatactggaataacgcgtccggttccaggatgtcatcgtggtccaagaacgcgatgtagtctccagtcgcttgctgaatacccgcgttggtgttgaccacaatgccgccgttaccaggcagctcaacacgacggacgcgctcctcgttgacgcccgccgcaagattggcaaccgcatcccattcgggcgaggcgtccataagcagcaattcccagttgtcatagctttgggcgagcaccgagtccagcagctcgcgcaggtagacccgatcggtcttgtagcacggcaccacaatgctcacgagcggtctataggcaaaggccgccgaagcgacacgctggcacgctaaatcgcccggctttgcgcgatgtcgctcaaaccaacgtcgataagctgcgtcgtctgcacgcgcgtccttcatgcggttccaactgtcatcgaccatgccgttgtacaggcgaccatccatggcgcaaaacccgctctggatctgctctgtggggtcgctcacaatcgcgacaaaatctcgtatatcctgaggcatctcaacactcagatacgttttattgacgcggcatccgttctgctgcggcacatcgacctgcgattcaaacacatgcacggtgacatcgatggcattcatatgcgcatcgaagatctggagctcaggcgcgcactggaggtctcccgcccaagtaacctcatagcgccacaccgcgccggcgtctgccggcaaatagcgagtggcatcgatctcgtagaaaccgcagtgttcgccacgctgagcatcgcggataagcgcgcacagcgcaggctttgctttgtagttaaccttggattccagcttggccacgcggctatcgaggcgaatggagcccaacctttggccaccggatgcaaaaacgacatccatcgacgagccatccaaaaacggaagcaccaagacggcgagctcgcgctcgtaatcggaaacggaaggacaaagcgccagcacacggccatgatcgaccgggagcaccagcgacggcacacaagaaccgctcgtcgtcgcatgggcaaacgcctgagagccctcccgctcaataagcgcggcgacatcctgaccggcaaaacgaagcagcacaaacagacggccctgactgcggcaaagcgccaaacgcttgatactcatctacacttctcgctttcccagggcgttcgctgccatgcgtttgcaggcacccaggcgcccaaacctcaagacgtcgtaatcgaacatgagctttttgcactcacgggcattgggggccttgctgataagcgccgcacgcaccatagcagcaacagaaggagcgcattgtgcgagcgcagcatcgctgcccacggcagaaccggcaagcgccgtggcaacggcagcaaacaccttgccgcagtccgaacccagcaacctgagcgcatcgtacagcaccagatcgcataggaagtacgccaggtcatcggcatgctggacatcgagaccgtcgcgctgccagtcagccagcaccgcggagtaaatcttcacgtgctccagcaggcgcgtctcgtcgtcatagcgcatggtgtccatgagcgagcctttgcgcgccacgcggtagtcatacagcttgttcgagataagcgcggtcttgtgcgaacgaccgtacacagcaaaatcgaagacctggtcctcgccatacttaacggtttcgtcaaacacgatcccgttgcccagcaaaaactcacgtttgcaggcggtgcgccatgcaaaggggcgagatgcttccttaaacagcaggtcagagctatagccttcaaacgacacatcgcgcgggctcagcacatagttaagccacggataccccgcctccagcggatacggattcgcgccaaaggtcaaaacgtcgcagtcctcgcgctcaaaggcatctacgatcacacggcacgcatcgggcgtaaatcggtcgtcggaatccaagaacgcgacgataggcgccgtggacgcagcgatacccgcattgcgcgcgctcgacaggccgccgttctccttatcgaccagcgtaaagcgcgcgtccttttcgcaataggtagccgcaatatcgcgcgaaccgtccggcgagccatcgttgaccagcacgccttcccaatcgggcatgtcctgtgcaagcagggagtccaggcaccaggccaggcactcctccacgttatagatgggaacgacaacggaaatcttgggggtagccatagtcactcgctcctactgtgctgccggaacgtcgtcagggtgcgggttgtcgccgtaggtgcgctgatacgtcagcacgcgccagaccagcggtaggccgccaatcttaaagtaatgcttaaacgtattgagcttgcccggcttcttaaagtcaaaacgcgaatcgatataggcgcggggcgacttgaccatcaggcgcaagtcggtctcgccgcgcgggtcgaacagcgacaggtcaaagcgaccggcatcccaatcggccttgagctcgggtgaagccttctcccaaaactgctcgcgtagctcatcgaccagacgctcatcattccaacggtacgtatcgaccttcatgcgcattaaaatgccctgaagctgagccttaagctcggggcgctcgtccaaaaaacgttgcatctcggcatattcatcgcacacgcaaaacaccttgttgggcgaattaacagagctcttctcgttatcctggcgatagcacaaaatggggtccgtaataaacgcggcacgctcggcgcaagcccaaaccttaaagttaaagcctgcgtcctgatacgaggcacccggcgtggggaggaaccgaatctgattgtcgttgaggaactcgcgccgatagatagccgaccaaatggaaggtttgcggtagaagatgcccgggcgatcgacggggcaatacgcggcgcccgtcatatgctcgtcgataatcccaaacagttcacggcgttcgctgggcgtggaccaatacaggtaaaagtcgccctttaccacatcggcatgctcagcatcggccttggcgaccagcttttggagcgaatcctcaaacatgaagtcgtcggactcaaggatgcccacgtactcgccgcgcgccatctccaggccgcggttcatcgagtcgccgtagccgctgttggccttgtcgatcatctttacacggggatcgcgctccatgtactcgcggatgatatctggcgagctatcggtggagccgtcgttgatacagatgatctcgatgtccttaagcgtctgcgccacggcggaatcgagacactcgcgcaggtagcgttcgacattgcagatgggaacaagcagcgaaactttaggggtatcagagttctgcaagagaacctcctgttgaatagcgtgtaacagggttattttaacagccgagttgcggcgggcggcagcgcttggaattagagaaagcgctccaggcaggctttgagaccgcgagtcgaaagatagaacagcgtggcgtctgccatcgaaacgcccgaggtcgccgcaacgagcttgtgggcaacacggcgaacggcgcccttagcaggcatatccgcccactctgttcccaaaaacgtcgtgaaagccctgttgacgcggccggcaacacggtggaagccgtccgcatccagacgcgccaagtcgaacacaatgaggtccaaaaaccaagttatcagctcgccggggcacaggtccaaaagaccgtaggctgcccagtcctccaagacctcctcgagcatcctcatgtgggcgtcaagctttttggcacgagcctcggcactgttgaactcgtgcgtcgccgattcgctctccatcacgtagtggtagaacttgtccggcatgacgacggtcctgcgggcaagcgcataagccgcaaattggaagacgacgtcctcgcccaaagccaaaccgggggcgaagcgaatgccttcgcgattgagcagctcgcgcgaaaaagccgcacggcaggcatagggctgcgcattcgaatggaacagcagttggggatcacgggcgccgaaagcaccagctttggtgctcatgagttgctggacgcgtttgggggcagcatcggcaggttcacagacgccgccaaaaacggcggcctcggcatctgcggactccatggcatgcagcacgcgctcgaccgtctgggcatcgatgtaatcgtcggcgtccacaaaaaagacggtctcgccctcggcgacatcgataccggcatttcgagcacacgagacgcccgcgttttcctggtcaatcaccagtacgcgatcgtcggcctgcgcgatctggcgcaacacgttcaacgaatcatcagtcgaaccgtcgttgacgcagacaacctgaatcgaacgctcagactgggccaacagcgaatcgaggcatcgctgaatggagcgcgcagagttgtaaacggggacgacaatggtagctttaggacacgaggcctctcccatgccgacctaccccctcagcgattcgatgaggaaggcagcaaccacgcctgggcctccaaccgaggcgtaatacttagcacgccccaaggcaccatccgtcgcaaaactcggatgctcgtcaacccagccctcaggatctttgaggatggcagcgagatttgcgcgcttccacggcttgaggtcgtcaagcgaaaactcccccgcgtccaaggccgcttggaactccttggccatctgaaccaggaactccttatagaacttaggcgccaggcgcacgtagttccacatgtacgaatcgtacttaatgagctgattgaacttgagcatgcgcgcgacatcgccgcttgcgtggccgcgggcataatcctctcgaatccaacgctcaatctcggcatactcggtattgacgcaaaagaccttagccgaagaattgaccgaggaattctcgttgtcctggcgatacgacaacacggcatcatgtaggtaaacagccttatcggcgcacgcgatcaccttaaaggcgaacgacgtgtcctgaaaggatgcccccggagtcggcaggaacgtaatgccgttgcgctcaagaaaatcgcgacggtacacggccgaccaaatcgacggcttttgcttaaagaactgcgtcgtatcgctcggatgcaccggcttgccgcaatcctgaggtctaaacatctcgtgcagcgaacggcgctcctcgggcttagaccagtagaaatcaaagttcgccttcgcaaagtcggcattattgctatcggcggccgagacaagtttttcgagtgcgtcggacgccataaagtcatcggactccaagatgccaacgtacttgccacgcgccatctccagaccgtggttcatcgagtcgccgtagccgctgttggccttgtcgatcatcttgacgcgcccatcgcgctccatatactcgcggataatcgccggcgagttgtcggtcgacccgtcgttaatgcagatgatctcgatgtccttgagcgtctgcgccagggcggaatcgaggcactcgcgcaggtagcgctgaacattgtaaatgggaataagcagcgacagaacagggctgccagaggcgttagtagacaaatgtgctccttaggaaatacctgtcgtttcatggtatcaaagggccagcgcgccagcgggcgtttatataatctatggagcctcttgcgggcaaagcagccccacgtcatgcggcgggcccgtggcaggttcctgcgttttattcaaagcttgccgtcaaggtgcgccgagcctttacaataggacagtcccaaggacgtattcgatagcttccgtgcagcgcatgcgcgccgcacgtgaaaggatatattgccccatgccttcaaccctccccgcccccatcgataagctcgccatcgtcgtcgttacgtacaaacgccaggaactcctggccaatttgttcgactccatgaccgagctcacggccgcgccctggcgcatcgtgattgtcgataacgagaattcacgcgagaccgaggccatgtgcaccgcattcaacgagcgcctgaccaacctgtggggcatcgacaccgagcagcctgacgcgcagggcggcaccgaccgcgtcatctacgccccgcagcttgaaaacggtggcggcgcgggcggcttctccgccggcaccaagtgcgcctacgacctgggcgcccagtggttctgggtgatggacgacgacgtgctcgtcatccccgaaggcatcgagcgtcttgccaagtggaccgaccgctacgatgtcatccagggttcgcgcctggactttgacggcggtgccttcttttggcaataccaactcatcctttcactcggcattcccaaccctgtcgccaagtgggacctaggacccgagggctaccgcgccatgaaccagctgtgctttgagggcggcatgttctcgcgccgcgtggtcgacaagattggcctgcctgacgcgcgcttctttatctacggtgacgacgcctgctacggctacgtagccagccaacacttccccgccgccgtggtcgccgacgtggtgctcaagcgcgcccgcgccgtctctaactgggatatcgccggcaagcgccagctcaactccacgagcgacaccaaccgttactacatcatgcgcaaccgcggttatctggcccgctacatgcagatttacggcgactatcaccccgtgctgttccgcctaggcaacgccgcgaccttctgcaaggagttcattcgcctggccgccgttgacaagtgctttaagaccggaattccggcgctacgccgcggcatgaaggacgcccgcaagatcatcaaggaccccaactggaagcccatgccgcccatgaaggacaccgagtaacggaagccggaaacacctcggcgcttaaagccgctggcacaccgtagccacatgctgcccatcaaaaccgaacccccagcgcatgcggccaatgccgggtcgcggcacacggatttcgtcgatgccgtcgcgctctatgtcgagcagcgcctgcacggccagcaattccaggcccagcgcatccacaccggggtcatacatcatgttgatcgttatcagcggacgttcatcgagcataccgatcgtatcggctatgtcgaacacggcgcccgtaggaaaaacctggatgtcccagcgatccgcgccacactttcgcctcgaagcaggattggcatagcccggcaatccaaagcagagtccttgcaagagtaggtgatatggcagcggtgtatctgggtcggtcccaccgattcccgcatcccccaagatgcggcttagcgcccgcctcacggtatcctcgttcccatggcacagcccgtcgcgaaacgcatcgacgtctcgaatgtcttctgcagcgcactcaaaccactcaataatcactagacgcaaggcctggcgaagctcgttattgggcaatcgcaaagcacggaggcaatcgccatgctctggctcctcagtcatatccgtcgtgagaaaaccggacagatacagcgctgtccacatgccatcgtcaggcgagacatctggctctgctgtgcccaaacaaagcggagcctcagcgcacccatgggcctcgagcaaatcaaacaagaccgaaaggcggtcgagattccacccggcaactaccctactcaggcaatcggcatatccatacagatcagcacgcacaggcgccgtgcagcctcggcccagaaaaccgatcacacgctctggactcgagcaataggccctgccaaaccgatatccctcgagccattcacgcgcatcatccaggtattcctcgcgcccagcatgattcaaaagagcctcgacctcggcatccgaaaaaccgaaacatcggtcacaccacgctgacagcggcgtcgtcagacaatacgagcagccgcgcgaagaaagcgccgcttcggcagggccgggacactcccccatcagacacgtcagccgcaacgaatcgcgcgcagcggcaatggcgtcgaacagcacgcgatcgaatagccctgccggatcagcaccggaagcgcccctcgcgcttgcacggcccaaccatgccgcatcgtacccatcaacgagcaatacaacctgctcatcgcaggccatctccagcagctcaatgagcacgccaagcaccgaggcgacctcgtcctcgctcgccgcgccacgcgcaacacgttcgatgtgacgcaccttgtctcgagctaaatccggagcctccaaaagcgccagcaggcggacgcactcgcccgaaagagcatcgcgcacgacgtcggcaatagcggcgccacgcctcgcagcgccagaaaaatccagcgatatcaccggatagcaagcgtactcgtcccgataacgcccaccgtctgcatcccaaatctgagcattggcaaacaaacgctgatcagcgcgaccaaccgctggacgctccagaaaagccctgagcatcgacaagttcatgcttttgccaaaaccctcgggtcgacagcacaccacaacggacgcgtcgcagtccaacgcatcggcaataaacatggtcttgtcgaccagcgtgcagcaaccaagagcctccgcatagtcgtgcatgccaatgggcaaagccgcatcgtcggcacagccgatcaaacgcacgccaaagccagcagcacaatcaacatttgcctgttcagacaccaaaacgttccccctaaatcgcagcacgatgccaattgtaatgaccgcatcgcatgtaccgatgtcgccgcgcaaacatatcgggcaacggtagtaacaagaggtgtgagggggcacaattaatcgttgcacaacaaaacggggcccgatacattcgcaccggaccccgtcccgactatttagttatctggcaactaagagcctactcccccgagtcgtcctccccagaagccttcttctgctgatcgagcttatacttaccacttacgatagacgtagcgcccagcgtggccaagctcgcgctggcaaggctcgccataacgataaggtcgcccgtcttgggcatgttaccgcccgaagtcttagtcgttgtagtggtggttgtagtggtcaccgtcttggagtcattttgctcttggttctggttgtcggtgttgcccttactgctgtcctcgccctgctgctttccgtcctcggtcttgtccttgttcttgtccttctcctcagattcagacttcttgtcctcgtccttcttctgagcggacttgtcgtccttctcatcagagctagaacccttatcggattcaaccttctcggaagccttatccttggagtcgccctttacggcttcggtcttttccgtggaagcctgatcagagttgtccttgttctgagtcgaaccattattgacgccagccatcagcgaagagcccagcgtagaaccaagctgctcggagaaagaaggcttcttgtccggcgaagcaacgggagcgtccggcgccttattcgagtcgtccttggaagcatcggaatcaggggttgcgtcagagccggagccgttgttagagccggtatcaacggacgaatcgctcgagccggtagatgagttagaggtgtcagcgccggtcgaaccagaagcgtcgctgtccgtattgccggcagagcttgaagacgaatcgcccgcagcagagccgttcgaattggagccgttcgaggtagagccgtcgttggtagtgccaccagccgagccattaccgtcagcatcggtcgagggcgtatccatcctgtcatcgttgggatcgtcactcgagtcgtcattcgaatcaggtgtcggcgagggcgccggtgtgggctcgggctgcacgggcgtcgcagcggctgcctcgtcctcggcgatataagccaagcagtccttcagctcattcttataacgattcttccagccctcatgatactggggctggctcgaatacttggtcgccacgttattgaccacgctgttggagagcgccgtcacaaactcgcggtcggacatatcattggaaagattcgcccagcggaaaaagtccctgcagccaccggtgccgcacatgttggtaatgctccacaccatgcccttgacgcaatcggcgcggcccgaaatatcaatacccaggccgctcttgagccacgcctcggtcaccgcatagtacgagttgtacgcatacgcatcttgaagtgctgagaactcaacaggatcggtgttgtacgcaccttggaaggcatcctgcgcgatatggcccagctcggtgagctggccgttctcgtacatgacattactcgtgttggaaatctcgctgccgcgatcaatcgcatccttgagcatgctgtattattcggggttgtagttgtaggcctgcttcataaacggaatgagcgaccaacgacggtcgaactggtaataacccagcgcgttatagccgtcaccgtacgaaaagccctggttgtagttgccatggctctcgtacttggtaaagtacttcatctcgggagtcacgttgacaaacgaaacgccctggaccgacctcagtacgcccgagaaggactgctgggtgtagagacccttatcgatatcggtggcatccgaggcaacgcccggcgtgggctcctcggcagcagcgggtgccggcgcggaaatggcgccaaacgaaagcgccagcgtcaggcccgcgacaatcgcggaatgcttgagctgcataagatcctccctgcattggtatagttaaagtgcagtttgcaaagatagaaataagtattgcagctcgcccgttgttgcacaacaacccctcggtaaacggcaacaaccctccgcgaaatcttaaggaattaaacaaactggtcgtcgggcgccatcagaagctcgccgtatcgctccatcagcccgtccctcaactgacagaaagcggggatatagacgttcaagatgcgctgaatcaagtcttgagcgagcttgttgtcgtagatatggacgttcgtattgcggtctctgagcatatctagccaggccgcctcatcaataaagtcgtagaatcggtacgactccttcaagatggcacgaggagaccccgacgcggcaagcgtggcgccttcatactcgagcagacgcttaaggagcttccagctcagttcaaattgaagattgaacttattaatcaatccactctgaacaaaatcattgttgagatcctgattgggcgcatcctcaagattcgccaaggcgctggcaaagttctcatattttttcatacagaatcacaccatccctggcaatttcatcgagcaattgctgcgataagggctcatcgagattgacgacatctacatctaaaagagtatcaagacgctcctcgatcaaatatgacaaccggccgaaatcccggcaacctgctactgcgatgtcaatatcgctcttaggcaagttgtcacctcgagcgcgggagccaaacagcacaaccttctcggcgtcacactcccgagcaaaaacttcaatttgcttatacaccttgtcgagagatgccatttgcagccctacagcttaatgtcaaagttgatttcggggacggcggccaggtcggccaacgtcacgccgtcgacgtacttttcgatcacgtcgtccaggccgcgccagaacttgacggtcgagcaaagatcgctgcgagtgcagctgttgtcgatgccatcgcacgccactggagccgtgctgccctcgacggcgcgcaggatgtcgccggcacgcacctcggccgggtccttggccatcatgtagccgccgcccttgccgcgcacgctcttaagcaggcccgccttcataagcggacgaaccagctgctccagatacttttgtgagatatgctcgcggtcggcaacctcgcgcagggcaatcttgccctcggcgtcgcccagcgccgcgatatagatcatcagccggagggcatagcggcccttggaagaaatgagcatacctaccctcccatcgcatctgggacaacataaccaggtttgtttgtcccaaatcttaagtaaatgggacaaacacaacaggttattttgtcccagaatttgaaaagtcgagtggattagtcgggttttcccttgactaacgccgaacccatagtaactttattccgagaagattcctagggtttagtacacctatgagtacaccatatacagagagggacagcatgagcgcaaatccgctgctttccatcgaaggtctgaccgcctccgtggacgagaagaccatcctccacaacgtcaacctcaacgtcgccgccggcgagacccacgtgctgatgggacccaacggcgccggcaagtccaccctcggccacctggtcatgggcgaccctgtctataccgtcaacgacggccgcatcgtctttgacggccaggacatcaccgagctcaccaccgacaagcgctcgcgcgccggcctgttcctgagcttccaggccccggtcgagatcccgggcgtgccgctgtcgagctttttgcgtgccagcatcgccggccgccccggcctggagatgaagggcaaggagttccgccggcgcgtcaaggagctcgcggcagagctcaacatggacaccgcctacctcaaccgcgagctgggcgtgggcttctcgggcggcgagaaaaagaaggtcgagatgctccagcttctgctgctgcagcccaagctcgccattctcgacgagaccgactcgggcctagacgtcgacgccctgtccaccgtcagccacggcatggacgcctaccgcaagagctgcgacggctccatgctcatcatcacgcacaacacgcgcatcctggagcacctggatgtcgaccgcgtccacgttatggtcaagggccacatcgtgcgcgaggacgacgcctcgctcatcccctggatcgacaagaacggttttgagaccttcgagcgcgaggccgccgagcagcgcgcccaggccgaggccgccgctgccgagcagcaggcgtaaaggggcgacgcaatgaccaagaaccgcaccgaggtcgcggacatcgaccgcagcctctacgacttcacctatggcgaggagggattcgagcgcctcgacgccggcatcacgcccgacatcgtgcgcgagatcagcgccaagaaagacgagccgcagtggatgctcgacctgcgcttaaagtccctcgagatcttcaaccgttttcccgacccgacgtggggcccctccatcgagggcctggacatggacaacatcgtcacctacgtcaagcccaacaccgaccaaaagcacgactgggagtcggtgcccgacgacatcaagaacacctttgagcgcctgggtatccccgaggccgagcgcagctacctggcaggcgtcggcgcgcagtacgactccgaactcgtctaccacaacatgcaggacaccgcgtccaagatgggcatcgtctactccggcatcgaggaggccctgcacgatccgcagtgggagccgctcatccacgagaagtttatgacgctcatcccgcccaccgaccacaagtttgcggccctgcatggtgccgtgtggtcgggcggctcgtttgtctacgtgcccaagggcaccaagctcgacttcccgctgcagagctacttccgccttaacgccaagggcgccggccagtttgagcacacgctcatcatcgtcgaggacgatgccgacctgcacttcattgagggttgctccgcgcccaagtacaacgtagccaacctccacgccggcgctgtcgagctctttgtgggcaagcgtgcgcacctgcgctactcgactatcgagaactggtccaagaacatgtacaacctcaacaccaagcgtgcgcgcgtggacgaggacggcgacatcgagtggatcagcggctccttcggcagccacgtgggctacctctaccccatgagcgtgctcaacggccgtcgcgcccgctcgagctttaccggcattacctttgccggcgccggccagaacctcgataccggctgcaaggtcgtgctcaacgcgcccgacacctcggcaaccgtcgagaccaagggtatctccaagagcggcggcatccagaccttccgcagctccatcgtggccacgcctaaggccgaaggttccaaagcaaccgtgagctgccagtcgctgatgctcgacgaccagagccgctccgataccatccccgccatggacatccgcgccaagaacgtcgacatcggccacgaggccaccatcggccgcatcggcgacgacaaggtgttctacctgatgagccgcggcatatcggaggaagaggcccgcaccatgatcgtcaacggctttgccaacccggtctccaaggagctgccgcttgagtacgccgtcgagatgaacaacctgatcaagctcgagatggaaggagcgatcggataatgaaacaggaaaccaacaccgctgctaccacgctcgagcaggtcaacgctatgccggccgccacttggggttggctcaagatgaaccagaccaagctcgagctttcggacgaacttgccgccgctcccgccgaggccgttgaggtcgagggcctggacgagcagtttgccggctcggccgacgccttcgataccgccatggacgccatggccgagcgcttccccgagcgccgtgcctccgcccccggcgacgccgtcgaccgcgcccgcatcacgcccgagaccgagctcgacgtgcccgccacctccatctaccaggccggcgccatcaagctcgaggaggagctctcccctgccgaggccttcgagactggcatgggcgaggctacctacacctacctggccgaccacaccaccaagcgcgtcgtcatcgatgtgcccgcatacaagcacgccacggttaccgtgcgcgtgagtggcgtcgacgctgccgcagccatcgccgccatcgatgtcgtcgccagtccgcaggcaacgctcgacctgcgcatagccctggactcccccgttgccggccaaggcgtcgtgggctccgcgctacgcgtgtgcgcccacgagtacgccaccgtcaacgtgacctgcacgcagacgctcgacgatagctggatcgcgctcgacgacaccggcctgttcctggacgagggcgcgcgcgtcaacgtgcagcacaccgtcctgggtgctggcgccagcgccaccggccttgccggcgacctgctgggcgataccgccaaggtgacgatcgataccgattacctgggcgcccgcgagcaggtgcgcgactttaactacgagctgcgccaccgcggccgcaagaccgagtgcgagatcgacgccaacggcgtgctgactggcacgtccaagaaggtctaccgtggcaccatcgacctcgtgcacggctgcaagggcgcaaccggcaccgagcgcgagacggtgcttttggccaacaagggcgtcgacaacaagaccgttcccgtcattctctgcgacgaggacgacgtcgccggcaaccacggcgccacaatcggccacgtccgcgacgagcaactgttctatctcgcctgccgtggccttgaccaaaacgccgccgaggacctgttcattcgcgccaagctggaggacgccgcgctttccgccaccgacgagcgcacccgcgcagccgtcgtccgcttgggcaacaacctgatcaacaactttgaagaggagctcgcatgatcgacaccgagcacgttaaatgcgatacctgtaccgcaccggagcctatggagctcgacgccagtgacgaggcctcgcgcggctggcctaccgtcgacatcgagaccaatccctacaaggcacagttcccgcttttccagcagcaccccgagatcgccttcctcgatagtgccgccaccgcgcagcgccccgcctgcgtgctcgacgccgagcgtgacttctatcagcgcatgaacgccaaccccctgcgcggcctgtactcactgtccgtcgaggccaccgacgccatcgcgaaggtccgccagcagatcgccgacctcatcggcgcctcacaggccaacgaggtcgtcttcacccgtaacacgagcgagtcgctcaacctggtcgccaagagctttgcacccacggtgctcgagcccggtgacgaggtcgtcatcaccatcatggagcaccactccaacctaatcccgtggcagcaggtctgccgcgaaaccggcgccaagctcgtctacctctaccccaccaagaccggccagctcaccaccgaggaggttcttgccaaggttggtcccaagaccaagattctggccgtgggtcaggtttctaacgtgctgggcgtcgagaacccggtcaagaacctcggcaagctcgtccacaagtacggcggctatctggtcgtcgacggcgcgcagtcgctgccgcacatgccggtcgatgtggccgacctgggagccgacttctttgcctttagcgcacacaaggccatgggccccatgggcatcggcgtgctgtggggcaagatggacctgctgaacgccatgccgcccatgctcaccggtggcgagatgatcgactctgtcaccgagcaggacgccgtctgggcgcccgtccccgagaagttcgaggccggcacgcaggacgccgccggcatcttcgccacgggcgccgcccttgattacctggtcaacacggtgggttacgagaacatccaggcccgcgagcaggcactcgtccactatctgatgggcgaactcatgcagctcgactttgtccaaatcatcggttccatctactgggacaaccaccacggcgttgtgagctttaacgtcaagggaattcacccgcacgacgtcgcgagcatcatggacatggacggcgtctgcatccgcgccggccaccactgcgcgcagccgctgctcacctggctgggcgtcgagaaccttgcctgctgccgcgccagcgtggccttctacaacgacaaggccgacatcgacaagttcatcgccggcctgcatcacgtttggagcacgttcaatgggtaatctgtacacctccaccacgtttatggagcacaactcgcaccccgactataagtacgagatggatgctcccacgcacgagcacgacggtatcaaccccagctgcggtgacgagctcaccttgcagctacgagtcgagaacaacgtgatcgaggaagcctcctttaccggccacggctgcgccatcagccaggcaagcgccgacatcatggccgacctcatcacgggcgagacggtcgaggaggcgcgtcgcttggcggaactcttcctcgccatgatccgcggcgagaagctctccgaggacgacctggaagacctggacgaagccgcccagctccaggacatctcgcacatgcccgcccgcgtcaaatgcgccgagctcgcttggcgcaccctcgacggcatgctcgaggggcaagcaaaccagtagtttatgccccgaatccaagttttttgattgccgagccgcccgatacgggcggctctgtttttacctaatgagcgcgaacgcacaaagtccgcgcgtccggcgccccgtctgacatttgccacacagccagacgcgagcacgggcgttttccacagcaccaaaggcctgcggcagggccccgggcccgccaagcaatgcgccaagccccgttctgcgaagctccgactcgcttcgcgcctgccgcagacgggtcccataggaagcggcgtgcatttttgcgagtattcagcacgccaagctgtgtgtatacgcatcgaaagcgttaatcaatgtctttaggcgcatatatattgtgttttagaacaagcatcgcggtctgacgggacgcaggcacgtgcttcgggggcgcaacggcaggaatcaatagcttcgggacccgtatgttgcaagattgcggcggtgccgacagcaacacgatgctgaaaactccgttttttgcacggcgcagacgggggtaggcacgggcaaacccggactgagctgttattttatgcaagatgacgattgttctatgcatattaagaagtgcagttaccgtaccaagcttttgaacgctggttgcggcgtatggacgaccccagctgcggtgaacaggcgaccttacatcacgtttccgccagcccgcatcgccgttcgcgcgcgggcgcgcacgatacgagagacggtacttttgccaatcccggtataccgctcaatctggcgcaccgtaaagccggcattgttcaatccaacaataacagtatcgcgctgcgccggcggtgcagttttaaccccgttgagcggaaccccgagactcttcgccaacttgccggcaaaggcattgcgttcccactctgtctctttcatatcgcacagcgctggcttgctgccgtcgggcgtcgaaagcgaataggcaataaagccctcggcagaaccaaaaagctcaagcacgcaagaaggatcagaaaatcccctcgcgacatcagccgcgtcaccgtcgtaagcgcacaaatgctccgcaaagctactccagggataacgctcgattaggctaacgcccgcctcctgcggatcggcgtgtacggagcgaatagcctccatcacctgccagtcggtatcgagcgagcgccggtcaaaacggttctggaacagatggcctgtgcgcctcgtgcgtttattgaaccgccgcgcgtacgtcaaaagcagccggtgcatcgccgcgctcatcctgtcctcgtaatctgcaagcaccaaatgcacgtgattgcccataaggcaccaagcgataaccgtcacaccctcctcgcggcagcactcgcgcatcagctccaaaaactcccaccggtcctcatcgccctcaaagatgagctgcttgcccgtaccgcgggcacagacatggtaaaagccggtaaccgttctccaaacgcgctgcatggcgctcccttcgccgggatctgcttgccatccaatacagcacgattgaagcgtgccatcaaaacattcacgcaaaacaatacactcgcgcggccaaaggcagtaatcaggcggcgaacggcatcgttgcaacaggtcaacccccgcaatgcttacaagagctgaccaatagcttgcccaagacggaccccctctacggaagttcacgaccacagaacatagagttaaaccgtttcaattaaaacttccggacttctcgctacgaaaactgagccgttcgccgaatattccgtgcatttcgcggtattataggggctgcatgtcatgtccctttcgaagggtcgcccggcaatcgccagccacggcccccagacgggacgccaacacgatagagaggagaggcatgcagtactcacaggaagtggagaacatgtgccccgttgccaagggtgcataccacggccccgcacccatccccgaggagggcaagtgggtccaggctaaggagatttccgacatctccggtcttacgcacggtgtgggttggtgcgcacctcagcagggcgcctgcaagctcacgctgaacgtcaaggacggcatcatcgaggaggccctcgttgagaccatcggctgctcgggcatgacccactctgccgccatggcttccgagatccttcccggtaagaccatcctcgaggccctcaacaccgacctcgtctgcgacgccatcaacgttgctatgcgcgagatcttcctgcagatcgtttacggccgcagccagaccgcgttctccgagggcggcctgcccgtgggcgcctccctcgacgacctcggcaagggccttcgctctcaggtcggcaccatgttcggcaccaaggccaagggcgctcgttacctcgagctcgctcagggctacgtcacccgcatggctctcaacgacaagaacgagatcatcgcattcgagttcctgaacctcggcaagttcaccgacgccgtcaaggccggcaagacccccgaggaggccatcgctggcgctatgggccactatggtcagtgggagaacgctgccaagtacatcgacccgcgcaccgacgaggagactcactccgtcgccagcgtgttcccggttcacgagtagaaagggagggaaataactatgactgttacgttcgaaggttacgagcgccgcgctgacaagatcaacaagtgcctcgccgacaacggcatcgcctccctcgaggaagctctgcagatctgcaccgacaagggcttcaacccgcgtgagatcgtcaacaacacccagtccatcgccttccagaacgccgagtgggcctacaccctcggttgcgctctcgctgtcaagcgtggcgccaagtccgcttctgaggctgccgccatcatcggcgagggcatccaggccttcaccgttcccggctccgtcgccgaggaccgcaaggtcggtctgggccacggcaacctgggcgctatgctgctctccgacgacaccgagtgcttcgccttcctggccggtcacgagtccttcgctgccgctgagggtgctatcggcctggctctaaacgccaacaaggctcgcaagaagccgctgcgcgtcatcctcaacggtctgggcaaggacgctgctcagatcatcgcccgcatcaacggcttcacctacgtgaagacccagttcgactacttcacgggcgagctcaaggtcgtcgagaccatcccctactccgatggtccccgcgccgccgtcaactgctacggcgccgacgacgtccgcgagggcgttgccatcatgtggcacgagaacgtcgacatctcgatcaccggtaactccaccaaccccacgcgcttccagcaccccgtcgctggcacctacaagaaggagcgcctcgaggctggcaagaagtacttctccgtcgcttctggtggcggcactggtcgtaccctgcacccggacaacatgggcgccggccctgcctcttacggcatgaccgacaccatgggccgtatgcactccgacgcccagttcgccggttcttcctccgtgcctgcgcacgttgacatgatgggtctcatcggcatgggcaacaaccccatggtcggtgccaccgtcgcctgcgctgtcgccgtcgaggaggccctcaaggcctaatcgcgcccgcgcgatgctcatatagttgagctttggagccactacccacccaggtagcggctctttttgtttgcgctgtcgcagggtagctaatgccgatatatcagttggggcgaaatacaagatgtgatgagatggagcgtcagagcgtccatgacgcccacctgccatacttgccctttaccgatttgccgagtctttgcggccccattgccgatcacccgtgcgacaatgcgccggacgagaaaggaatccgatggaatcgactgatgtactggtaattggatctggcattgcgggcctttgcgccgccatcgaagcggcacgcacgggtgcaaccgtcactgtggcaagcgccggcaagactatgagtggatcgagcttcttccccggaacctggggcctagggcttatcggacccgttaacgaagacgacgagcaggacctcatcgacaccatcctggccgtcggcggcggcgttgccgaccccgaactcgtccaagcgttcgtccacggcattccccaagcgattaactggctcgagcaagacctgggcgttgagctccagcgtccgcaaagcgccaagagtgctcaacaaaagcaatttatcccctgctttgaccacaagacgcgcatgtggcgcggcctcacccgcaagccccttgaggacgctctgacgacctggatcgagtcgctcggcattcgcctgctcccccgccatgagcttatcgaccttgttgaggacacgaacggcagaataaccggaaccgtactctacgaccttaccgaaaatcgaatcgtgccctttgctgccaaggccacggtcatcgcagccggtggcacaggcggcctgttcgagcgcagccttacgtcggctgatgtgctcagttcctcgcaggccatcgcgctggcgcacggcgcaacacttactaatatagagttcatgcagatgatgcccggcttcattgagcccaagcgcaacctcgtctttaacgagaagacctggcgctacgtcaaattcgatcagtcggttgacatcgacgacgacaaactggacaagctgcttgagcagcgctccggatacggccccttcacgtcacgcctggattcacgtgctatcgaccttgccatcgaccaagcgggcgccgagggcctagcgctgcattacgacttccccagtgaggacgtccccgagtttgtccagacctttgccacatggctccaggacgagcacggcattgctccgactgacgagatgcgcgtagcgatgtacgcccatgcctccaacggcggaatcaagatcgacaaggcagccgcgaccggcgttgcgggtctctacgcctgtggcgaggcaacgggcggcatgcacggcgccgaccgcattggcggcctgtcaagcgccaacggtatcgtgttcggacggattgcgggtgcatcggcgactcaggcggcgctggacgcccctgagacgcccttgaagacggatatcgccctcccccagcgcggcctcgccaaggcagatgcagagcgtctggctcgcagcctcaagcacacgatgagtagctactgcatgatcaaccgcaccgagacgggcctatccgaggcactacacgagcttgagggcttgaagacagaggcaacgaccttgagcacacagaaagcccaggacagcgaagtcgcagccctcgcccgcctgcaatcgcagattcaactagcacaggaaatggtcaaagccatgcgtaagcgaactgaaagtctcgggtcgcactatcgagcggattaaaccggacacctatctaaagcagaacacaaccaatcgatatccatgggccccgtgagctcgaagcagcacgggcccattcgtgtccgcacggcagcgtatccttattctgaatacagagtgggcaaagcccgcatagacaatagaccagcgaggaggagatatggacagtagagatatcgagaagtggcgtgtcgaacttgatagctacgccaatgtggaagacggcgttgaatattggctcgcacgcgatttaatggaacccatggggtacactcgatgggagaacttcgccgaagttgttaagagggcaaaagtctcgtgcgaaacaaacaaaactccagttgattcccattttcgtgacaccacgaaaatggtaactgccggtgtcgccgctcgcgcggttaaagactacaagctgacgcgctacgcatgctatttaatcgcccaaaacggagacccaaacaagcccgaaatcgcactcgcacaggcgtacttcgccgtgcagacacgccgtcaggagctcatagagcagcgcttcgcagagattcagcgcttgcaggcgtgccactcgctatccgattcagagaaacagctctcgggcattgcgttcaaacgaggcgtggactccaaaggattcgcgatcatcaagtcgaagggcgatgaggcgttattcggcggcagaagcacggcggacatgaagcggcagcttggtgtgtccaagagtgctgcattggcggacaagctagccgatgttctcatcaaagcaaaggacctcacgaactcgatgacggccttcaacgccgaggaacacgacttgtacggtctggaccagatcaaacaagaacacgtcgagaacaacacgagcgtgcgtggcagcctcatcgaccgcggaattgttcccgagaacctaccgcctgccgaggatacaaaaaagctcgagcgtcgcgtgaaggcagacgagaagaaactcaaggagggtactgacggtttcaccgatccccagggtagactcaatctgtgaaagcggccgcgccctttcgggttcgaccccatgcgaggttaacaaaaaaacgaccagcctaagccagtcgctttaacgatctttgggtgggccgtcagggggtcagcccgctgcgcaggcggccgctgcggcgccaaggcgccttgcgcgctgcgctggcaaacgcttacgcgtttcctcagctccgcgccctttcgggttcgaccccatgcaaggtcaacaaaaaagacggccaaccgaagttgaccgtcttaacttgctttggtgggccgtcagggggtcgaaccctggaccttgggattaagagtcccctgctctaccaactgagctaacgacccaaagctaaagtccgttatggcggactttagaggagatatcgtgtggtgggccgtcagggggtcgaaccctggaccttgggattaagagtcccctgctctaccaactgagctaacgacccgatatcaacacaaagcaagaactggggtgggtaaagggactcgaaccctcgacctacgggaccacaacccgtcgctctagccaactgagctacacccaccgtgtcctgtgcgcttcgcgctcgactattattgcaaggaacgccacgcgatgcaagccccaattttcaagaattttgaaaagagtttttcgagaccatttcgagcaaatcccaccggtttcataggagtaaacttgccccactgcaaatcctcgaaaggaccgtcatgaaagaactctccaaccgcacggcaagatttaccgattcggtcatccgccgcatgacacgcatctccaataagtatggcgctgtcaatctctcgcagggcttccctgacttcgatcccccagcgcagctgctcgatagcctcagcgccatcgccagcgaccccaagccgctctatcaccagtactccatcacctggagctcccaggccatgcgcgaggcgctcgccgccaaacaggagcactttatgggcatgccggtgaaccccaacgagaatatcgtagtcacctgcggctccaccgaggccatgatggccgccatgatgacggtcaccaaccccggcgacaaggtcgtcatcttctcgccgttctacgagaactacggcgccgacacgatcctttcgggtgccgagcccatctatgtgccgctcaacccgcccacattcgactttgaccgcgagacactcgaggcggccttccgcgacaacgaccccaaggccatcgtcctgtgcaacccttccaacccttgcggcaaggtctttacacgcgatgagctcacctttatcgccgacctctgcaaaaagtacgacacctactgcatcaccgacgaggtctacgagcacatcgtctacgcgccccacgagcacgtctatatggccacgctgcccggcatgtttgagcgcaccatcggctgcagctcgctgtccaagacctactccatcaccggctggcgtctgggctacactatcgcccctgccgaaattaccgagcgcatcaagaaggtccacgacttcctcaccgtgggcgccgccgctcccctgcaggaagccgtcgtcaccgccctcaaattcgacgacagctattacgatgaggtcctcgacctctacaccgccaaacgcgacctgttctgccagggactcgacagcatcggtcttgagcataacgtgccgcagggcgcctactacgtcatgctggacatctctgagtttggctacgacagcgacctcgagttctgcgaggacctggcctcaaaggtgggcgtgggcgccgtgcccggctcgagcttcttccgcgagcccgtcaaccatctgattcgtttccactttgccaagcgtgacgagacgctcaacgcggcgctggagaacctcaagtccctgcgtgataaaatcaaaccgcgcgggtaaggacggcccggcaactaaagcaaccaaataagccccgcaccgccagccgagttgcggggcttctttttatagcgccttcttaatttgtttagagcgttatactttagccatggagcaactcgtcccagagagaggaatattatggcagagcagcagcttatcggagcgctcgaggccggcggcaccaagatggtctgcgccacgggctatgcagacggcacggtcctggagcgtgagcagatcgcgaccacgaccccgcaggagaccgtcgaggccgtcaacgcgtggtttgccgacaagggcatcgccgcgctgggcatcggcgcctttggccctactgcagtcaaccctgcctcgccccaatacggcaagatcctggagacgcccaaaacggcatggcgctactttgacctgctgggtactatccaaaacgagctcaatatcccctgcggctacgacaccgacgtcaacgtcgcctgcctgggcgaggtcacctttggttgcgccaagggcctcaccgatgtggtctacctgaccatcggtaccggcgtgggcgccggcgtgctctcgggcggtaagctcgtgcacggcatgatgcatcccgaggctggccacatcctggtcatgcgtgacccgcgcgacaccattggcgagcacagcgcctgccccttccacgacaactgtctcgagggcctcatcgccggccccggcgttaaaaagcgctgggatggcaagagcgccggagacatggccgatgacccggaggccatggacctgctcgcaggctatctggcacaggcgctcatgacctacacgctgtgctacgcgccgcaaaagatcatcatcggcggcggcgtggccgaccacacccccatcgtgccgctcgcgcgcaaaaagtgcgccgagatgctcaacggctatatcgtcacgcccgaggtcaacgacatcgataactacatcgtcaacaacagcctcgagggcaagcagggcatcatgggctgcctggccctgggcgcacaggcgcttcagtagcagacgcacccacagggcgtggcgcgctcggcaaatccgacctacggaacgacgccaccacgccccatataagccctcaaataaaaaagggcttataggacaaaatgtgtgtcccgatagaacatccgtttccatccattaatccagccagaacgggtacgggtccctgtggtggaggtcctcccacactgccctgtcgcaccgcaggaagcttggatacgcctaggcgcggtccaagaaatcgtccgcacccccttttggccattttgccctccaaacggcactaccgccggcaacatccagcagatacgctgaatctagtcgtataggccctatgagaacgggagcaaccatggcagccttgttcacgacccccaaacgcaatgacactaccgccggaacccatgttgccgaacccgacgttcgccgtcgcataggactcgcgcacggcagctggcgccgcgtgacgcgccgcatcgtctgcggcctggcctgcgcgctcacggtgagctcgctgctcatgccgagcgtctcgctcgcagcggaatgggtcaaggtcggcggcaacaagtacaacaccgcggcgagcgacgaggccggtacctggtcgtgggacggcgccgacgacttgaagctcaacaactataacggcggcgagatccaggccgcaggcaagctcaacgtgaattactcgggaaccaacatcgtcactgccgaatggatcgaaagcatcaacgtttctcatggcactaacgagaatgccgagctcaatatccaaggcgacgagggcggcacgctcagcgtgacatctactgaggacgctatcctcaccacgggtaatatcaacatcgacggagccggatccgtcaacgccacgagcactgggtttgatgccatcaatgccggaggtgatctcgctatcaaaggttcgggcaacgtcaacgccacgggtgcatcggatggcatcagggcaaacggcaatatcacgattgacgacagcggagccgtcaccgccagggctaccaaggacaagggtattggagccgacaagaacctcaccatcaagggtggcgggacggtcgaggcaagctcagccgatggtgaggccctttggagcggcgacaatatcaacatctcggacggcagccaggtcaaggcaagctccgaggaagacgctgccgtcgaggccaagggcagcctcgcagccacaaacgcctccctcaacgtaaacggtgttgaatatggcgtctatgcccacaagggcatcaccctcgatcatgcaaacgtgacggtccgtgcaagtaaaggcagatacggtggcgccaacgccctcttcacctaccaggacgacatcgtcgtcaagaacggctccaccgtggacgcgtttgcggaaggcgaggtttcggctgcattctccaccagaaacgatcgacccaacgagaagggcggccacatctacatcagcgactccgttgtcaaggccatagcccgctatgtcgagaacggcgacggccccatcccctacagcgaaaaccaagatggcgagacgaggcgcgaaccccaaggcgagaacatcggcatcatcgcccagaccagcgagggcgtcacacccgcagtcatctcgatcatccgcagcaaggtaacggccgaaggagatacagcggcaatctttgcccgtgccatgagcgctgacggcaagacaatcggcaccatcaagattgagaacgccgccatccagacgcccgaaggcggcaaggtcattgactatcgcaagctccgtgacggcatctacgaggcaggccaagccatcggcacgggcgacgccacggtcgactccctctatatcaaagcagtcgccaaaagtacgaccatcgcacctcccgaggtagccaagccggaagaccccaagcccgacgagaccaagcccgcagaaagcaagcccgcggagtccaagcagaaccccaagcctgagggctcaaagccgaccaaggccgttgcggcttcaaccacgaaagccaagactaccggcgtgctcgcggcaaccggcgacacctcgggtgcggccatcgtggcaaccgtccttgcgggaacagccgctatcgccgcaggcaccatggcgagccgtaagcgttcttagacgcctctgcgcacatggcagctcccgcgaaggccccgagccccagcaccgtttaacaacgccaccgccgagctcccctccggcggtggcgttttccatatgcgtccgcaggggatgcacgagattgtctttggtctagcccaaccggcatacgctggcgtgcgacaattggggctgccgatatcacaacactgagagaagcccgtcatggaagcgcatcaaaagcagataaccgtttattcgaatcatacggaaagcgcgcctgtcatctaccttcctgtggtcgtgggcgacggcagcgaggtttataagtgttgccgagagctcgactgtccgcctttcgccctcgtcaccattggcgggctcgattggaatcgcgagctgagcccctgggcatgcgacgggaccgtacgcgatgccgagcctttcggcggccaagctgccgattttcttgatgagctgctgaatcagataatcccccaggtcgagtcgtcgcttcctcagccgcccacctggcgcggcattgccggctactcgctcgcgggcctcttcgcactctggtccctctggcaaaccgacgcctttgaccgcgccgcgagcgcatcggggtcgctatggtttcccgactttgtcgaccgtgccagcacggccccttttgccggcagcccgcaagccgtctacctgtcactcggcaaaaaggaaaccaagacgcccaaccgcatgatgcggcatgtactcgacgacacacgcgcgatggaagcgttgctcgtcgagcgcggcattccaacaacgctggagctcaaccccggcaatcactttgcccaaaccgacttacgcatggcccgcggcatccactggatactgacgcattaaaaatggtgcccacacgcatatacgcatgggcaccatatcttgttttagctgaacgcagctgctactcagcagcctcctcaagctcggagacatcaaactcaaagtcgttacccggcaggatggcgttgagcacgatgcccaccagtgagcccacggcaatgccggacagcgaaatggtcacgccgcccagctccaacacgatggcgccggcggtgctgtacgcgatgccgagcgaaagcacgagcaccagcgcggcaaccagcacgttgcggttgttctggaaatcgacctggttctcgatgaggttgcggacgcccacagcgctgatcatgccgtagagcacgagcgacacaccgccgataacgcatgccggcatggcggcgatgaccgcggcgaacttggggcagaacgaaagcacgatggcgcaacacgcggcaattcgaattacgcgcgggtcgaacacgcgcgtcagggcgagcacgccggtgttctcgccatacgtagtgttggccggagcgccaaagagcgaagccagaatcgtggcaaggccgtcgccgagcagcgtgcgatgcagaccgggatcggcaatgtagttgcgctcgcaagtcgaaccgatagcagagatatcgccgatatgctcgatcatggtcgcgaaggccagcggcatgatggtgatgatggccgtcgtggcaagaccgttatcgaactgcggcccaaagagtgcaaacacggtgttgtcccacacgatgggcagaccgacccacggagcggcggcaacgcccgagaaatcaacctcgccgagcgcagccgcaacggcatagctcaccacaacgcccagcaaaatcggcacgatcttgaccatgccacggccccagatgttgcagatgacgataacggcaacgccaatgacagccacaagccagttggtctggcagttagcaatagcggagctcgccaggatcagaccgatcgaaatgacgatggggccagtcaccaccggcgggaagaaacgcatgacacgcttggcgccaaaggcgcggaagagcgccgcaagcaccggataaagcaggccggcgcaagcaacgcccagacaagcgtagggcaaaagctcggtctcgccgttgggcgcgattgcggcataaccggcaataaaggcaaacgatgagcccaaaaatgccggcaccttaccgcgcgacaggaagtggaacagcagcgtgcccaaaccggcaaacaaaagcgttgccgaaaccgagagaccggtgagcacgggcaccagcacggtggcgccaaacatggcaaacaggtgctgcagaccgagcaaaaacatgcgcgggcggccgagcgacgatgcgtcgtagatggcatcgctggcggcgggcgtcgaggactgggacatgagagtcctttcaaaatggaagggcgctcgagcatagcggattacctgcccgaacgatacgatccgaaccattgtacgcgatgcgccatgtctcgcacgcgccgtcacctgcgaacgttaccgctatttccaaacgcgctcggcaatacgcttgaccagcgcgatctttgcccattgctcgtcctcggtcagcttgttgccaatctcgcagctggcaaagccgcactgcggagacagatacaggttctcgagcggaacatactttgcagcctcgtgaatacgctcgacgatggcatcctcgtcctcaagctcagcggccttggtggtcaccaggcccaacacgaccttcttgccaggggcaacgtacctcaacggctcaaaaccgccggcgcgcggcgtatcgaactccaggtaaaatgcgtcaacatcctcgtttgcgaacaggtatggcgcgatggggtcatagccaccctcgaaggcataggtagagtggtagttaccgcggcacacatgcgtgttaatgaccaggtcgtcgggcttgccctcgatagcggcgttgttgagcgccacgcccagctcactcaccttttgcagatcaaccgggctcatgccggtcttggacacaaagtcggtatcgcaatagatgccccaggtgcagtcatcaaactggatgttgcggcagcctgcagcgtacaggtcggcgatcaccgtacgataagcggctgcgatggcgtcggcaagttcctcatcggtcttatagacagcgcgcaggctctcctgctggccatcgcagcggtcgagcgtgacctcagagaacgtctggataggcgccgggatggtctggcgtgcaacgtggtcctcgccctcaagtgccttgacaaacttaaagtgctcgacgaaggggtggttctcgccgctgatggagccagtcaccacggcggtatcggccgtggtctcctcgtcgtggaacatatatcccgtacgcgaggtgcgacgctcgacgccgttcagcccccacataaaatcgaggtgccagtagctgcggcgaaactcgccatcggtgatgacctgcaggccggcggccttctgctttgccaccaaatcgcgaatagcatcgtcctcgacggccttaaggccggaagcgtcaagtttacccgcgacataggcggcacgggcatcctttacagcctgcggacgaagaaaactgccgacgatatcggcgcgaaacggcgcgttcggttgaatcgaagtgctcatagatatctccctttgcattggttgctttactgggacagagtatgagcgctcatatggccatcgtaaaatatacgtttataacagtttgatatagatgcttcctatatcagtctggactgtcataaagagacttgaaccgtgcggagcacagcagcctagatatgctgacgaatcgcgtcgatataggcccgaccgtagcgcgtgagcgtcgtgttcttgcgcgtaataatgccgatctccatgtactcgtccacgtcgagcggaatcgagataatgccggggccgttgagctcgtggctgatcacgcccgagcataccgtgtagccgttgaggcccatggccaaattgaacagcgtcgcacggtcacgcacgcggatattcttgcgacgctcaaaggtcgaggtcagctcctcggaataataaaacgagttatagctgccctgctcgtaggacaggaacgggtagtcttccagatcctcgagcgtcacgctggagcggcccgccagcggatggtcggcgcagacgaagacatgcggcgtggcgcagaagagcccttcgaacacgagctcgttggccaccagcatgcgctcgatgacctcgcgattgtgctccgacagatacaggatgcccagctcgcttttcatatgcgcgacatcctcgataatctcgtgggtctgctcctcgcgcagggtaaagtcgtagcgcgcggcatcgaactcgcggatcacatcgacaaacgcattaacggcaaaggaataatgctggcagctcacactaaagtgcggcacctgctcggacgtacctttgtacttgccctcgagcaggtcggcctggtcgagcacctggcgcgcgtaccccaagaaggtctcgccttcctcggacacaatgacacccttgttggtgcgctcaaagatatgcacacccatctcgttttcgagatcgcggatcgacgcggtaatcgaaggctgcgacacaaagagccggcgcgaggcctcggtgatgctgccgcattcggcaactttgacgacatatctgagttgctggagcttcatggctttctccctagacgttcgtgacgtcaaaacccgccgtgtccatttggctcataaacgacggcatctcccccgtcgcggcgcaggcggcaatctgatgcagagccccggcaaccgcatcatctgccgcagcgccaatatgccagcgtgcggcagccgtgacggcctcgttggcattggcgactgcaacggagttaggaacggcatcgatcatgggcaaatcgttatcggaatcgccaaatacggccacctcgtcgggcgtcaggcccaaagcgcgcgccagctccagcgcagcgcagcccttgtcccagccggtcggaagaacgtcgaacaggcgcacgcggttgttgggaaacacgagtgagagctccggcacctcagcggcaacacgctcgcgcagctcggcgagctcctcgcgcgaacgggcactccagatattcgccttgtataccggggcatcgtcaacgacaggacgacagggagcctcttcgcccttgagccacgcgttgccgcctgacttcatggcgcgacgcacacgctcgggatcgcttgtcacgcaataggcatcgttattccaaaagtcatcacccagacggtagaccttcaaatacgtatcgtcggtctcctgttcaaaataatcggctaagcgcataaggacatcgttatcgattgcgcgcgaagcgactacttcgccatcgacaaacatcacctggccgttgcaaaacgcaccggtcgagaagcactcggagcgattgcggaacatccagcccatcgcggacggctgacgacccgaaaccggcccaaagtgcaaacccgccgcctgcatggcatgaataccctcaatggcgtagtcgctggcgccgtcatgcccggctggaatcagtgtatcgtccatatcggtcagcacaagtttgatcataaggtcccctcggtcattcttaatcccatctattgtaccgacctgccaaaaagggacaggtttatttcggcaggtttcatctgggaaaacgcaaagtcccagttgttacctgccaaaataaacctgtccctttttggcaggtgcgctagtatagggaacaacagattcgatgcgggagtgccggcggtgcaaaccacaaggctgagagggcaatgggcccaatcctttgaacctgtcagttaatgctggcgtagggagcatgccgcctttacaggggcgctgtctatgcacagcgccccttttctatgccaaggaggcatgtgcagtgattgattcggaacagcttaagcaacatatggtcaaggccgtggaggagattcgcgctaccaatccgatggccggttccatcaccaacacggtgacgatcgactttgtcgccaacgcgcagctcgccgtgggcggatcggccgccatggtctatctgcccgacgagggcgaggcactcgttgccggcggcggcgccatctatctcaacatgggcacgctcttccccatttacgagcaaacgattccccgcgcggccaaggcggcacacgacgccggtaagccctgggtgctcgatccggtgggcctgggtatcggtagcctgcgcacccagctggtcaacgagctcaagcagtacaagcccgccatcgtgcgcggcaacgcctccgagattatcgcgctcgccggcctgtggggtcttgagggcgaggcggccgatctgagccgcgtgcgcggtgtcgataccaccgacacggtcgacgccgcccgtggtgccgccgtggcgctcgctcgccacaccggtggcgccgttgtggtctcgggcgaagtcgacctgatcaccgacggcacgacggtggccaagtctcacggcggcagcccgctcatgtccaagatcaccggctgcggctgctcgcagggcggcgtgctggccgtgtacgcctgcgccgccgacccgtttacggcagccgtctgcggcaccgccgtctacaacgtggccggcacgcgtgccgccgctgtcgccgacgccccggcaagctttaaggtcgcctttatcgacgagctctaccgcgcaaccgcccaagacatcgccgataaccgactcgagctcgaggaggcataggccatgtccgagcccgcaaccaatgccggcatgaacacgctcgtcgccgtggccatcgccccgtgcggcaccggcgatgagctatccgccgaggtcgccgaggtcgtgcgtgtcattcgcgagagcggcctgcccaaccgcaccacctccatgttcaccgagatcgagggcgactgggacgaggtcatgcaggtcgtgcgcgacgcaacctttgtgttggcgagcaagggcatccgcaccgaagtcgtgctcaaagccgatattcgacccggatttaccgacaccatgaccggcaagctcgaacgcatggaagcgcagatcaaaaagcaggaggaagcacgatgagcatccgcgacaaccttgatatctcggcctatctggtactcggccccgaaaacacgctcgggcgtcccgtgggcgatgtggtggcccaggcgctcgacgccggctttacctgcatccaggtgcgctccaaggtggcaagcgcccgcgagatcattgcgctgacgggcgacgccgcgcaggcaatcgcacaggccggcaaaaccggtcaggttgccctgctgatcgacgaccgcctggactgcgtactcgccgcgcgcgagcagggtattgctgtcgacggcgtgcacgtgggccagagcgacattcccgtcgaggtctgtcgcaagctgctggggcccaacgccatcgtgggcctttccgcccgttgcgaggagatgctcgagtacgtcaagaccgccgacatgagcctagtcgactacctgggcatcggcccactccacgagaccgagaccaagcgcgactgcggacgcgcggccgacggctctatcatcaccaagagctttgaggacctggccgccctccacgcggcaagccccgtgcccatcgtggtgggcggcggcgtcaagacggccgacctgccacagctcaaggccaccggcgtcgacggctttttcgtggtgagcgccgtctgcagcgccgatgacccctacgccgcggccaaggagctcgtcgacacctggcagcaggcgtaagtctaggccgagcagctgattcgcagcctcatatcttcagcaatggaaagcgcatcccagtttgagcctccattccgggatgcgctttccgcatgcgacccttaccccgccagatacgctttcaacgccggcaaagtcgcctccgcatctcgacgaccgatctgatagatgcgctcgagctcatccggttcgcggcacagcgacggcaccttcaccgattcgctcggccgcaccataaagacctcgccggcagcctcgcgacgcgccaggtcatcgagcgtggcattgtagacctcatgccgatgctcaagcgccgcgacaaactccgggtagtgacggaacacgcgccgcagcatgggcataacgctgttgggctgctttacaaagcccgccggttgcgtcagcaccaccacgttgcggtcgtagccctgcgcaaacagccatgcactgggaatagaatcagccacgccaccatccagatatttgtgtccctcaatgacaacaggacgcgtcgccacgggaatagccgacgacgcccggatccactcgatatcgcgctcatcgccatagggcaggtcgtggtagacagccttgcccgtctcgatatcggtacacacgcacgtaaaccgcatgggacaggcgcgatatgtctccaggtcgatgggatcgcgctcgataggcacctcgtgataggcaaaatcggcattgaacatatcgccggtccgcagccagcttgctacacccgcatagcgcttatcggcacaataggccttgttatagcgaatggcgcggccgatctggcgcgatttaaagttgtagccaaacgccgcacccgccgagacacccaccatatggtcgcaggtcaaaccgtgctccatccaaacgtcgagcacgcccgccgtatacataccgcggtagccgcctccctcgagcgcaagccccaccgtgtgtgatgtctccggctgtgtcatgcaaccatctccgttcccatgcttttgaactcaacaagtatatctgtcaacgtatgccgtcaaaaacgtgtttataagcatttatcgaacgtttcccaatgcattccccatgccgtaccgcaatgcccctagatggccttaggcatgaacgcccttaagaacgttgcgggataaacatcgcccgcaccatgccgacgtcatcgcacgcaacgtgagataattctcagcagaagtcaccaaaagcagagggagtttatgatgaaggttcttttggtcaatggcagccccaaggcaaacggcaacaccgcccgcgcactcgccgagatcgccgagcaactcaatgcggaaggcattgataccgaggtgtttcagctgggcgccaagcccattcgcgactgcatcggctgcggtcagtgcggcaagcttggcggtcgctgcacctttgacgatgacgtggtgaacgagctcatcgctgccgccgagcaggcagacggctttgtctttggctcgcccgtctactatgcgcatcccagcggacgcatcctctcggctctcgaccgcgcattctatgccggcgggcatgcctttgagcacaaacccggcgccgcggtcgccgtcgcccgtcgcggcggcacgtcgaccaccttcgatgtgctcaacaagtacttcaccattaagcagatgcccgtagttgcttccacctactggaacaacgtgtttggccgcgtgcccggcgacgccgatggggatgccgagggccttgccaccatgcgaaacatcggtaagaacatggcttggcttctacgttgcatcgaggccggacaggccgccggtatcaacgcacccgaggcagatcgagcaacgaccaacttcatcaggtagaacggcggaacatactatgaacgtgcaaatcttcggcaccaagaagtccttcgataccaagaaggcacagcgttattttaaagagcgccgcattaaggtgcagtttatcgaccttaaggaaaaggagatgagcaagggcgagctcacgagcgtgatgcaggcggtcggcggtatcgacaagctgctcaaccccaaagccaaggacgaggagacgctcgcgctcattcagcatctcacccccagtcagcgcttcgacaagctgctcgagaaccagcaggttctagccgagcccatcgtgcgcaacggcaaaaaggccaccgtcggttattgccccgatgtatggggagcctgggagtagcttgtgttatttgccggcgcgtgggtataagagcaggcgtttggcataagattcaactgtaagccatgtctaacaaaggagggcacatgcccaacaaacccgtgaagatcatcatgcttaccggatacctcggtgccggcaagaccacgctgctcaaccacatcctcgctaacgacggcggcatccgcgccgccgtgatcgtcaacgatatcggcgagatcaacgtcgacgccagccttatcgccgacggcggcctttccgagaccgatgacctcatcccgctcaccaacggctgcatctgctgcacgctttcggacgacctggccaaccagctgcagggcatcgccgattcgggcaacttcgattacatcatcatcgaggcctcgggcatttgcgagcccatccccatcgcctacaccatctcgagcttctgcgacgaggccaaggtgggaggcgagcccaagctcgcgctcgacaacatcgtggccgtggtcgactgcgcccgcatgtacgacgagttcaacggcggtcgcgacctgctggcagaggatatcgacgaggacgacatcgagagtctgctcatccagcagatcgagttctgctccacgctgatcctcaacaagaccgataccgtgagccctgagcagatcgccgagcttaaggccatcgtgcgcagcctgcagaaagacgccgtgatcgtcgaggcccaaaacggcgaggtccccatggaggagctgctcgacaccgaccgcttcgactttatgcgcgcctacaactccgccgcctggatcgaggccatggaacatcccgaggagcacgacgaccccgaggtgctcgagtacgacatcgagacctttgtgtactcgcgccgcaagccgtttgacctgcaaaagttcaccgattttgttgagcaggagtggcccgacgaggtcattcgcgtcaagggcccgctgtggcagaccggcgatccggacatgtgctacatgttcgagcaggccggccaccagatgcgcctgatggagaacggcctgtttgtcgactcggcgcccgagggcgagaagcagaagatcatcgacgagaaccccgagatcatgcagatttgggacgacgagacgggcgaccgcatgacgagcctgtgcatcatcggccgtcacatggacaaggatgcgctcatcgcctccctcgatgcctgcctgaccgactggcaccgcgcctaggtttatccaagcggacatttttccgctacgtaaccgccaaaccaccacgaaggtgcctgtcccctttgtggtggtttttcgttctgagccaaggagattcatgttcaacattgtgctgtatgcgcccgagattccggccaatacgggcaatatcggccgcacctgcgtggttaccggcgcccgcctgcatctggtggagccgctgggcttctcgctcgacgacaaaacggcacgtcgcgccggcctgggctactggcaaaacttggacgtgaccacctatgccagctgggaggatttccttgcgcgcaatggcctctcccctgccgacgaacgcctgcatctgctgaccaaaaaggcacgccgcacctatgcgcagagcacctaccgcgacggcgactacttggtctttggcagcgagagctcgggcattcccgagccgctgctcgccgcggcgcccgagcgctgcgagcgcatccctatgctgcgcgattgcgactcgctcgataacgccgaggcctgggaagcccacgaggaatcgctcgggcataccgaggacggccacgaagccatccttcggcaggacatctgcggcaacttcgtcaatccggacgactaccgcatcagcgcactcaacctctccaacagcgccgccatcgtcctctacgaagccctgcgccaaacaggctttccgggaatgtgacaaaggaactgtccctttgtcacattcaagcgccgcgccgatggcgcacacgcctaattgatgctctagataaagagcctcacttttaatcagaattaactaaagtaaaatgaagttaaacggcggtgtgaaaggagagccttgtggaatatctcgagaacccgtttacccccagttttggtgaggttcccgcccatctcgctggcagacaacagattattcgggatttggaccgtgccttcttgagccagcgcaggcgcccagaattgacctcgatcttctcaggcgcgcgtggaaccggtaaaaccgctctcatgtcgtcgctcgcgacaagggcggaatcccacggctggatagccgtaaagacgaccgcgctcccgggaatgcttgaggaactcgagttcggggcgaaacgcgccgcagcccatctcatcgacccgtccaaccacttcgaagtcaccggcctcggaattgcaccgctcggcagcatcgaggtcaatcgtgtccacgatgcctcaacctggcgttatcgcatgagcgacatcatcgaccagctcaacgaggcgggcaccggtctgctcgtcacggttgacgaggtggacccgacactcgacgagatgattcagctcgcagcgacgtatcagcactttgtgaccgatgggaaacgcgtcgccctgctcatggcgggacttcccaacaacgtctcgacgttgctgaaccacaagacggtctcgttccttcgccgcgcccaacaatatcatctgggtcgcattgccgactatgacgtacgcgaggccttgattcgcacgatccaggaaaacgatcgcttggcagatgctgagggaatcgatagagccgttcgctcgatctctggttttcccttcctattgcaactcgtaggctaccgtgcctgggatctcacaagcgattcgaaggagatctcgtcacgcgactttgacctgggaatcaaaatcgcgcgcgacgagatggacaaccgaatcctcgcggcaacctatcgggaactcactgcagaggacaagcgattcctcatcgccatgctcgatgacgaggaagagtccaccaccgctgaccttgtcgagcgccttaggcgttcgccgcagcaggtctcccgctaccgacgccgcatgatagacgccggcatcatcggggagcgaggacgagggctcgtcgcatttgaattgccattcttccgcgactatctctccgctcagtgcgtgaaataggcatcaatgaggcaaagggactgtccctttgcctcattgtctataggtagcggccagtaacgctcttgggacaggcagcgatatccgccggcgtgccggcgcagacgatttgcccgccggcgtcgccaccgcccgggcccatgtcgatcacataatcggcgttacggataaggtcgagatcgtgttcgatcacgataaccgtggcgcccttggaaacaaggccgtcgaacacactcagcaacacctgaacatcgagcggatgtagtccgatcgtgggctcgtcgaatacgaacacggcatcgtcctgcacgcggcccatctcgctcgcgagcttaaggcgttgtgcctcgccgcccgagagcgccggcgtgggctcaccgagcgtgagatagcccaagcctaggtcatgcaaggtctgcaagcgcgcctggactttcttgagtcccaccgtggcgtcgagggcctcgtccacactcatgtccatgagctgcggcaacgtaagcaagctcccgtccttgccctcgcgatggatatgcgaggcggcctcggcgtagcgcgaaccacggcatgccgggcagatgatctcgacgtcgggcaaaaactgcacgtcgagcgatatcgagcccgtgccgtcacacgtagggcagcgcaaggcgccggtgttgtagctaaaggcgcccgccttgtagccggctgccttagcctcgggcgtacgggcgaaggcgcggcgcagctcgtcatgaatgtcggcataggtcgctaccgtcgagcgtacgttggcgccgatgggcgtagcgtcaatcagatttgcgcggccaatgccctcggcatcgacccaacgcacgtgccccggcaagcgctcgccagctgcctgcgccttaagtgcaggaatgagcgtctcgagcacgagcgtcgtcttacccgaacccgaaacgcccgttaccgcgacaaggcggccgcgcgggatatcaacctcgagcggcttgacggtatggatggcatcggttgccatgcggatatgtccctggtcgaacatttcgtcgtcagtcacctgcggacgcaagcgcttgagctcggcgcgcaaaaacggcgcgatacggctgccctgcgattgctcgacctcgtctaccgtaccagcggcgattacactgccgccgcctgctccggcaacggggcccatctcgaccagatagtcggcttccgccagtacgcgcgtatcgtggtcgacaacaaccacggtgttgccgtcatccaccagatcgcgcatcacgcccaccaagccgtcgacattggcgggatgtaagccgatcgaaggctcgtccagcacatagagcacgcccgtcgatcggttgcgcaccacgcgggcgagctgaacgcgctggcgctcacccgtggagagcgtggcaccagcgcggtcgagtgaaaggtaatcgagacccaggtcgaccagacgacgggccacgctcaaaaacgaatcgcagatatccgtcgccatgggccgcatctcgggcggcaaggatgcgggcaccccgcgcacccactcaaccgcatcgccaagcgtcatggccgcggcctgcgccagattgataccgcacacctggggctggcgcgcagcctcggagagacgcgtgccgccgcaatcgcggcatgctccctcgcgcaaaaagcgcgcaacgcgtttgaggcccttgtcgtccttaaccttggcgagcgcattctcgacggtatagacggcgttgtaataggtgaagtcgagcggcgtggcaccctcgccgtttttgggaacgtagagaatgtgcttcttaaccgccgggccgtggaacacgatgtcgcgttcttcaggcgtgagctggttaaacggcacatcggtgcgcacgcccatctcgccagccacttgcttcatcagatcccacatgagcgtaccccagggaagcaccgcgccctcgttgatagtctttgactcatcgggcaccaggctcgcttcgtccacctcgcgcatgacaccggtgccgccgcaggtgggacaggcaccgccgctgttaaaggcaaggtcctcggcgctcggcgcgtagaactcgcgaccgcatgcagggcacgtgagcgacaggcccgcagccacgttaaggctcggctccacgcgcgccccgcagtgcggacacacgtgatgggcgcaacggctaaagagcaggcgcaggctgttgttgagctcggtcatggtaccaaaggtcgagcgcacgcccggcacgctggggcgctgatgcaatgcgagcgccgccggtacgtgcaatacctcatccacctgggcgtgttcggcctgcgtcaggcgacgtcgagtataggtgctgagcgcttccaagtagcggcgcgaaccctcggcataaagaacccccagtgccagcgaactcttgcccgaacccgatacgccggcaatacccaccagctttcccagcggaatatcgatatcgatgtctttgaggttatggacgcgcgcgccgcgtacctcgatagcctgcgggctcatcttctgttccgtcacctttatcaccctactcatgccataaaactcgatcgcgaacgtacgcgcccagcatgggcacggtaaatcggacgaggccgtatccggcagcctcgatgacacgctcgcgaatcaggcttgcgcgatatttgctcgcccagctctgggtgcgatcgcagcgctcaatgatatccgccatgcgagtcggtttgccctcgtcaaccgccatggcctcgataaaaaggcgctgtggactgcgcagcccgtaatatagaggcgcgtcaaccgcttcgtagaactcggagacggcatccgcatggccatcctcgacatcgtgcctttcgatgacttgcgagccacgccggacagcagagcgccacatgtaatagcccaccagctgaaccatatagggatgccccatgctcttgtgtgccgcaagatccgccgtccccgcgtcaacgtaaagaccagcgtttttgaccgtctggatatatgaatcgcgcaccttgggcaaagaaatcgcccccagcgtacgctgctgggcacgccgcaaaaacgtcacgctcggctcttcgagcagatcgtcaaccatactgggtaagccggcaaacaccagcgcaagaccgcgctggtcgctatcggacaagcccgtggcatcctggtctccgagcacctgctgatagagaacggcaagggccgccagctcctcgatagacgccgattgtgcctcgtcaatcgcaaacagcatgcctttgcctggatcgagcttcttaaggcgctcgttgaccagcccgcgcagcgtttcaccctttgcacgcgccgcctcgaccgacatgcgcccgaatgatggactgagttccattgacgtcacaacgggtttattcgagcgaagtgcatcggccaagcggtcgcataagccaagcgaagcggaatcggagacaaccgcccatccgcgctcattggctagacgttgcagctcccgcaggagaaccgtcttgccgcaaccgcggtttcccgtaatgagtatgagcctgcccggcgctccggcgccgttatcgagcccttcctcgaaatcttcgatgaccgactcgcgaccgatgagtatcggaggccgcttgccagccgtgggcttaaagggatttggattcatgtcggcctcctcggattggcaaaccttggcaatagttataccaacttgtaccgagttataccaatagcatgtgacaaaggaactgtccctttgtcacatgtggccgaaaaactcggcgtctgctgctcgccaggggcgaaaggtggcgggatcgacctttacgtgcgccgtggcggggacgtcgtgccacttgacggtgtagccggcgccatgagagcagaagaccgagtcgggcgtattgggcagatcggcctcgggcttataggcggccgcctcaattacgcgctcagcatcatgacagggcgcgtggccggcaaactccaggtacagatgcccgcggccactcgtataggcagccacctccagcgcgtaatcctgcacttcggatgccggcacgcggcccatgagcttggcgcggtctcccgccatcgtcggcggctcgtactcggcacccatacgcgtagcatccgaaagcgcccggcccacacactcccccggcacctcgagctcaaagtggtaccacggctccaacagcaccgccgcgcccgcctcacgcgcctgcatgaacccctggcgaatcgcgcggtacgtggcctggcgaaaatcgccgccctcggtgtgtttggcatgcgcacggccgcccgtgagcgtaatgcgcacatcggtgacgggcgagccagtcagcacgcccaggtgatcgcgctccatggcgttggtgagcgccagacgctgccagttcaagtcgagctcgtcagtcgaggtcacggtgccaaattgcacgcccgagcccgccggtaacggctccaaacgcagatgtacctcggcatagtggcgcagcggctcaaagtggcccacgccctcgaccggctgcgaaatagtctccttatagagaatgccgccgggctcaaacgcaatcgaaaggccaaaacgatctgccaacacccgctgcacgacctcgagttgcacggcgcccatcagctgcaggtgaatctgctccagatgagtattccagcttacgccgagcataggatcttcgtccgctaactctgtcagtgctttgaacaccgcgtggacatcgtgttcgcccggaagcaccgtataggtgagaaccggcgcaatgacaggcgcatcgcccgcgggctccgcacccagggcgtcccctgggcgaacgtgcgcaagacccgtcacggcacaaataccgccagcggcaacttcttgggcaagctcatacttctcgccgttatagatgcgcacctgatcgaccttctgctcccatgcctcggcaccggaacgtccgctaatcatctgcttggcatgcagcatgccgcccgtcaccttgacccaggcaagacgctcgccacgctctccacgactcacgcggtagacacgcgcggcgaactcctggggccatgttcgctcgcgcatcagagcacatatgccgtcgagcagctctgccacaccctggtccttgagcgccgatcccgcaaagcagggaaacaatttgcgctcggcaaccatgcgtgacagcattgcgacagaaagctcacccgcctcaagaaactcctcgagcgccgcctcgtccaacgcagcagcgtcctcctgaacggagccgcccgccagcagttcgctggcatccaggcagccctcggaaagacgttgcccaagttgtgccagcaaaacatcgcggccgggattctccaaatcgattttgttgatatagatgaacgtcgggatgtcatagcgtgcaagcaggcgccacagggtttcggtgtgcccctgcacgccgtcgttggcgcccacaactaaaatcgcgtagtccagcgcgcgcaatgtgcgctccgcctcggccgaaaaatcgacatgccccggtgcatccacgagcatgacgtgggtatcgccatggtcgagtacggcctgcgacgagaaaatcgtgatgccacgctcgcgctcgatcgcgtcagtgtccagatgcgaatcaccatcgtccacgcggccgcgcttgcgaatgcgacccgcgttgaacagcatggcctcggccagcgtggtcttgccggcatcgacatgcgccacaattccaacgaccgcttgcttcgacatggctctcctcttattgcaagcccatcgcacgcggcaacgggcatcctcgttccacactggatgatacaatttacgggccggcgggcgaagcgggccctatcccccgaccgagctcatcgccccgcgttgccgcgcggcgattttcgtaggttcgcgccttgcgaaagccggcacctcccttttttgtctgcccggggtcatctgggacggtagcaacgcgagccccacaacaacgcgttttaccaaaaatggccccactcggggccattttcatttcggtgaaacgctggtatgtgactcggcctttatgcctcgcgcagccaatcaaacgcgacgcgcggcgtaccgtccgacacatatacgataccggcgcgcttaaacccggccttggcgatggctccctgcatgggcaggttgtcctgatgcgtgtcgatgcgcaggtgatcggcacgctccttggcaaaggcaaacatcgcagccgcgataccgtgcacggtgccatcggacgccacacggtgcagcacggcgtacggagtgtcgctgcgccattgaccatcctcaattacgtcatagcactcgtccgggccgggcaaaaaggcaaacgtcgccaccacgcggccatcgacttcgcacacatagctgccaccggcggcgatatcggcagccagttgctcggcagaaggcgtgccctcgggccactgtgtggcgttgccatgcgcgcgcataaaggcgcgggccgcgtcatagatagccatgacagcgggaatgtcggtatcgagggtttttctgatcatcacgcggcgacctcacgtttattggtatcactttgattgagcaatgataccaacgtttggagaggggcgcgatgcagatggggagcaaaaagcgagccgcctggtcaaaagcaaaaagcgagtttttgagcactgccaccggcggcgatatgagcgacctgtttgcacgcgaggacgagcgccgcgacgccctggacgccgagcgcgatgaggcctggcgctacaagtcgtgcgagcgcaaaaaccgttacgacacgcgcgccgaggccgaggccgttatggccgactgcgaaaaccgcgggcggcgcggtttggcctgctacaaatgcgaatactgcggcggatggcacctgacgtcgcacccttggaaataggcgccgcatcggcacggcattgacggagcgccagccatcgcacgcaagctacgggcgcggcggcaccaaaacatcgtaacgaacggccttgcccgcaagttgatagctcggcttaacgccggcaagcagtggccccttcaccggtcgcttgataacgaccttgcgcgggtgcaccgcaagcgcagcttcgaccaacgtctcctcatcggcgcacggctgttccagatgatgcaagagttggaacttctttttaaccgccgcgctcttggtgcgtccgggaaacatggggtccagatacaccacgtcaggaacggtgagctcgccctgcccgatcagctcagctgtatggcgaaggccggcaatgctgtcctcgcccgcatgtaagcgcatgcgcgccacggctgtcgcaagcgccggatcatctgccgcgcgatccaaggcatccttgaggagcgccgcgatcacgcaatcctgctcatacagatcgacggcaaaacccgcagccgccagcagcagcgaatcctcgccaaagcctgccgtggcgtcaatcgcccatgggctctcgatgccttttgtgcgcgcggcctttaccaacagctcttgctgcagacggccctgcttgagtcgcggcagcatgcggccaaaatccgcgcgcagctccatcgtgccgtcggtgagcgtgaggccctcgggcttcccgatcagctcaagccccgcggcccgagcaacagataagggatcgacgacgcccatggacactccttaacaagcaaaacgaatacgcggggcaccgtttatgtcagcacccaaccgttcgctattgtcccacatgcgacatggcccacagcatcccaatgcaaagcaccgtcatcaatcccgtgcacacggcagcgatcgcagaatcactcatgcgccttcccaacgaccgcggctcatgcacttgccctgctccgtacatcatggctcctccttgagaccagctcttaccatggacccatcatcgcagcgccgcgcatacgctgccatcgatttgacttacgcccagccttcctttttgaaaggttgggcttggctgcgcgggctcaatgcgctttcaaacgcatgcatcgccgcgttgaactacaatgtgcttcaccatatgtgcagtacattgggtgcgccaagttggcgtactcgtatcgaaaggaccagccatgagcttcactcgcaagactctcaaaatccttgctctcatctactttgttttgggcatcgccagcctcgtcaccgccggcgtcggtattgccacgggcggtctcgattccacgtacggttcgtacgccacactcgcagcggtcgtgcttatcgccaagggtctcgtcgaccttgccgcaggcgtcgccggtatcaagggcgccaacaagccttcgcaggtggacggcgcgtttaagctcggtattgttgccgcggtcgccacgcttgcccaagcggtgctcacgcttcccgcgtttggcggcgacgccatcaactttggcgcctttgtcatcgtggtgtacgacctgttctttgttcagcaggcacacgccgttaaggccgagaacaaggaccgcctataagcgctcgcttctcataacccctgcagccaggcaactaaaaagggccgatcgcgcatctccgcggtcggccctttacgtttgcccagataaaacctaccaaaataaacctgtccctttttggcaggttgttagctgtggcggtactcggcgatgatgaagtcgatatcggtctggagcgtttccaggtttgccaggcgctctttgtcggcagggcgcgtgcggtagtagtacggcgtcatctggaacaccgcctcgatatcggcctgggtctggagcgtaatattcgcagacacccgctgcgttccgaccaactcgagctcggtggtcttcggcagcttctcatcgttaaggtacggcgtgtcgtagagcacctccttgagcccaaagagatgacgggcacccggcaccacggtgtagagcgagccctcgggtgccagcacgcgggcaaactcgcgctcgttaaagggggcaaagagctcggtcaccatatcgaaggcgccatcggccacggggacgtccttcatgttggccacgaaataggtcgcatcgccgcgcttggcggcaaggcgtaccatctctttgcccaggtcgaaaccgtaagcatccacacccggcaccgcgcccatggcgctggtgtagtagccctcgccgcagcaaatatcgagcaacgtcatggggccgttcgtagacgcagcgcacccagccgcccgctcacgcaccagctcgaccattgcatcgcgcaacggcgcatagtagccacggtttagaaagtcacgacggctgcgtgcctgcgacttgggatcgcccatggagtcaccgctcttggacgagcgcagtagatatagataaccctcgcgcgcacggtcaaaccggtgtccgcccgcacatgcggccccacgctcatcgtccaccaacggttcatggcaaacgggacacaacaacatggcaactccttagcgcgaacaacacaacgcccaccattgtctcacgccttccccacctagtcattggggacgttcttgaatgactagttagaagagataaggagtgtccccagctgccgacagaaaaggaacgtccccaagtgccgactggttgcattaggagtatcatcatctgcgcaaataagcacgaaagagcatgttagagattgagagcgtatggctgacaccgtatctaagcacattgacatgaccaccggctcgctgtggcgcaatattcccctgttcgccttccccgtggccgccacgagcatcttggagcagctgtcgaacctcatcgccacggtcattatcggtaacttctcgggcgaccagggaaccctcgccatggcggcggtcggctccaatgttccgcttaccagtcttatgctcaacctgtttattggcatgtcgcttggctccaacgtggtcatcgccaacgctatcggccgcaacgatcagaacatggtcaaacgcgccgtccatacctcgattttaatggcactcgtgggctttgtcgtcatcgctctgggcgagatctttgccgagcccatgctcgccgcgctcaacgttcccgccgagaccatgccgctcgcctcactctatctacgcgtctttttgctgagcatgccctcgattttgctctacaactttgaggccgcgatcttccgctccgtcggcatcacccgcatgccgctgcaggcgcttgccgtgtccaccgtcctcaacattggcctggacctcatctttgtccccgtacttcactggggcgtcgcgggcgtcgccatcgccaccgccatcgcctacaccgtcagcgccgctacgctctttatccgcctgctcaagaccgactctgtcgtccgcgtcaccccgcgtgacttggctatcgaccccgtcgccctcaagcgcatcgtcaagatcggcctgccagccggcatccaaagcgccgtctttgccgtagccaacatcatcatccagtccgccatcaacagcctgggcaccgaggtcatggcggcatcgagcgccgccatgagcttggagtacgtatgctacaacctgctcaacagctttagccaggcgtgcaccacctttgtgggacaaaaccacggtgcccgccagatcgaccgctgcaccaaaacgctcaaggcctgcctggtcgaaggcggtatcgtcgcgctcaccacgatcatcgttattgtcggcctggggcgcgagatcttgtcgctgttcaacagcgatcccaacatcgtctcgatcggctatatccgcgtgtgctcgatcttcccggcgtacgcctttagcatgttctacgaaaacatgtcaggctacctgcgcggctttggcatctcgctcacacccgccctcatcaccatgatctgcgtctgcggcatccgcttctactgggtgttctgcgtgttcccgcacttccgcacctttgcgaacatcatgatggtctaccccatcagcctgggcaccacggcgttctttatggtcgtggcggtactactttgccacccggcacgcacctatcgcgccacccaagccaaagcgacagcccgctaaacaccgcactcaacgccacgacagtcattaattgacaatatgcgagctcatatagtcgataaagcgcctcgtggcgataggcatggtgtcccagctgcgccaggcggccaccacgtcgcgcgagggggcatgcacgatgggccgcacacgaatatcggctcgcatgccctccacagtacgacggtagagcatgctcacgcctaggccctcctccaccatcgccatgatggtgtagtcgtcagtcacctcgctcgtcacgtgcggcgacagcccatgcgccgcaaatgcatcgagcaccaggctctgttcgccctcatccagcagtacaaacggctcggacgccaggtcggcgagtgtcaccttttcctttgccgtcagcggatgcgcggccggcaacaatgccaccaactcgtcgtgatagaccacgcgcttctcgagcccagcggtaaatccgcgtgccgtaaagcaaaaatcaaccacgccatcgtgcacccactgggcgttgcgcgtgtaatcgccctgcttgagggtaaagcgtacgcccgggtgcagggctccaaaatcgcggatcacgcgcggcaacacggttcgactcacgttggtaaacgtcgcgatgcgaatatcagtcgacgaaagccccagcagctcctgccgcttgccctcgagctcgagctcggcggtcacaatctggcgcaggtacggcagatattgtttaccgtcgcgcgtaagcgaaacgccctgctttccgcgctcgataagcatggtgcccagctcgcgctcgagcgccttgacggcctggctcaccgcactttgcgtatagcccaactcgtccgccgcgcctttaaggctgccgcggtcgaccaccatacaaacaatctgataccgcgatgccatcgtgcctccacatcaatgcagccgtaaaacgttttgccagcgcttttcgcgcctactttagcgtttcttaatcatactgaagatacattcgctttactacatcaacatctgagagcagaatcctttgtgcgaaaccgttctgtaacaaaaggagtcccatggatcgcaaaaaagcaatcgcgctctcattttccgttcccgtcgcatggggcttttcgtatcccctcatgaagatcggcatggacagcatgaacgccacgagcatcgtcgcgttgcgctgcatcatcgcctttgtggcctgtctgctgctcttccacaagcgcgcgttccgcatcaaccgcgaccttatggttcgtgccgctatcatcggcgccattatggcaaccgagctcacctgcatgtgcttgggctccagcctcacttctgcctccactgccggctttttgcagagcctgacggtcgtgatcgtgccgtttgccaacgccgccctgctgcgccgcgcccccgagcgcaaggtgctcatcggcacggctatcgtcacctgcggcatgctgctgctctcgggcgccgactttaccagcctgaatcccggcgcgatcatcatgctgctctcggcctttatctatgccagccacattatcgtggccaagcgctttgtcgaagaagtcgatccgctgtccctgggcgtttggcagctgggctttggcggcctgttctcgggcattgccgcatgcgtctttggcggtttcgcacttcccagtacgcccagcgagatcgtggtcgtcgttgccctcgcgctcatctgctctgcctacggctttatcacccagacgctcgtgcagccccacgtgcccgccgagaccaccggtttcgccttctcgctcgagccggtctgctccgccgtcttttcgttcttcctggtcggcgaggtcctgagccccatcgccttctttggcgccgccctcatcctcaccggcgtcatggtagcaaccgtcgagcttccgcgcctccgcgcacatggacaggctcgcatggcaggagcgcccgagcacgtctcgtagaccccactcttcatacagccgcggcataaaggcaaccggtgcgcctttacaatagatgccagcagagcatctgacgtaaaggagccccatggacgccgcgacccgcgaccgcaacatagcaacttggttgggcgatgcaccgcagccggtacgtgacactacgaaccagctgctcgagcgcatcgcccttttgcgtgccgagcagactatctacccagcacaagacgacatcctcaatgccctcgcctacacgccggccgaccaggtcaaggttgtcatcttgggtcaagacccctatcacggacccaaccaggcaatggggctgtcgttctcggtccccgcgacgcaaaccaagttgccaccgagcctgcgcaacatttacaaggaactcaaagccgatctgggttgtcccattcccgccacgggagacctaaccccatgggcacaacagggcgtcctgctcctcaacactacgctcaccgtgcgcgagcatgccgccaattcgcacgccaaactaggctggagcgcgctcaccgactacgttatcgagcgctgctgtcagctgccccaaccggtagtctttttggcatggggtcgctttgcccagcagatggtcgaaggtaagctcgtcgcaaccggtgcgggcaaggcaaccggcaagttctgcctggcctccacgcacccctcgccgctttcggccaaccgtgccacggcagaactccccgcctttatgggatcgcgtcccttctcggcagccaatcggctactcgaacagcacggctcgacccccgtcaactggacttgcctcggctaaaaatcgatacatcaaaaacgcgcccgacggctttctgaactgcctcccatttcttggacacgagaaatgggaggctttttatgcgtgtcggggcccgtgggttataccctaagagcaaaccaccctttttaagggtggttctgatttacccgaggggattgtacccgatgggaacgtattaagcgaagtaggctacgccgctctcaaagatcggcatgaatttgtcgccggggacatgctcgggcacgttgcagtacaggttgtcgccgcgacgctcggcatggcccatcttgcccaggacacggccgtcggggctcgtgatgccctcgatggcgagtgcggagccgttggggttgacggaaaggtccatgctgggtttgccgttctcgcccacgtactgcgtggcgacctggccgttggcgatcagctgggcgagcacttcgtcattggcgacaaagcggccctcgccgtggctgatggcgacggtataggggtcgtccaggctgcactgcgacagccacggggacaagttggacgagatgcgggtgcgcaccagacggctctggtggcgaccgatggtgttgaacgtcaacgtgggcgcatcgggcgtggcgtcgacgatgtcgccgtagggcaccaggccgagcttgatcagggcctggaagccgttgcagatgcccagcatcaggccatcgcgggccttgagcaggtcgcggactgcctcggtgacctcgggagcgcggaagaacgccgtgatgaacttggcagagccgtcgggctcgtcgccgcccgagaagccgccggggatcataacgatctggcttgcacggatgcggcgggcaagctcgtgggtgctctcggcgacggcctcgggcgtgaggttgttgatcacgaaggtgtcggcctcggcaccggcggcacggaaggcgcgggcgctgtcgtactcgcagttgttgccggggaacacggggatgatcacgcgcgggcgggcgatcttggcgccgccgtacacgtggatatccttggcgcggaagtcgatggtctcgacctcgggggtctcgccggcgctgcggtaggcgaagacgccctcgatgccgctctcccaggcctcctggagctcggcgagctcgatgacctcggagccggtgtcgatgacatagccctcgacggtggtgcccaggggctcgacgacaacgccgtcggcgacctcgggcagctcggcgtcctcggcgagctcgacgataaaactgccgtagagcggggtgaagaggctctccacgtctacatcctcggcaagctcgataccgatctggttaccgacgcacatcttaaagaggctctcggcgccgcagccgtagccgggcgtggatatggccagggcgttgccggtagcagtgagcgcctcgacggcgtcaaacgcggcgagcaactgctgggcgtcgggacggtagtcctcgccataggtggcgggggcgatgcggacgacgcggtgcgtgaggcccttgaactcgggcgagacggcgcgggcggccttgcccacggcgacggcgaagctgatcagggtcggcggaacgttgagctcgccggtctcgtcctcaaacgaaccgctcatggagtccttgccgccgatggcgccggcacccaggtcgacttgggccatgagggcgcccaggacggctgccgtgggcttgccccagcgctcggcctcggtgcgcagacgctcgaagtactcctggaaggagagataggcgcgcttgtgctcaaagccggcagccacgagcttggcgatggactcgaccacggacaggtaggcgcccgcaaactggtcggcctccatcagataggggttgaagccccatgccatggcactcgccgtggtggtctcgccgcccacggggaacttggcgaccatggccgagctgggggtgagctgcgtcttgccgccaaagggcatgagcacggtcgcggcgccgatggtggagtcgaagcgctcggaaaggcccttgttggaagcgacgttgaggtcggtgacgagcgaggtcatgcgctcggcgagcgtggtgccggcccagctgggctgccacacgctacgggcgcacacgtgggcgacctggtgcttgggtgcgccgttggagttgaggaactcgcgggacaggtcgacgatagcgacgccgttccaggccatgcgcatgcgcggctcagcggtaacctcggcgataacggtcgcctccaggttctcctcggcggcgtagcccatgaactcctcgacgtcaccgtcggcgacggcgcaggccatgcgctcctgggactcagagatagcgagctcggtgccgtccaggccgtcgtacttcttggtcacggtgtccaggtcgacatacaggccgtcggcaagctcgcccacggcgaccgagacgccgccggcgccaaagtcgttgcagcgcttgatcagacggcaggcgtcgccgcggcggaacagacgctgcagcttgcgctcgacaggggcgttgcccttctggacctcggcacccgaggtctcgatggactcggtgttctgggtcttggaggagccggtggcgccaccgatgccatcgcggccggtgcggccgcccagcaggatgatcttgtcggtgggggcggggcactcgcgacgaacgtggtttgccggggtagcgcccacgacggcgccaacctccatgcgcttggccacgtaaccggggtgatagagttcgttgacctgaccggtggcaaggccgatctggttgccgtagctggagtagccggcggcggcagtggtcacgagcttgcgctgcggcagcttgccctcgagcgtctcggaaaccgggacggtggggtcaccggcgccggtgacacgcatggcctggtacacgtagctgcggcccgagagcgggtcgcggatggcgccgcccacgcaggtggcggcaccgccgaagggctcgatctcggtcgggtggttgtgggtctcgttcttaaacaggaacagccagtcctggtcctcgccgtcgacatcgaccttcaccttgacggtgcaggcgttgatctcctcggactcgtcgacatcggtcatgacgccggtcttcttaaggtacttggcgccgatggtgcccatgtccatgaggcagacgggcttggcgtcgcggccgagttcgtggcgcatctccatgtagcggtcgaaggcttgctgcaccacggcgtcgtcgatcgtcacgtcgtccaggacggtgccgaaggtggtgtggcggcagtggtcggaccagtaggtgtcgatcacgcggatctcggtgatggtggggtcgcggtcctcatcgcggaagtactgctggcagaaggcgatgtctgcctcgtccatggcaaggccgcgatcggcgataaaggcggcaaggccggcctcgtcgagcttgcggaagccgtcgagcacctcgacgggctggggctcgggagtctccatgtacagcgtctcgggcaggtcgagcgaggcgatgcgcgcctcgacggggttcaccacgtagtgcttgatggcatcgctggcggcctcgtccagagcgcccgagatcatatagaccttggcggagcgcacggcggggcgctcgccctggctgatgagctgcacgcactcgctggcggagtcggcgcgctggtcaaactggccaggcaggaattcgacggcaaagacggcgccatcgcttgcggggagttcgtcgtaggtcacatcgacctggggctcgctaaagacggtcggcacgcaggagcggaaaagctcctcgtcgatgccctcgacgtcgtagcggttgatgatcctcagggcctcgatgcccttgatgccgagaatttcggtcagctcgcccttgagctgctgagcctcgacgtcgaacccgggtttcttctccacgtagatacgagagaccattggttcctgccttcctgatcggttgggcgtacggtacggtatgcggcagcggtcggtttacgggacaagcctcgcggtcgccttgagccacatgtttgtaaacctcactatgatacgacagctcgcggcgcgttgaggacggcgagggtgctacagtgaagcgcaaacaagagaaaggcatcacatggcattcgtttcgctcgccatcatcgcactcgtggcctttgcgagtccttttatcgcctcggcgattcccggaaaacccgttcccgagacggtctttttgctcgtgctcggcgcggtgctgggaccccatatgctcggcgtcatccatgtagatgccgaggtctcgcttgtgtccgagctgggcctggccttcttgttcctgcttgccggctttgagatcgaccccaagagcatcacgggcgtcgaggggcgctacggcttggcgacgtgggtcgtcacgtttggtatcgcctggcttgccgtacgctttaccccgtggttctcggtcagtcatttcgacggtatcgccgtgacgcttgccctcacttcgacggcgctcggtacgctcgtgcccatcatgcgtgagcgctcgctcaccggcacgcgcgtgggcgactcgattctcgcgtatggcacttggggtgagctcggccctgtgcttgccatgtcggtgctgctgtctgcccgcaccggcatccaaacgcttgtgatccttggcttgtttgcggtggtctgcgtgttgctggccgtggtcccgagccgctccaagcgcgtcggcagccgcttctttgcgtttgtcgaggaacgtgccgataccacgtcgcagaccttcgtgcgcctgacggtgctcatcctggtcacactcgtggcgttctcggctgtctttgatctcgacatcgtgttgggttcttttgccgccggctttgtcctgcgctacatcatccccgagggcaaccatacgctcgagaccaagctcgacggcctggcctacggctttttgattccggtattctttaccgtatcgggcgcaaagatcaatctgacggccgtggcgtcgcgcccgggtctgctcgtgggctttatcgtggcgttgttgattattcgtgccgttcccattctcatctctatgagcatttgtcctgcgacgcgcgatgtgtcggcgtatggtcgcattaccgtggccctgtactgcaccacggccctgccgatcatcgttgccgtgacaagcgttgccgtcaacgcgggcgcgctgtcgcaagatattgcgtcggtcatggttgccgccggtgccatcacggtgttcttgatgccgttgctcgcgcagctcttctaccgcgtggtcgacgccgcgccggtcgccgccgtggcagaagttgccgagcatccatccgatgcgctcgacatcctgcgcgcccatcacgatttggcgagcctgctcgcacgtgagcacgagctgctgacttcgcatggccatggtcgcgtattcgagggcttgcctacgctcgatacgattgccgagcgtctttccgccgaggcggcgagcggccatatcgatgcccgtattgtggacgcggcacatcttcttgccgataagacctatggagacgaggtcgacccgtccgagctgactccgcgcgagcgtcgccgcctggagcgcgccaagctcgccgtgcgcgaataccgccgccgcatgctggagctctatgcaagagaagaagccgaggacgacgacggcaagtagtcgatactctctcggggaagccgcgtcctgctttgaaggctcggaacgggatgtggtttccgaaacgggggccgttgggaaactgtgtcccggaatgggcgctcagagtgggatgcagtttccgcgagagacccgttgcggaaacggtatcccagaatcggcgttcaaaacggggcgctctttccgaaacatggccctgagggaagctgcgtcccggtctgagtcggaattccgggacacagcttccctttcaaacagaagaaggcgcgctgcctgcagttgatgcagacggcgcgccttctttgttggactatgttgaggctgggagctgaggcttgtggtcccttaagagcgggcggctccgtcgacggggagcacggcgcccgtgacataggaggacatgtcgctcgctaggaaaacgaaggcgttggcgacgtcctcgggctcgcccatgcggccgagcggaatggtggcgatgatgggcttgatgacctcttcgggaaggttggcgaccatatcggtcttggtcacgccgggagcgacagcgttgacgcgaatgcccatgggggcgagctcgcgcgagagcgactggaccataccgttgacggcgaacttggacgtgggatagccaacgccggagggctgaccgtacttggcgaccatcgagctcgtggtggtgatggtgccgccgtggcctgcctcggccataatcttggcagcggcttggtggccgttaaagacggcgacgacgttgaggtccatgaccttggcgaactcttcggccgtgtactccagaagcggcgagcgctgggagatgccggcgttgttaacgaccgtgtccaggccacccatgtcggcggctgcctcggtaaaggcctcggttacggcctcgagcgaggtgaggtcgcaggtgcggccccagaccttggcctcgggataggctgcggccagcttttcaacggcggcgtcggcagtctcctgacgcgagccaaagaccgtgacggcggcgccctcctcgataaagcgacaggcgatggcatagccgataccgcgcgtgcctccggtgatgattgctttcttgccctcgagcaacatggtgcttcctctcatcgcgggcggacattcgcagcacagcgtagcggtagccggaatcggtcgcgtctgcatatcggtgaacggtagcccgcgttaccgatgagcggttcgcgcaaatgtactctgccgttgtgcttggggcaggagacaaaagggctcccgtcccacatcggacgggagccctcaaagcgtgtattgctaggcaagcgttggattagttggccataacaccttcggtccaggcctcgacgtcctcgatacgcaggacgttggcgacctcggccacgcagtcgacactggcaagctcggcggcggcagcctggacgtccttctcgagtgcgcggtgcgtcaggaagatgaccgagcaggcatcgctgacgcccgacttgccgtcctcgacctggttgatgagcgagatcgagatgttgtgcttggcaaagatgtcgaccgtctcggacagggcgcccacgcggtcggcgaccttcagacgcacatagtacttggtctggagttcgtccatgggcttaaaggcgaggttgtgaccatagggctcaatctcgggaagcggagccacgccgcggctgatctgctcggagagcgacaggatatcgcccacgacggcgcttgcggtggggaaggagcctgcgccggcaccgtagaacatggtttcgcccacggcgtcacccaccacgtagacggcgttcatggcgccgttgaccttggcgagcatgtggtcggcggggatcagcgtgggatgcacgcggacgtcgacgccggcgtcggtgttgcgggcgatgccgagcagcttaatggtgtagccgagttcgcgtgcctgggcgatgtcctcggcgccgatggtacggatgccctgctggtatacgtcgtcggtggtcacacgggtgccaaagccgatggaggcgaggatcgccgttttgctggcggcgtcgaagccgtcgacgtcggcggacgggtcggcctcggcatagcccttggcctgcgcgtcggcgagcacgtcggcgtaatcggcaccctcggcgtccatgcgcgacaggatgtagttggtggtaccgttgagaataccggcgatggtcaggatcttgttgcccaccaggtcgtgctcaagcgtgctcacgatggggatgccgccgccgcagctggcctcgcacttaatctgcacgccgcacgcgcgtgccttctcggcaagcgtctcgacgtgacggcccagtagggctttgttggcagagacgacgtgcttgccgtgctcaaaggcagtggtgaagatctcggttgcgggatgctcaccgccgatcagctcgacgacgatgtcgacggcggggtcgctgacgacgtcgtgccagtcactcgtaaaggcctcgcgctcaatgcctgccgcctcggcctgctcccaagcaagcgcgcaggcgcgggtcagcttaaggtcgatgccgtaggctgccaggtactcatcgtggtggctcttgatcagacgggccacgccgccgccgacggttcccagaccgatcagaccgacgttcacggtgcgcaggggttcgctcatagatagctccttcgtgcatcttatggatggattaaccgcttaaaggttgagtgcattctagcgtgaaccgagggcgcgtgctcgccaggcaacaggagtcgcacaaaacggcacccccgaaacgctgcggaaacattggaaacatgctcgctacaaacggaactccgtaacaaactgtcaacgtttgcaccatgaggtttgccccgtaccgcaagacggccgcactgcggccagcgaagaggggggcaccatgcttagcatcaacaacgtacttaaccgcaggagtttccttgtcggagccacgcttatttttgccccgatctatttcaccccagcgtccgttttgctcaagaacgccaaggacatgagctacgacatgacactaatgggtgccgacggcatggacagcctatgtaatccaggacggcaagtacatctccgcctaagtgcatataacgagaccggtgaggccgttttattcagggcaagggcgcttgtaacagaacagaaacattactttcacataataaagtggctaaactgcataaactgatagaaatacgcataaaaatggataaatggacaaagcaaaagaaaagttgaaataatcgccacttttctcaactaaagcgtctactattttgcgaacgccgaacacggcgaaggatggcctgtcgggtaaccgaaacccgacgagatttgagaggagagccgcatgtcgagcctcaccggtaagtcattgaaccctgttatgaatcgcaggagcgttatcgcgagcgcagcaggtctgggggcgatgtccattctagctggctgctcctccaacggcggcgacagcggttccgcttcgagcgacgcttcgtttaagatcggcaccatcggcccgctgaccggcgccaacgcgtcctacggcaagtccgttacccagggtgtcgagcttggctgcaaggatttttcgaccaaggagctgccgcttgccagcaaggccgaggatgaccaggccgatggcgagaaggccgtcaacgccttcaacaccctgctcgactggggcatgcaggccctcgtcggcccgactaccacgggtgcgtcggttgccgttgccgcagagtgtggtaacgaccccaagacgttcatgatcaccccgtccgcgtcctccgaggacgtcaccgacggcaaggattgcgtcttccaggtttgcttcaccgaccccaaccagggtgtcaacgctgccaagttcctggcgcagaagtatgcggacgagaagttcgtgctgttctataactccggcgacgcctattcttcgggcatcgcagattcctttaaggcccaggccgctgagtccaagctcgagattgttgacgaggagacctttaaggacgactccgccacgagctttacgaaccagctgaccaaggccaagcaggccggcgccaccatgatctttgcgccgatctactacacgccggcgtccgtcctgctcaagaacgccaaggacatgggctacgacgtcaagatgatgggctgcgacggcatggacggcatcctgggcgttgagggcttcgatacctctcttgccgagggtctgctgctcatgaccccgttctccgccgacgacgagaagaacgccgacttcgtcaacgcttacaaggataagtacggcgatacccccgaccagtttgccgccgacgcctacgacggcgtgcacgcggtggccgaggccctcaaggaggccggtcttggtgtcgacgccgacccgaccgaggccgccgagaagctgtccaaggctatgctcaagattaccgttgacggtctgaccggcaagctcacctggaacgataagggccaggtccagaaggagcccacggcgtacgtcatcaccgacggcaagtacgtacaggcctaattggccgccttacatagagcggttttgatcccaagcaggggaggttttggccttccctgcttgcttggtatctagggacgatgtaacgtccctgtttcatacatcaactggaaacctattcgaaagggggatgtggaacatgacggtctttatccaatacctggtcaacggcctgtccatgggcagcgtctacgccatcatcgcgttgggctacaccatggtctacggtatcgccaagatgctgaacttcgctcacggcgacgttatcatggtcggtgcctatgtctcgttctgcgccacgtcgtatctcggcctcccgggctgggcatctgtagttctctcttgtgtggtctgtaccgttctcggtgttctcatcgagggtctggcatacaagccgctgcgtcaggcgggcccgctggccgttctgatcacggctatcggcgtgtcttacttcctgcagaacgccgcgcagcttctgtggggcgccacgcccaagaacttcacttcgctcgtcaccttccaggtgccggagttcttggccaagttcaacgtaagcgccgtctcgctcgtcaccatcgtcgcctgcctggttatcatggccggcctgatgttctttacaggtaagaccaagatgggtaaggccatgcgtgccgtgtccgaggacaaggccgccgctcagctcatgggcatcaacgtcaaccgcaccatctcgatgacgtttgccatcggctctgcccttgccgccatcgccggcgtgctgctgtgctcctactcgccggtgctgcagcctacgacgggcgccatgcctggcatcaaggccttcgacgccgccgtcttcggtggcatcggttccatccccggcgcctttgtcggtggcattctcatcggcatcatcgaggcgatggcgcaggcctacatttccacgagccttgccaactccatcgtctttggtgttttgatcatcgtcctgctcgtcaagcctgccggcctcttgggcaagtacgtccccgagaaggtgtaggtgagcgttatgaagtttcttaaagataagcagacgcgtcacgactttgttacgtatgccatgtgcatcgtggccttcgccatcgtgttctttatgcagtcgaaccacatgattccgcgcatgatcgccggtcagttggttcccattacggcctacatcgtcatggccatttccctcaaccttgtcgtcggcatcgcgggcgacctgtcgctgggccatgcgggctttatgagcgtcggcgcctatacgggaatcgtcaccgcggtcgccctcgagagcgccgttccctccgatccggtgcgccttgtcatcagcatcgtggtcggcgctatcgccgctgccgtcttgggcttcttgatcggtatcccggtcctgcgcctgagcggcgactatctggccatcgtgaccctggcttttggcgagatcatcaaagagatcgtcacttgccttatcgtgggtgtcgactcgcgcggcctgcacgtgatctttaacatcacgggcaactctacgatcgacgacctgcacctgctcgaggacggcaccgccatcatcaagggcgcccagggcgcctcgggcgtgtcgacgtactcgaccttcctcgccggtgccatcctggtcatggtcgcactcgtgatcgtgctcaacctggttcgcagccgtaccggccgtgccattatggccgtgcgcgataacaagattgcagccgagtccgtaggcatctccgtcaccgagtaccgcatgatcgccttcgtggtttccgctgccctcgccggtgctgccggagccctcttcggcggtaacttctcgcagctctccgccaccaagttcgacttcaacacgtccatcctcattctggtgttcgtggtcctgggcggtctgggcaatatgcgcggctccgtcatcgcggcggcgctgctcacggtgcttcccgagctgctccgtcagttctcggactaccgtatgctcatttacgctatcgtgctgatcctggtcatgatctttaccaacaacccgcagctcaaggcgttcttcgcacgcattaaggatcgctttgcttccaagaaggaggtggcagccgatgcccagtaaatttgagttcaagaagggcaagatggtcccgtatccttctggcgccatcgttcccgatcgtgacctgggcgagcgccctgcactcgagtgcatccacctgggcattgagttcggtggccttaaggcagtcgacgactttagcctgactatcggcaagaccgagatcgccggtctgatcggccccaacggtgccggtaagaccacggtcttcaacctgctcaccaaggtgtatcagcccacgcacggcaccatcctgctcgacggagaggatacctcgggcaagtcggtctatcaggtcaaccgcatgggtattgcccgtaccttccagaacattcgcctgttcaacaccatgacggtggaggataacgttaaggtcggtctgcataaccaggagcgttactccggctttgagggcgtgctgcgcctgccgacgtattggaagcacgagaaggccgcccacgagcgcgccatggagctgctgtccatctttgatatggagcatctggcaaacgagcaggccggatcgctgccttacggcgctcagcgtcgtctggagatcgtccgcgcgcttgccaccaaccccaaactgctgctgctcgacgagcctgccgccggcatgaacccgtccgagaccgcggaactcatggagaacatcgttaagattcgcgacacctttggtatcgccatcatgcttatcgagcacgacatgtcgctcgtcatgaatatttgcgagggtatctgcgtgctcaactttggtaaggtcatcgccaagggcacggcagaggaaatccagaacaacgacgccgttatcgaggcatatctgggcaagcaggataagggggagaactaaatggcagagccgatgctttccgtctacaacatcaacgtctggtacggcgccatccacgccatcaaggacatctcctttaacgtcaacgagggcgagatcgtggctctgatcggtgcgaacggtgccggcaagtccacaacgctcaagaccgtctcgggcctgctgcgctccaagaccggctccatcaagtttatgggcgaggacattactcatacgcccgccgataagctggttggtaagggcctggcccaggtgcccgagggccgtcgcgcctttttgcagatgacggtcgaggagaacctggagatgggcgcctacacgcagcccaagtccacggttgctccgggccttgagcgcgtctacgagcagttcccgcgcctgaaggagcgccgtcgccaggtcgccggcaccctttcgggcggcgagcagcagatgctcgttatgggccgcgcccttatgagtaatcccaagctgctcatgctcgacgaaccttccatgggtctggcaccgattctgatcgaacagatcttccagattgtcgaggacctgcacaaggccggcaccacggtgcttctggtcgagcaaaacgcgcagatggcgctttccatcgccacacgcggttacgtgctcgagaccggcaagatcaccatgaccggcaccggccaagagctcctgcatgacgacaacgtccgcaaagcctacctcggaggctaacccacctaacaaaaggggcgctgactatctcagtcagcgcccctttttaagttgcggtgaaatagggactgaatacgggctccagaggccaaaagagtccctattccaccgcaacttcatggggatgtgtgacaatgcccgtcggaaaacatctgctgtctttgggggtctatctatgctgtacgagttttgtgccgagaactttgagcgtgtgccggcggctatcgatgccggtgctaagcgcatcgagttgtgcgacaaccttgccgtcggtggtaccacgccctcggccggcgttatcagcactacggtcagctatgctcacgagcatgacgcgcgagtgatgtgcatgattcgcccgcgtggcggtgactttcactacaaccaggacgagctgcgcatgatggagatggacttgggtcttgccgtgagcgccggcgttgaaggcctggtctttggctgctgcaagccctgtgccggcggctgggcgctcgacgagctcaccctcggcgccctcgtgatggctacgggctgcgcgaccgaggagtgcaagcgcggggccatcgatatcaccttccacatggcctttgaccagctctcgcccgaggctcagctggacgccattgacacactcgccgactgcggcatcacgcgcatcctgacgcatggtggtgctgccggaacgccgatcgaggacaacctggagcacctgtcgcgtcttgtcgagtatgcgggcgaccgcctgaccatccttcccggcggcggcatttctacggccaaccgcgataccgtggcggcggcattgagcgtctccgagctccatggcaccaagatcgtgccgctggaggcgtaacccgtggcgctggtatttgacgttcagcaggcgaacggtaagcccgacgacaaccggcgccctggcaccgcgtgtcccttttgcgataccgaggaacttgccgatatcatccggcgcgatggtgactgcatctggctcgagaataagttcaagaccctgcgcgccacccgtcaaaccgtgctgatcgagtcggccgatcacgatgccgacctggtgatctatgagccggatgaactccaccatgtgatgcggtttgccctgggttgctggcagcagatgatcgattcacagcagtatcgcagcgttctcatgtacaagaacaagggtccgctctcgggcggtagtctcgttcatccgcacatgcagattgtgggtttggagcaggaagacggctacacttcgctgacttctgccaatttcgaaggcatcaatgtctggcaacaggggagaatctcggtcaatatctcaaccgaaccgatcatggggttctttgagatcaacgtttcagccccgcagggaatcgccgccagcgatgacgcacgagaccaagccgaggcggatctctttgccgatgcgatccaggtagctctgcgctatatcctaaacgagcaccacggtggtcgcgcagagtcgtacaacttgttcttctatcacctgggcggtcggaccattgccaaggcgctgccgcgttgggtggtttcgccctactttgtcggctatcgtttggcccaagtcaatgccgagacgacgctcgatatcgatgctgagcgtctgcgtgcgcatctggaaacgctcgtatagcaagactaacacccgcgtaatgcggacagcctagcgcgccatggcgtcgcggccggcttcgacccgcttgcgctgtttggtgcgctcctcgcaggttaggcactcaaagagatgcccgataatcgaggccagcacctgctgaaacagcgtgccgcacatggcggggaacacgacctcgcccggaaagtactgcgtggcgatgacggcacccgaagagatgttgcgcatgccgcaggtaaagcacatggtagtcgtctcgctatatggcagatgcagcgcacgtgcgaccagaaaaccgacgacaaagccgctgatggcgaagaccaaaataaagagggcgacttccaggcgcaccgcgtttatgtgcagcacgtactcgctcatagcggtggagttggacgcgatgacgcccatcatcatgaacttgcaggcgggcgagagcacgggagagagtttctcgtggccccagccgcgcgtgagttcattgatggcaataccgagcacagcggggatggcgatcataaaggccatgttctgcatcatgctcggcacgtcgatcgagacggtggcgcccagcaggagcttgagcgtaagcggaatcgtcacaggtgagatgaccgaggacgtcaggatgatggtgagcgcgagcgggccgttgccgccgaacatgctgatccacataaaagcggtgacggccacgggcacgctgtattcgagcacaatgccgcagacaaggttggggttggagccaaagaagagtgaccccatggcatacgccgcgatgggaataagcaccgccgagacgagcagcgccaagactaggtgcaacggacggcggaacacctcggttacctggtgaaaggtgttgctgagcgcaccctgaaacgtcataaaggcaaacaaggtgggaacgatgggcttgagtacgccaatctgttggggaaagagcacgccgagtgccacgcaaatcggaacgatgacctgcatgtgccccgcgagaaacttgcccagtccaacccattgcttcatatgcgcttgtgactccctttgcccgtgaacccgttttgaatggatatgctagacgctcgcatgcgtccgtgcgtcagaaacgctcgaatatttcgaggctattaccggcatcgtttaccgaaaccgcggcgtgctgcggcgatttgcgtctgctctgcacggtataataaatccgttcaacagatctgcctgccgaagcgggcatacacagaggactcatcgctatgaaccgtgagaggtatcgcggcgacctgcccctatcgggggtgggcgcctatgtcatcgcttaagacgacgcatcgctgggcggtcgctcagcaaaaccccgagctcgaaaaggagctttcggctggcctgggcattcccgggctggtggcgcgtattatggtcgcgcacggcattacatccatcgaagaaggtcagctgtttttgacgccttcgctcgatcgcgactgggccgacccactcattatcccgggcatgtcggtcgttgccgaccgcgtcgagcgtgctatttgcagccacgagcacattgcggtctttggcgattttgacgttgacggtattacgtcgacctgcctgttgaccgaggcactgcgcacgtttggcgccgatgtcacgccgtttattccgcatcgctttgacgagggctacggcctgtcgcgcgcggcgctcgaccgcgtcaacgagctcgctcgccctcagctgatcgtgaccgtcgataacggtattgccgccaaggaagaagtctcctatctggagagcctggggatcgatttggtggtcacggaccatcacgagccctccgaccaggtgccgcagggcgtgcccctgaccgaccccaagctcgaggacgagggcccctcgcgcgagcttgccggtgccggcgtggcgctcaagctggtgcaggtcctgggcgagcgtttgggcaagccgtcgtattggcgttcgctgatcgaggtcgcggcgctgggcaccgtgtccgacatgatgccgctcacgcccgagaatcgcgcactggtcgccgagggcatccagcagatgcgcgtgacggcccgtcccggctatatcgcgcttgccgcacttgccaaggccgacctttctaccattacggccgacggcctgtcgttttcgctcatccctcgtctgaatgctgccggccgcatggctgatcccaagctggcgctcgacctgctgcttgcccgtgatcctatcgaagcaagtgcactggcagccgagctcgaggaaatcaatcgccaacgccgtgagatcgaggcggagctcacgcgcgatgccatggcgaaggtcgaggagacttatgacggcgggcgcgcaatcgtcgtgggcggcgagggctggcacgagggcgtcaaaggcatcgtggcgagccgcttgaccaatcgctatcacgtgccggcgctgctgttctcgatcgaggacggtatcgcgcgcggctctggtcgctcggtgggcaaagttaacctgtttgacgccgtcgagcgttgttccgacctgctgattcgtcgcggcggacatgccggtgcggtgggtgtgaccatcgaggcatccaagctcgatgagttccgccgccgcctttccgccgtgctatcggagctttccgccgaggactttgaagacaccgacgaggtcgccgccaccgtcgacctttccgagctgaatatcgagaccatcgagcagatctcccgtcttgagccgtttggccagggcaacaaggtgccgctgctggctgccgagggcgtgacgatgtgcgaccgcgccgtggtgggcaaaaccggcgagcacatgcgctttgtggcgaccgatggcgccgcgagtgtgccggccattatgttccgcgtgccgcaaatcgataagctcatcaactgcgatagcgctgtcgacttggtgttcgaggccgttgccgagcattggcaggggcgtgtgaagcccaagctcatgatcaaggatgttctggttcgcgataccacgctgcccagcgtcgatgatccggcatgcgagcttcgtcgtggcgtgcagccggcggattccggcctgcgcctggagtcgcgtaagcgcgagacgctcgcccagctttcctataccgagctcacgcgctcgcttatccatagctttatcggatcgaaccagccgcaccgcgcgcaggttgaggcgctcgatgccttggccgaccaccagagcgtcttggccgttatgggaacgggccgcggcaagtctctcatcttccatgtacatgctgcgcgcgaggctgtccttcgcggacgtgcgagcatctttgtctatccgctgcgcgcgcttgttgccgaccaggcctatcacctctcgtcgacgatggcagcgcttggcattggcgttggcgtgctgaccggcgagaccgtggaggccgcacgcgatgatgtgttcgccggcctagcttcgggccgcaccggtatcgtgctcacgacgcccgagttcctatctatccaccgtgaccgcttcgcgcgttcgggccgcatcggctttgtcgttatcgatgaggcgcaccacgccggccttgccaagggcggcgaccgcagcgcctatctcgacatgcccgatatcctcaaagccctgggcgacccggttgttatggctgcgacggccaccgcgacggctccggtcgtggccgagcttgcccgcatgctgccgattactcgcacggtggtcgacgagacggtgcgcgagaacctgcagctcgaggacgaccgcgaccttgcgagccgcgagaaccgtttggtgtcgatcgtggcgacgggggagaagaccgtcatttacgtcaattcgcgcgaccagtccgtggcgctcgccaagacgttgcgcaagcgtgtgcccgattgcgcaacccatatcgcgttctataacgcggggcttgcgcgctccgatcgccgccgcgtggaggaagcattccgagacggaagcctcagctgcatcgtctcgacctctgcctttggcgagggtgtcaatctgcccgatatccgccatgtcgtgctgtaccacatgccgtttggcgccattgagttcaaccagatgagcgggcgtgccggtcgtgacggacagcccgccgtgatccacctgctctattcgtcgcgcgacgcccgcatcaacgagcgcctgctcgactgctacgcacccgagcgcgacgaactcgtcacactctatcgtgcgttgcagaccatgtggcgctccaaccgcggtaagaccggggatgattcattctgcgcaagcgatatcgacatcgcgcagatgtgccttgccatcgatgctcgcacgccggtcgacgagcgctcggtggaaagtggcctgggaatcttcgaagagcttggtttctgtcgcgtttcggggtttgacgacacccgtcgcatcgcgatggccgaaaaccccggccgtgtgcaattgagcaggtcaattcgctatttggagggcttgcgctcgcgcatggagttctcggctttccggagttgggcgctcgattcgtgcgcttctgatatgctagccaaagttaaccgcccgatcgtaccgcgggcctaggggaaggggacctcgatggatgccgcagcccgtaccgcccatgattccaccctccagccgttctcggagatggagcactataagcatgccgatgagctgccgcccgagattatggcggacagctacgacaaactggagcgcctgtgcctcaaatatatgaatgaggacgacttttctaaggtggagcaggcctattgctttgctgccgagaagcactgcaaccaaaagcgccgctcgggtgagatgtacatcaaccatcccgtcgaggtggccatcattttggccgatctcaagatggactgcgatgtagtgtgcgccgcgctgctgcacgataccgtcgaggataccgagacctcgcttgccgatgtttccggcctgtttggcgatacggtggccgagctcgtcgatggcgtgaccaagctcaccaacatcgaagtcgacagtatggacgagaaacaggcgctcacgctgcgaaagatgttcctcgccatgtccaaggacatccgcgtcatcatcgttaagcttgccgaccgtctgcacaacatgcgcacccttgcagccctgcgtgaggaccgtcgcctgtttaaggctcgcgagaccatggacgtgtatgcgcccctggccgaccgtctgggcatgagctccattaaatgggagctcgaggacctgtccttcttctacctggagcccgatgcctaccagcgcatcgcacgcatggtggcggagtcgcgcgaggtccgtgagcgctatctggccgagaccatcaagacgctcaccgacgagctcaaccgcattggcctggaagacttccagatcaacggccgttccaagcactattggtccatctaccaaaagatgaagcgcaagggcaaggaattctccgagatctacgacctggtggcactgcgcgtcatcacgcattcggtgcgcgattgctactccacgctcggcgcggtgcacacgctgtggcaccccatgcccggccgctttaaagactatatcgccatgcccaaggtcaataactaccagtcgctccacacgacggtcatcggccccacggctcgcccgctcgagattcagattcgaacctatgagatgcatgagcaggccgagtacggcattgccgcccactggctctataagaagtcgggcggatcgtctgcttccaagaccaatgacgctcaacgtttggacgaccagatcaactggctcaagcattcgctcgattgggcggcttccgacgagatcaccgatgccaaggaatacctgcattcgctgaaggtcgacctcttcgatcaggagatctttgtctttacgcccaagggcgaggtcatggcgcttcgtgccggctccacgccgctcgactttgcctacgccgttcacaccgaggtgggaaaccattgcgtcggcgccaaaatcaacggtgcggtggctccgctcacgcacgagattaagacgggtgaccgtgtcgagattctgactaacaagagttccaagccgtcgcgtgattggctcaagatcgttaagacaccttccgccaagtcaaagatccgccgctattttgccgctgcgaccaaggacgacgacgctgctgctggtcgcgatatgctggctaaggacctgcgtaagcgtggctatggcatttctacgccgcgttcgacgcgtgcgctcaacgccgtggcggagcagtttaacttcaagcagctcgaggacttgtttgccgccgtcggcgccggcaaggttgccccgcgcgctgtgggcaataaggtcgagcaaatcttggaccccaagcccgaggaacagctcaccaaggccgaggctatcgccgaggtcgtgaagcagcctgctcgcggctccaaccgcaagccgcaaaagcgcggcaagagcgccagtaacggcattatcgtcaagggcgagagcaacagcggcctactggtccgtctggctcattgctgcaaccccgtgacgggcgacgacatcgtcggcttcatcacgcgcggtcgtggcgtttcggtgcatcgcgccaactgtcccaacgtcaagggtcttatggagcatcccgagcgcatgatcgaagtggagtgggacggcgctgccgacaccctcttccaggtcgagatcgtggtcgagtgcctggaccgcatgggcctgctcaaggatgtcaccattgccattggcgatgcgggcggcaatatcctttctgccgccacgtcgaccaaccgcgagggtattgcaaccctgcgctttatggtcgagatctcggacgcgagtggtctggatccgctgctggcctccatcagcagcgttgactcggtctacgacgcacgccgcctgatgcccggtgagggtggagcccagcttaagcgccgcgtttagtcgcgacgaacgtgtcacattatcgatattcgctacactcgaggcatcgtttgatgcctcgagttctatagagaggagagggacatgagtgctgtgtccttggatgtaactcccaagggatcggtcgagatcgagacgctcgtaaacggtcccattcagaccaatagctatgctgttatttcggacaatgagtgcgtgattatcgatcccgcatgggaaggcgaacgcctggtggagcatattcgagccgagcatcccggcgtacgcgtgtttggcgccgtatgcactcatggccatgccgatcatgttggtggtgttgcaggcgtgcgaaccaccgttggcgagggctgccagtatgagctgtgtgctaaggatgtggcggtgccgcatgcgaacatcgaggaacagcgagctatgtggggcattgagacgcctgaccccggggagccgacgcacctgctcgccgagggagatgctatcaaggtgggcgatatctacctgcaggtgatcgagacgccagggcatacgccgggcgggatcgtcttgtttgctgccaccgagcaggggaacattgcctttgtgggcgacaccctgtttccgggtgggcacggccgcaccgatctttctggaggagacgaggcggcgattctgcgctcgctctccaagctcgcccggcttctcccgcccgataccgtttgcctaaccggtcatggcgattcgaccaccatggcacgcgagctcatgcagaaccctttcatgcagatttagcttaatagtcggcttttgaagcacgagaagcgtccaaacgtcaagctatttttccccaacgggtcgatttcgtagggcaaacggtcaaaaaagtctgtttggacgatattcgtgaacaaacgaacgtttatgctcgggtgcgccgtggtaaaatctcaggcgttatcggagcaaccttacaggaggtttcttttatgctcgtcaacgcagcagacatgctcaagaaggccgaggccggcaagtacggtcttggtgccttcaacaccaacaacctcgagtggaccctggctattctccaggccgccgaggaggccaagtctccgctgatccttcagtgcaccgctggtgccgctaagtggatgggcggtttcaaggtctgcgccgacatggtcaaggctgccgtcgaggccacgggcgttaccgttcccgtcgcccttcacctcgatcacggttcttacgaggactgcttcaagtgcatcgaggccggcttcacgtccatcatgtatgacggctctcacgaggagaccttccagcttaacctcgaccgcaccaaggagctcgttgagcttgcccactccaagggcatgtccatcgaggccgaggtcggcggcatcggcggcaccgaggacggcgtgacctccagcggcgagctcgctgatcctgctgagtgcaagcagatcgctgacctgggtgtcgacttcctcgcctgcggcatcggcaacatccacggcgtgtaccccgccgactgggctggtctttccttcgagcgtctgggcgagattaaggcccagaccggtgacctgcccctcgttctgcacggtggcaccggcatccccgaggatcagatcaagaaggccatctccctgggcatctccaagatcaacgtcaacaccgacctgcagctcgtcttcgccaagggcgtccgcgagtacatcgaggctggcaaggatcagcagggcaagggctttgacccccgcaagctcctcaagcctggtcgcgacaacatcgttgcccgcaccaaggagctcatggaggagtttggctccgtcaacaaggcgtaagcgtcgctaaacttcccgccggaagccccgtccccctacactgtttcctttgcgctcacctggctttgccagaagtcgcgccaagaaaacagctccgggggacggggcttccttcgtttaacgccgcagggttacgaggctgaattatttatttgactaccgttcagcggtgttgatggctcccttgttggggctttctttttatctcgctacaatgggcttcaagcgttctagtgacttggagttttggtatggctgttattaatgtgctgccttcggatgggaaggttattgacgagggtccagttggttgctctgctgatgtttgctgtgatgactttcgtcatctcgatgttggactgccgcccgagattcttcgtcttatggatgccgggtatttgacgcaggctgttgctgcctgcgatcgccttttggagcagaaccccgagccttcgctggctgcttgtgttcgtgccgagcggtatcgcatgctcgagacgccgcttcatttttcggtgtcgcgcgaccaggctattgcgatgattcgcgaggagtggccagagtttaccgaagagcagtttgatgaccttattaatcgtaagcgtattgactggcgctttatcgatggcgaactgttcgttctcgacaacttcctcgattcgcttcgcgtatatcccaaagaggttcccggcatgcggcccgattctacggacggaatagcactgcgcaacgagatgctcaaggagatggagtcgcaaaacgggttggctcgcgtcattacgcttaaagcgtccgtgtctgtccccggcgctctggaaggggagaccgtttgcgcttggcttcccgttgcggctgcctgccgtcagcagtctcgggtcgagattctcgatatgacgtcggggggtaccgttgcccctgaaaacgtttcggctcgcgctgcctcttggacatcttcgactgaacattcattctcggtgacctatcgctatcacgtcgatgccgcctattgcgatatctatggtggcgcgctcccatcgcatccctgtatggacgcgccactgcccgaggacacctccgaggaccgtccgcacattgcgttcacgccgtacatgcgacagttgacggagcgtgttattgacggtctcgagaatccgctcgatcgcgctcgtgctatctatgattacctgacacagcatattgactatcgctatcagccaccgtacctgcttttgggctccatcgccgatgactgtgcacactcgctccgcggcgattgcggcgttatggcgctcacgtttatcaccatgtgccgcatcgcgggcgtgcccgcccgctggcagagtggcctgtatgttgcgcctgattcggtggggccgcacgactgggcagagttctatacgccgcaaaccgggtggctcaacgccgacgtgtcatttggatcttctgctcgcaggatgggcgaggagtggcgccgccgtcactactttggcaatctcgatccgtggcgtatggtggccaacaatcgattccaggctgagtttgtgcctgctttcgacggcatgcgtgaggacccctatgacaaccagatgggcgaggcctcggttgacggacgtggatgtcgtaagcgggagatgttgcgcaaggttgagcttatcaaaatgctcgaagttccattttcggactaatcaacagaaagctgtgataaactaactcacgcattacgtgcccgagtggcggaattggcagacgctgtggactcaaaatccaccgttggcaacaacgtgcgagttcgagtctcgcctcgggcaccatacatgcaagtgagcgttcaagggggtcaaggccccctttttcgtgccgaactcgcgtgagcgcgcggagcgttaagcaaacaggcctgtggcctgtttgtagcggagcgtggcgagggcgccatgcgcccgaagcccggggcttcgcgaagcgaaggcccttcgagtctcgcctcgggcaccatacatgcacctgcgcttcaagggggtcaaggccccctttttcgtgtacgtaatgtgatagcgcgttgtacgtgttattattcgcaaggcgttgttcccgcaatgccctaaagaggaacccgagggctcccaccttttggcgccaatgagcagctgactggtcatacaacctagattcccttcctcataccgaggatgtctatgtgtacgacctggttgctgaaaagcgccgggttatttttttatgaatggaggtagggaaaatagctaagtctgatgacacccgcatcaacgacgagatcactgcatcttcgtgccgtttgattggcgtcgatggctctcagctcggcctgttcgccatccgcgatgcccagcgcgttgctgacgatcagggtctcgacctggtcgagatcgctcccaacgcggagccgccggtctgcaaggtcatggactacggtaagttcaagtaccagcaggccatgaaggctaaggccgctcgtaagaaccagtccaaggtcgaggtcaaggaaatgaagttccgacccaagatcgacgttggcgattacgagaccaagaagggccacgttctgcgtttcctcaagaagggcgcacgcgttaagattaccatcatgttccgcggccgtgagatggctcacccggagcagggtcttaacgttctcgagcgtctcgccgaggatctcaagccttacgctacggtcgagtccaagcctaagatggaaggccgtaacatgcttatgctgctcgccccgattaagggcgccttcgatgaggataaagcggcaagcgataccaagtaactagtgttctgtaaccgattaaggagtatttcatgcctaagatgaagtcccacagcggcaccaagaagcgtttccgcaagactggtaccggcaagcttatgcgcgccaaggctttcaagagccacatcctgagcaagaagtccaccaagcgtaagcgtggcttccgtcaggagaccgagatcgccgctgccgaccgcaaggtcatcaagtcgcgtctcgcctaagttcgcgttcccgtttttcgttttaccgtctaggagttgatagaacatggcacgtattaagcgcgctgttgccgccaagaagaagcgccgtaccgttatgcaccgtgcgaagggttactacggtgccgcttcgcgtacttacaagcatgctaaagagcaggtccagcactccctgcagtatcagtatcgtgatcgccgcaacaagaagcgcgagatccgctctctctggatcacccgcatcaacgctgccgctcgcctgaacgacatctcttactctcagttcatgcacggcctgaaggttgccggcatcgagctcgaccgtaaggtcctggctcagatggcttacgaggacatcgagtccttcaacgagctggctgccattgccaagaaggctctcgaggcctaatagattctgttgaatcgctaggggagtgtcgcactgtgcgcggcactccctctttttatctagagcgctggtttatatagcaaaagcgcgggtagatagacacttacaggtgaccgatctttatatatctcttaaccgaagggtcatcatctgatacgcgcagtatttctgcaccagcctttctattacttatataggaagcgataagttgtgtaggacttgtgaagagtggaattgacgtcccacatcgcttcgcggtctggcaatatatctccttgccgcgcggcccggtcgaaccggatgagccgcaaggcgtgcaccttgagaaccggatactgcgaggatggacacattcagtgtcgcatccgggcagacatcgaaccatttgaaatggtctaacttggatttgttgggcccgtgggttataccctaagagcaaaccaccctttttaagggtggttctgatttatctgacggtttaaaacggtctcacgtgttacagattgagacgttatatctggacagtcacgccatcccaattacatccccgttagcagcacgatgtcgagaatcgtcacgatgacgccgatccctacgagcagcgcgttgagcgggcgcgagttggcgtatttgcccataacgcggggcgaactggtgagtcgtatgagcacaaagaccgtaatcggcaactgaagcgacagcagcgcctgactccagatgagaccctcaaaaggattcgggacgaccaagcacgccgccactgcgccgacgaaacaagccgccaccccgatcgaggaatgtcggtcgtggatgtcgtattcctcgtcgaacatgcccgcggtgatggttcccgccgccatgcccgctgtcacgctgctcgatagtcccgcgaacagcagcgctaccgcaaagatggtcgagctcgccgggcccaagatgggggagagcgtggccgctgcgacggcgaggtcgtctacgacaatgccgtgcgcaaagaaggtcgttgcggccaggatgaccatggccgagttgattgcccagcccacgcccatcgaaaagagcgtgtcgaagagctcatagcgcagacgctcttcgataacctgctcgccttggccttcgaagtgcatggattggatgacctcggagtgcagaaaaaggttgtggggcataacgaccgcacccaggacactcacgataatcgcggcagagccagtgggcatgctgggcgtgatccagcttgcggcggcttgcggccagtcgaccttgactagcgcaagctcggccaaaaacgagagtcctaccacgccgacgaaggcgatgatccagcgctcggcacgcttgtaggagttcgtcatgagcattgccatcgatgccgcggccacgatgacgcagccggcgcgcacgggcagtccaaagagcatctggagcgcgatcgcgccgcccaggacctcggccatagcggtggcgatggtcgcgaggtaggcactggcgagcaccgtgcgtccaacgaaacgggggaggtagcgcgtcgtggcttcggcaagacaggcgcccgttgcgatacccaggtgtgcagcgttgtgctgcaacacgatgagcataatcgtggacagcgtgaccacccacagcagcgcgtagccaaattgtgagcccgcggccatatttgaggcccagttgcccggatcgataaagccgacggtcacgagcagcccggggccgatatgccgcgcaatgtctaggcctccgtgaccaccggtgcgtcgggagccaaagtgttgtttgagatggttgagcatggtgcgctcctgcgtgccgtttgtttgacgccgcaaaggatacccgttttaggctaaaaagttaaccaagactaacaagattgttgtatttgaataggatggtggaaggggattgctgaaatgtcttgatctgtaacaaccagggatggaaattgggcctaggtgttacaggtcaagacaggaagaaatggtcctatggaatatctcgatctgtaacagctgaccgccaaaaccggcccttcgtgttacagatcgagacaaaccaaaactgtcctgcagaaaatctcaatctgtaacatctaggcgccaaaattgggtcttcctgttacggattgagatgtttgaagcggtgagcatacgggccgaactcggggcccttgtcgtcgtccttgaggtcggcggtgtccactcgtagggcgtgcgttacgcgattgtttcgaaacgggcgggaaacacaacgggccggcgatgcacctagtatgcctagtcaactgactgtctaatagctaggggaggatcgcgatgcaggcagattccgctcaacagcagggcctttatcgccccgaattcgaccacgatgcatgcggcatcggcgcgcttgccgatatcaacggcgagcgccatcaccagattctggacgatgcgctgtccattctggtcaacttggagcaccgcggcggcaccggactcgagaagaacaccggcgacggcgccggaatcctgttccaggttccgcatcactttttccgcaaagaggctcaaaagtgcggccagattctgccggcagagggcgactatggcgtggccatgctgttcttcccgcaggacgacaagggcgtagaggatgcccgtcgcgtgtttgaggagggctgcgccgaggccggcgtgccgctgctcttttggcgtgaggtgcccgtcgacccgcacgacctgggcgagacggcccgcgcctgcatgcctactatcctgcaggctttcctgggccgtccggacgacacgctcgccggcgatgcctttgagcgtcgcctgtacgtgtgccgccgcaccatcgaaaagaaggccagcgctgagttcgccctgcgcgacaagatcttctatgtgtgctccatgagctcgcgcaccatcgtgtacaagggcatgcttgttgccacgcagatgcgccgcttcttcatcgacctcaacgacgccgccgtcaaaacggccgtggcactcgtccactcgcgctactccaccaacactacgcccagctgggagcgcgcacaccccaaccgctttatcatccacaacggcgagatcaacaccctcaagggcaacgtcaactggattcgcgctcgcgaacccaacctgtacagccccgtgctgcagcacgatcttgagcgcgtgatgcccatcatcaaccgcgagggttccgactccgcgattctggacaatgtgcttgagttcctggtcatgaacggtcgcccgctcacgcgtgccgcgtccatgttgttgcccgagccgtgggaccacaacgacagcctgagcgaggaacgccgcgcctacgacgcctaccagtccatgctcatggagccctgggacggcccggccgccatcgcctttaccgacggtcgcacgctgggtgccgccctcgaccgcaacggcctgcgccccgcccgctactacgtgacgcgcgacggccgctttatgctggcgagcgaggtgggcaccatcgaggtgagccccgagaacatcctgacgagcggctgtctgggaccgggccagatgctcgaggtcgattttgcccgcggccgcgtgatctacaacgacgagctgcgcgcccgctatgccaaggaaaaaccctaccgcgactggattgccgaggagacgctgaccgttgacgcgctcgatgagcccgtcgcgcccacgcccgccgaggataccgaggtgcccgccgccgtgcgcatggccaagctcgggtatcactgggatgatgttgacgaagtcgtgcgtcccatggcccaacagggcaaggcgccgctcgcctcgatgggtatcgatgcgccgctggcctgcctgtccaagaagacgcgctcattcttcgactacttctatcagctgttcgctcaggtcacgaacccgccgatcgacgccctgcgcgagcatatggtcacttcgaccacgctctacctgggcaaccacggtaacctgctcgaggactcccgtacggcctgccagctggtgcgcctggagcgtccgctgctgagcgaggaggagttcgagcgtatctgcgccatcgaccgcgtgggctttaagacccgccgtttccgtgccgtctaccgccgcgatgccggcgagggtgcgctgcaggctgcgctcaagcagcttgcagaggacgttgaggccgcggttcgcgacggcgtgaacatcgtggtgttgagcgatcgcgccgctgcgggcgaggtgcccgtaccgtcgctgctcgccgtgggctgcgtgcacaaccacctgatccgcgccggcgtgcgtacctttgccgacatcgtggtggagtgtggcgacgccgtgtccccgcacgactttgcggcgctggtgggctactccgcgagcggcatctatccgtacaacgcgcatgcgtgcattcgcgacttggcgacgcacggcgatctggacgtgacagctgagcagggcatcgccaactacaacaaggctgcgaccgccggcatcgtctccatcatgtccaagatgggcatctccacggtgcagagctaccactccgcgcagatcttcgaggccgtgggcttcactccggagttcgtcaacgcgtacttcgccggcacggtgagccgtgtgggcggtatgggtgtcgaggacgtcgagcgcgagcagaatgagcgctacgacgccgcgctcgctatccttaagagcccggctcccgatcagctgcccacgttgggcctgaccaagtggcgcccgctcggcggcgaggatcacctcatcgatccgcagactgtctacttgctgcagaccgcctgctgtgaggacagctacgacacctttaaggagtacagcgcccgcctgcaccgcaccggccgtgctgtgcgcctgcgtgacctgctggactttaatgccagcggtcgcacgccggtttcgctcgacgaggtcgagcccgcgctcaacatcgtccgccgctttaacaccggcgccatgtcgtacggctccatcagcaaggaagcacacgagtgcatggccatcgccatgaaccgcctgcacggccgttccaactcgggcgagggcggcgaggacccgcgtcgcgagaccccgctggctaacggtgactccaagaactccgccatcaagcaggtggcaagcgcgcgctttggcgtgacgagccgctacctgtgcagcgccttcgagattcagatcaagatggcccagggcgccaagcccggcgagggcggtcacctgcccggcaagaaggtctacccttggattgccgaggtccgtcagtccacacccggtatcggcctgatctcgcctccgccgcaccacgacatctactccatcgaggacctggcggagcttatcttcgatcttaagaacgccaaccccggcgcacgcgtgtcggtcaagctggtcagcgaggccggcgttggcaccatcgccaccggtgtggccaagggtgccgccgacaagatcttgatcagcggccacaacggcggctccggtgctgcggcgcgcgattcgatctggcacgccggtctgccgctggagcttggccttgccgaggctcaacagacgttgctgcaaaacggcctgcgctcgcgcgtggtactcgaggccgacggcaagctcatggacggcaccgacgtcgccgtcgcctgcctgctgggtgccgaggagtttggctttgcgaccatgccgctcatctccatgggctgccttatgcagcgcgactgccagcaggatacctgcccggccggcatcgccacgcaaaactgccgcctgcgtcgcggcttccgcggcaagcccgagcacgtcgaacactttatgctctttgttgccgagcagctgcgcgaggtcatggcgagcctgggcttccgcaccgtcgacgagatggtcggccatcccgagtgcttgcgccagattgaggtcccgggcaaccgcaaggccaacctgctcgatctgtcgcccgtgctggcgagcgcgacctgcgagttcggtgcccacatcccgggtgccgacggtcgtcacttcctgccgcagatggctgcggacagtgagctcgacaagacgctcgactccacgttgtttgtgccctatacggccgatgcccgtgcgcacctgcgtccgattcgcttccgcgccgatatcgccaacgtcaaccgttgcgtgggcaccatcttgggcaacgcggtgaccaaggcgcatcccgagggtctgcccgccggctccatcaccatcgattgcgatggttcggccggtcagagctttggcgcctttctgccgcgcggcattacgctcaacgtgtgcggcgacgccaacgactactttggcaagggcctttcgggcggcgaggtgtcggtgcgccccaacccgcatgcgacctacaagttcgacgagaacatcatcgtgggcaacgttgcgttctttggcgctacgagtggccgcggcttcattaacggcctggccggccagcgctttggcgtacgcaactccggtgccacggtggtggtcgagggctgcggcaaccatggctgcgagtacatgacgggaggtctggcgctcatcctgggcgaggtcgggcagaacttcgccgccggcatgacgggcggcgtggcttacgtctttgaccagtacggcacgctcgatgcccgtgtgaaccacgagagcgttgagcttaaagccccgacggccggtgagcttgcgcagattcgtgcgctcatccaggagcacgtggacgcgacgcagagcccgcgcggtattaagctgctctacagctttgagacgatgagtaagcactttgtgaaggtcattccaaccgagtacgagcgcgtgctggcgattgtcgccgccgccgaggccgtgggcaagacgcatgcgcaggccgaggagctggcgtttgacattgtgaccggccgcgcgagtgccgcggatgtcgctcgcttagatgtggcgggtggtgtcgctggcgctgcgcccgccaccgccagctctgttgcttcgaccaagaaggaggcgtaagtgccatgggtaagcccggtgcttttcttgatatcgatcgcgtgacccatgagctgcgccccgtggaggagcgcagccgcgatttcgatccgctgtacgtggagctcgacgacgacgcgcgccgtgcccaggcgagtcgctgcatgatgtgcggtgtggcgttttgtcagatgggcgcgagctttggcaaggcacgtccgagcggctgtccgctgcacaacctgattcccgagtggaacgagctggtgtaccgcggccgttgggacgaggctgccgagcgcctgtcactcacctcgcccatgcccgagttcacgagtcgcgtgtgcccggcgctgtgcgaggccgcatgcaacctgggctcggtcgatggccagcccacgacgatccatgacaacgagcgcgcgattagcgaccatgagtgggcaaatggcggtccgcaccgctttgagccggcaggggagggtgcacccacggttgccgtggtgggctccggtcccgctggtctggtggcagcatgggagcttgcgcgtcgtggggcccgcgtgactgtgtttgagcgcgacgaccgcccgggcggtctgctcatgtacggcattcccaacatgaagctcgagaagtccgtggtcgagcgtcgcgtggcgctcatgcgcgagctgggcattgtgttcgagctgggtgctgacgttacgaaccctgcggtggcggccaagctcaatggctttgacgccgtcgtggtggctgccggtgctcgcgccccgcgtgggctggctgctgagaatattgacgcacccggcgtggtgtatgccgtggactacctgacggcctcgaccgtctcggtgctcgatggcggcgagcctgtcgtcgatgcacacggcctggacgttgtggtcattggcggcggcgataccggtaacgactgcgtgggcaccgcggtacgtcagggtgcgcgcagcgtgcgccagtttgagttcttgccggcggcgcctgatgcgcgcgcggcgagcaacccctggccgcagtggtccaacgtgaagaagaccgattatggccagcaggaagccatcgctgccatgggcggcgagatgcgcgcttggggtgtggatacgctcgaggtactgttggacaagaagggcgcggccgcgggcctgcgcgtggtcgatctggattggtcggctggcaagcccgagcgcatcgcgggctccgagcacgaggtgccggcccagctggtgctcatcgcctgcggctttacgggtcccgagcatggcgtgttcgacgccgttggcgtgcctgttgccaccgctggtcgtccgctgccggtgatggctgccgagggctcgcaccttgcggcccgtgtcgacggcgtcgccgcgggcgccacaccggtatacgtggccggcgatgctcgcaatggcagttcgctcgtggtaagcgccatggccgacgccctggcctgcgctgccgaagtcgccgaggcgctggagctgtaaagtagtcatttaagaacgtccccaatgactagtcattttttgtctagtcgttggggacactctttgcgagcgatttgctcgtttgtcgacgtacgggtgtttatttgtcgacttcttgggctgtggtcacctgttgtttctgtggtggctgtgggtatctggctcaaaagggcgggttggccgtctatgtttacctgcggttttgttgcggtgcgtattttcggtcaagcttttcgtcaagtgtttggtcagcatctggtttgcagccggaggcctattttgcccgcgctggtcgtggccgaccaccctcctcgtaagctcaaattgaggtctatcagtttgaggaggatgccatgactgaccacgctttagaccgagcgcagctagccgaagccgtcggcaacgatattgccgacatagcccatttttggatgctgcggaagttccagtttttggagccggcgcgcgaacagttcgagatcattgtcgacccgtggctcagctattgcaccgagccttcgcaaaacgaaatcatggcctacaacatggcgtttaccgattggctgctcttcgagcgctcctatcgccatggcaagacgctgctcgagctgtatgttgacgagccgccggcatcgctttcgcctgcctcgctcaagcggctcgagcaggtacgcgacacgcagtatttctcgcgctttggcattttggacaaggatcctgcgaacggcatagttgcgctgaaggatacgcgcaccgaccgtcgctttgatgtctacgacccgcatatcgtgcaaaaggagcattggagcgacggcgcgattgcggtgcgcctcgcttgcgtcgacgatgtctggctgacggcgggacagctctatctgtacgacatcgcgcgcctgagtgacacggcagtcgatgggccgggtgcggtgcatccggaggacctgcaggatggctttgacacctcgtgcatcagcttctttttgcgcctggtccgcgacatcatgggcgcccaggggcgctacgtaaagtccctcaacatctacgaacaagaatgggagtaggggatgtgactggtgtcgccctacagccctgactttgtctcaatctgtaacgtttagcggctgtttgagcccgtaactgttacagattgagacggaaggttggcggctgtcgaaagatcttgttctgtaacaactagaggctcaaagactgtcttcctgttacagatcaagacatttgtcagcggaggcaacggtgacgatggtccatttgtctgacgtggtggtgacgaaagtgtctaataccgttctcaaacacaaacatgcgactcgcaacacgttggcgcggaatagaatgctcgcgcggctcacggagacggccaagcaaggtgcgctgctcgcaacgcatgacaataccgagctcatgtggctgcgacgccatgttggaaccgacgatatcgcggagcccgagccgtacctgttctgttttcagcatgattgggatgcattgacgccggcggagcgagcgctgaggactatcaaagggcttgcggaatttcatcccgattgggcgttttggggctatgacgcggcgcttttgtggggtctggaggtgccgaatgatctgctcgggccgcgctttcttgttaagacgggttgttcggtgacgttgagcggcgggtgcaggttgttgcgtccgcagatggcgggcgtgctcgagcgtgttgatggcgtgcgggtgacgtcgttttggcgcacggtggaggattgcttactgcgtgcgccgttctcctacgggttggcgattgccgattctgcactgcgggcgaaaggcgtatcacgttgggatttgtgcgagcgcctccgcgccgattgcgagggcaggcgagggtatcgcagggcacaggtgattgcgtcgtatgcggacgggctgtccgaaaacggcggcgagtctcggttccgagcgttctttattgcgtacggctttccagttccggagctgcaggtggagtttcgcgacccgctcgattcgagccaggtgtttcgcgtcgactatttttggcggctcgagaacgggacgtgtgtcatcggcgagctcgacgggaagggaaagtataccctgcaggatggtggggatcgggggtcggtcgacccattcgtggcagaacgtcagcgagagtctcatctgacgatgctcgggcacaaggtgcttcggtttacgtttgatgaactcaagaacccggggaagctggctgaaaagatgagactggcgggaattcaacagcgggccgatctggctgaggaatggagacgccagtggtatgggcgctgagaggttttgtctcgatctgtaacgtttagaagttgtttgagttcgtaattgttacagatcgagacaaaccggtgaaacgtcgaccgaatgtcttgatctgtaacatcaaggggcccaataaccctgtacctgttacagatcgagacattcccctgatgttgctggggtggggctgcaacgtattccgtccccccacatcccctcttccctccgttaaccgatatgtccgcagcaatcctgccgcgctggataataatggacagatgttcaagttttctgagggggaggagctcgatatggcgtctgccgatcgttccacgttgtttatcaatgcgaccgtcctggatggctcgaaacatatggagccgcagcccgatatggccgtggccgttgagcgcggtgtcatcacgtggatggggccgagtgctgtggcgcaggcgcctacgggtgccgaggttatcgacctggcaggtgcgtatctcatgccaggcctcatcaatatgcatgtgcatctgtgcggttcgggcaagccggtttcggcgggcgatgcgggcgcgctgatgaagaagctcgataatcccgtggggcgcgccatcgtgcgccatattcttaagggcagcgcccaacaacaactggcaagtggcgtgaccacggtgcgcggcgcgggcgacccgctgtttgccgatcttgccgtgcgcgatgctatcgatgccggcaagtatcaaggtcctcgcctggtggcgccgggaacgggtgtcacggtgccgggcggccatggtgcgggtttgttcgcccaggtggccaacagtcccgccgaggcagccgaacaggtgcgcgacctgtatgcgcgcggtgccgacgtcatcaagctgttcgtgacgggcggcgtgttcgacgctaccgaggtgggcgagccgggtgtgctgcgtatgccggtcgaggttgccgcggcggcgtgcaaggcggcgcacgaggtgggcctgccggttatggctcatgtcgagagcaccgaaggcgtgaaggccgcgcttgaggccggcgtcgatacgatcgagcacggtgccccgatgactcccgagatcttggaactgtaccgcggcgccgcgggcacgcagctcgaggggcgtgcgcccagcgttacctgcactatcagcccggcgctgccgtttgtattgctcgacccggaaaagacccattcgaccgatacacaaaagaagaacggtgacatcgtgtgctcgggcatcatcgagagcgcccgtgccgcactggaagctggcgttaaggtgggccttggcacggactcgagctgcccgttcgtgacgcagtacgacatgtggcgtgaggtggcctattttgccaagtatgtcggcgtgggcaacgctttcgcgctgcatacggccacgcaggtcaatgccgagctgctggggctgggcggcgagaccggcacaatcgagtgcggcaaggccgccgatattctggtgacgcgcgagaacccgctcgatgacctgtgcgcactgcgtgatccgacgcacgtgatgtgtcgcggtgatctggtgcgcaagctcaaggtgaagcgtattcccgaggtggacgccgagctcgacgcgattatggccatgcctgccgaggcgttggccgaggagcttgcccgcgatggcgtggcgtaagcgcgcgatatggcgatgcgacaaagggacaatccttttgtcataatcagaaaaagccgaggtcccagtgcgaggcctcggcttttatttgtcccatagtatggcagctatgagcgcgtctccatcttggcatggcacttggggcaggtgacgcggatcttgcctttgcccttgggaacggagagcatctggccgcagttggggcacttaagataggccgtggtcttgcggcccttccacatcttcttggctgtgcgcttggcacgttcaaagtcttccttgctagtaccggctgcgcgcgaggcgttggccgctgcagctccgccgcccaagctagctacaaacttgcccaagccgggtacgtttgcagtcgcggcgacaaaggcctcgttctccttgtgacgtgcgtcgatatttttggacaggccgcgcagcacgccaatcacgattacggcgatggcaatccagctgagccactggatgcgggctatcgatccgatcatcgcgatgacgatgccggcaaaacccatcacgatggtgagttcatcggcaccattgcgacccttcataaagtcattcatgcaaattgcctttcgttcgatatgctgcacgcctttatacccgatttagagcaagggggacaggttaatctgcaccaatgtggtgcaaacgtacctgtccccaatgccccaattacttggagagtttgtcgacgacgcgttcgatttcggcgagcttggcggctttgaggtcttcgtcgcccgattcgattgccgaagtcacgcagccctcgatatgcgccttgagcacgtcggcgttaatgcgcgcgaggagcgcctgcgttgccatgagctgcgtggaaatatcgacgcagtaacggtcctcctcgaccatccgcaagatgccgtcgatctggccgcgtgccgtcttgagcatgcgggtcaccgatttatggtctgccatcatgtcgggtcctcgtttctggtcgatcttccggatgtccccgtcagttgcggtgaaatacggaccgtttaaaggcctagggcggcacaacagtccgtatttcaccgcaacttctgaggattgagtaggcagcgactgctatgcggcggtcaccgaaagtgcgtggaacttctcgccggcggcctcgacggcggcggcgagttgctcggcggttacggtgtcggcgcactccacctgtacggtctgagtctcgtgatcggcatcggcgtcggtcacgccggcaacgttgagcagcgcggtctcgacggtggcatcgcaatggccgcacatgaggccggaagtcttgatcgtgtaacgcatgggtattcctctctgttgtgtcggctttcccaggcacccgaccttgaccttcaaaccgtcgctcgcgtaccaaagtacgcgtcgctcctctttcaggtcaatctcaggtacctggaaaacccgttctaaatgaacgtaatagtgatcctattttgccactttaggcataaaggattttaagcgcagggcattggacacgacgcagacgctcgacaggctcatcgctgcggcgccaaacatcggcgagagctgccatccggtgagcgggaaaaatacgcccgccgccagcggaatgccgatgccgttgtagaacagcgcccagaacaggtcttgcttgatgttgcgaatcgtggcgcgcgaaagttcgatggcgcgggcgacgtccatgagatcgctgcgcatgagcaccacatctgccccctccttggcgatgtcggcgccggtgccgatagcaaggcccacgtcggcgcgcgccagggcgggggagtcgttgatgccgtcgcccaccatggcgaccttgccgcccgcatcctgcagctcgcgcacgtggcgctccttgtcggcggggaggacgtcggcgatgacctgctcgcggctcagccccacgcggcgggcgatggcctcggctgtcacacggttatcgccggtgagcatgcgcacgtcgacgccaagcgagcgcagtgcggcgatggctccggcgctcgtctccttgacctcgtcagccacggcaatggtgccggcaagctcgccgttcttggcaaagaacagcggcgtcttgcccttggcggcaaattgctcggcaaggcccgcgggcacggtaacgcctagctcgttcatcaggcgcacgttaccagcggcgatggtgttttgcccctcgcgtgccgtaacgcctcgcccgggcacggcggcaaagtcctcgacggcgcgcgcgacaatccctcgcgtctcgcactcggccataatcgcctcggccagcgggtgttcgcttgagcgctccagcgcggcggccagcttgagcagcgccttttcgctcatggcgggcgatccgtcggcgcgcgtggctaccacgatatcggtcacggcaggcttgccgcgggtgaccgttcccgtcttatcgagcaccacggtgcccacgctgcgcagattctccagcgcctcggcgctcttgaacagaatgcccatctcggcgcccttgccggtgccgaccataatagcgacgggcgtggccagacccaatgcgcacggacagctgatcaccagcacagcgacggcggaggtgagcgcttcgttgatgcttccggtcaaaaccatccatgccacaaaagtcacggccgagatcgcaaacactacgggcacgaacacgccggcgaccttgtcggccatacgggcgatgggcgccttggtggcgttggcgtcctcgacgagctggataatcttggcgagcgacgtgtcggcgcccacgcgtgtggcacggaaggtaaacgagccggtgcggttgacagtggcggcgttgacggtgtcgccggcggtcttttccacggggatggactcgccggtgagcgcgctctcgtccacggccgagctgccctcgagcaccacgccatcgacagggatggactcgccggggcgcacacgcaggacttggccgggaaggatggcgtcgacatctacggtggcctcgctgccgtcctctgccacgacggttgcggtcttgggcgccaggtcgatgagcgcctcgatggcgccgccggtcttggatttgctgcgtgtctcgaggtatttgcccacggtgacgagcgacaggatggtgccagcgctctcaaaatacaggttgtccatgctcgtcatcatggcctcgtgcacctggcctgcggctagctggtcggccatgatgaacatggcgtagagcgaccaggcgatggaggcggtggcgcccacggcaataagggcgtccatggtgggcgcgccgtgcgcgagcgatttaaacccgttgataaagtacgcgtcgttgacgtagacgatggggatgagcaggacgagctcggtgagcgcgagtgtcatgctgtgggtatggtcggtgaaaaaaccgggcagcggccagccgagcatgtgccccatgcctatgtagaacagtgggatgaggaatacgatcgagatgatgaggcgggtgcgcatggcggaggcggcggcctccaactttttggtcggtgactccatatgggcggcgccggacctggcttgcgcacttccgctttggacagcgtcggcgcccgtgctgatgagcgaggccgagtagcccgcgcggtcgacagcggtgcagatatcgtcgggggtgacctgcgcggggtcatagtccaccatcatggaaccggcgagcagattgaccgcgacgctttctacgccgtcgagcttgctcacggcacggtccacgtgcgcctggcaggcggcgcatgtcatgccgcccacgtcgaacttatcttgagccatggcttctcctttctgtagttcggtgttggaattgttaacctgccgatactatacacctataccccctgggggtgtccagtacagaaagaaatgtatgacatttcgttacagatgaggatggatggttggccgatggaccgtcccaaccaaccatctcaatctgtaacatctgaggaccgttttgcctgctagatgttacagattgagatgttgtctcgcggggttggggtttgtctcgttctgtaacatctagacctgtatctgccgagctagtgttacagatcaagacaattgacggggaggggtcccgtcatggcaagacgcccgccgcctagatacagaatccggggatcacacaggttagcttgtttggcttttccgcaggcgttgcgtacgtaaagacgtcgccggcgtgccccacgcggttcatatagagcgtgccttcgctctccgatgtgtcggggctcaccgtgcgatcccaccaacaggtgtccttgcctttccactggcgaaccaacgtctcgttcgtggtatacggacttaccttgagctcgcggaacagctggtactccttgccttcgccgttgtagatgtcggccaggtagtgaaagccctcggcaaatgactcgggcggctgcactccgcacagctcgaccatggcgggcagccaaagggttgcgggcaactcgctcagacacgatgcgcttctggcagcgccaacgttattcgagatctttttgacagatttaatgagtgcgcgcaactcgttgggcagcagcttaaggccgtcgccgtcgagccattcccgcagctcgcaatctgcccagccggcgctcaacggttgggccgtggcatcgcgctcggcaatgccggcatcgaacataaacgtcaatccggccttgcccgtcccgtccagaagctcatcgtggcggatgcccacaagctgcgcgccaacctgcagcccgttggtgagcgtgacacgtttggtacacggataggggatatgcccatcggcatcgagcaggtgatagcgcttggcaatctcgcgtgcctcgctacgggtctcggcggccttaatcttgagcgaaatctcctgcagctgatcccaggtgtagtcgtcaagcgaaccgcggatgccatccaggtagtcggggatgccaaagccatgggtcgccgccccaatgacgctgagccacgcaacggctgcaacgacgccaccgataataaaccggcggcgggtcatggcatcgtgccgggcctgctccaggatctctctcgcgcgctcgccggcgacgtcgaccttaaggtgtgtaccggagtcgatgtcgattgcggcatcactgcccgcgccttcgcggccctcggattcggcatcggtgaggtatgccgagagcacctcgagcatctgctgctcggtgggacgatcgcactgctcgactgagagacccttcatgatgattttgacgagcgcttcatcgccctcgcagcgcggctcgagcggtgcaggcttggtcttggtctttacgagatagaacgagccggttgcagcggcgtccgtcgactcaaagtcaaacggtttgcgaccgctgtagagctggtacagaatgctcgaaagcgcatagacgtcgattgccggcgaacggcgaagagccgcgatgccttcgatatcctgcgtgagcatctcgggcgcggcgtatgcgggcgtggcaaagcgccagatgtcggcgcgccgggtgatcgtgtcgtcgccgagagccatggtcgcggagcccatgtcgatgaggcaggggtcaaaggagcaatcggcaatctgctgctcgagcgttcggctggtggtgcggaacatgatattggcaggcgaaaggtcgcgatggacgaccggattcacgaggccttgggtcatcaagagcgcacgaagcacggcgtttccgacggcggcgaccatctgggtggtcagcccgcccgaggcgtcgtgaggaagcaggggcagcgcctgcttgagtgaggtgccctcgacccactccatgaggatgagcgggtcgtcctcgcacgatccgtagccatagacgcgcggaaatccgcgcaggtgcgagacggtgcacagatgacggtactcctcgaacagcgcggcggtgttggccaggtgagcggccgattgctcggcggagcggtcgggggcttggccggaaaggacggcgttgtccttgagtagcttgacggcaaagacctcgccgctcgtgttggtcgcgcgcagcacgtgcccgatgttgccgttgttgcggtgggccgtctggagaataagcgtcataaaccgacgcttggcgtcgtcctcggcgctggggtcgaccgccacggcggcgtcgaacgtgtcaagacggatgagtttgtcgccataggcgctatcggtagtatccatggcgttcctttgtctggcatgggttgccgtgcgtatacgtgagcagtgcggatatcggtaaagtaccatgatagccgcactgctcacgtataccgctgagtattgtcgtttacgacgcagaaggtagaagacgaaagacggacggcgaccgtcttccgatcgccgtccgcgctagtccacaatgacaaggaatgtcgtgtagagacccagatggagcctgtcgctgttggcgatttccacggggggatagactttgccgggctcgcgttggtcgcgcggcggctcaatcacaatatcgccgtcgcccgcgcccgattcgagcactgtgccgttggtcgatccaaggccctgggcgtaccagtgctcaccctcgagccaaatacgaagatgctcgcgcgaggcgtcggcgcctacatcggtgatgctgggcgaggttttgggcaaagaaccaatcacggtgccgcgcggatcgcgtgtgaggggatggatttgcatgtcggcgcagttgtcggcatgggttctgagcagaccgaggttgggggcgacggtgcgcggctgctccaggctgctcataaagccacgtccgacggtagtttcggtggtgccaaagtgcccgcccgtcttgctgtcgcaaaagcgctcgacggtggccacgccctgaacgggatcggcgagcgcccccgttgccacaaagagcataaggtaaagcgtgcttttctcgcgcacggcattgccgtcaaagttgtcgatgcgattgagggcatttgcatataggcggctgtccagcttgtagctggcgagagccgacatcatttcgttggcggccggaccgcgatagtgctcggcgattgcctgataggcggactcgccgccgccgagcttgctgcagattgccgcggaaaggttgagcgtggtgacggtaaagtcgctgtagatggcgggcgcgcactggtcaggcttgcgatggacgatgtaacgggtgagatacgagcggttggaagagcatttctcgagcagggtactgccgagataagagtttccattgatgagcattcgggcgatctcgagatgtttaagaccgccgaacgagcgaatatcgttatagaggaccgagcaaggcgtctctgctgccacggatacctcctttgattgcttcctagccaatatggcgataggaattaatggcccccggtgggcgacgtattaaatggctgcgcaatatatagcgtaaccaaagcaacattataggccacatgttcgaaattgcaggaagaccgagagattttggttggactgaacggaaatccccctctgtcttgttctgtaacatttggacccggttttgccctgcatctgttacagattgacacaatcggccaggcccacctcgtccgcctcgtcatctgtggtttacgtgggggcatgcgaagcacgggtatactatccggcggcgaatctgctccatcgcttagagctgctgcgtctggacggcgcgtgatagggctgccaaagcgatcgccagcgtgctgagcaacgtcctctctgtgcgcacctgtttttgtatgtattagcgcactaccaagcacgcccgcgcggccgcatgccgtgcccataacgcgtgcagataaggaacaacgacatatgcgtaattctgtatccgacgtcacggacgccgagattctggacgagacccgcgaggccatgacccaggctgccttcgatgccgccgatgaggccaatgctgcccaggccgtcgagtccgctaccgagagcctgcccgcctttgacgagctggggctttccgacgagatgcttcgtgctatcgagaacctgggctacacggcgcccacgcccgttcaggccggctccatccccgtggtgctcgagggccgcgacctgcttgccgccgcccagaccggcaccggcaagacggccgcctttttgctgccgtccatgaacaatctggagcacatcgctccgcccaagcccgtgcgcgagcgcggcggccgcaaccgccgtcgcggtgccaagaagcccgaggacaacggccgcggccccgtgatgctcgtcatcacccccacgcgcgagcttgcccagcagatcgacgaggtcgcgagcaagatcgccgacgtcaccggccatgtcgccgtgaccgtcgtgggtggcgtgagctacaagccgcagaccgcggcactcaagtatggctgtgacatcctggtcgccacgccgggccgtctggtcgacctgatcgagcagggcgcctgccacctgaacgaggtcaaggtgctggtgctcgacgaggccgaccgcatgctcgacatgggctttttgcccgccgtccgccgcattgtgcgcgagacgccggccgagcgccagacgctgctgttctctgcgacgctcgacgaggaggcagtgggcgagatcaccgacctggtgagcgacccggcccgcgtggagatcgcacccgccacgtcgaccgccgacaccgtcgatcagtttgtgttcccggtgtccattgaggccaagaacaacctgctgcccgagttcctcaaaaaggagggcccggagcgcactatcgtctttatgcgcaccaagcaccgcgccgacagctgctgccgtcgtctggagcgtaagggcatcaaggccgccgcgattcacggcaaccgcagccaggcccagcgcgagcgtgccctttcggccttccgcgacggcaccgtcgacgtgctggtggcaaccgatgttctcgcccgcggcatcgacattagcgacgtgcgctacgtcgtgaactttgacgtgccggccgagccgaccgactatatccaccgcattggccgtacgggccgcgccggcgagctgggctgggccattacgtttgtgaccgagcaggacgtcgatgagttctacgagatcgagaagctcatggacaagacggccgatatttacgaagccggcgacctgcatgtgggtcccaacccgcctgcggttgatcccgagcgcgaccctgcggcctttaaggtgaagaagaagactaagcgcggcaagtccaagagcaagaagaagcttgagcgggcgcgtcgcgacggcaagcgcaacggcgacgattacggcgatgttgccggtcgttccaaccgcggtcgcgacgagcgccgcggcgacggcgagcgtccgagccgtcccaagcgcggcggcaagacccgcgtgcgcgagggcgttcaggctcgcgtggacgaggctgttgagagcgtggctcgcgaggtagctgccgaggagcgcggcggtgctggtgccgctgagcagcctgcgcgcggcaaccgtgccgagcgtcgtgccaagcagttccagggcgaggcacaccgccgtcgtcgtgaggacgaggaccgcggcggtcgtcgtcgtgtcgagcgcgaggacgagggccgcggttcgcgcggtggcaagcgcggtgcgggcgaccgccggcgttccggtcgtgatgacgagcgcggcggccgtgatgagcgtcgcggcggcgagggtcgcggtgagcgtactgcccgtggcggtgagtcccgtggcggcaagcgctttgaagagcgcggtagccgcggcggcgagcgtcgcgagggtgctcgcggcaatggcggccgcggcggcgctggtcgttctaacgagtcgcgtgatcgtcgtgacccgcgtgccagccgcgatcgtcgcgatgactggcgcaactacgacgatacccgcgaagagcgtcgcggcggctatcgtggtggtcgtggcggcaaccaggccggctcccgtggcggccgtgccggcggtcgcgataaccgtggcagctacggcaacagccgtggcggcaagcgcggtggcagctcccgtcgccccgacgacggcggcggcaagcgcaagtaagatgcgcatcgcgcgctagcgtgagacaagctaagggcccgagcaaataacgctcgggcccttttgtttgccgtgtccatcgctaattcaaacgtgatgttctcgggaatgcatctgggggatgctgaggacctattttccgccatgcagcaatgggtcctatggggtgcgccgtgcattttttggagtattctgcagttcgagttgtctgcatatgatttgacgtcgccaacggtggctttcggatatccctagcgagcgttctgagtcagatttcgtcgttttccggagcaggggcgcgtcattctcgccatgtcggaacccaaaatgacgcagcgccctaaaggtttgcccgctcggggtattgctggcgcggtcacgttgcagaatactccgttttttgcacggtccgggatggggtacctcgggagaacacggcggtatcccgtaaatatatacaatctgtaccgtaatttatacaaaacgaagaggcagacagcgtagggttggtgcattggggtgcttgatgcaccaaaatggggatcccacgtgccgtatactctggctggatgtgaaaacggcttgacgcgttgccagacgtaggggggagggtgtctcgatgagcgtattcgaaattgtgtttagtccgacgggtggaacgcagaaggtgtctggccttgtggccggggcactggacaagaataccgttaccgtcgatctgaccgatagcgggctagatttcagcgctgtctcgatgactgaggacgacgtggccgtaatctctgtgccggcgtatgccggtagaatcccggctgtggtggctgaccggttgggcatggttcacggcaacggagcgcgggccgttctggtgtgcgtctacggaaaccgcgcgtttgaggacacgctcgtagagctggaggacgttgcgaagcatgcgggattccgggtgatcgcggcagttgcggccattgcagaacattccattgcgcgacggtttgctgccggtcgtccggatgcgcaggatgcggcgcagcttgctgagtttgctcagcaaattcagcaaaagctgttggctgaggatgcgtccgagccctctatccccggcaatcgtccttataaacaagctggaggtcaccgcatggcgcccgaggcaacagaggattgcgtctcctgcggtgcatgcgccgcggcgtgccccgtttgtgctatcgacaagggtgaccccaaacgagcagctggcgaggcgtgcatctcctgcatgcgctgcatcgccgtatgtccgcgaggtgctcgcaagcttgattccagcaaactatccgctgtttcccagatgctgagcaaggtttgcgtcgtgcggaaggaatgcgagctcttcatctagcgcatacgaaattggcgcaatggggccaggttaatctgcaccgacctggtgcaaacaaacctgtccccaatgcaccagagcaaggagtgtccccgggtgccggcagaaaaggaacgtccctaagtaccgcataaataccgtttatcggagaaaaaataccgttcgccggtcataagggggtgcggacagaaagttggaccgtgaagcggtccggactggaggttcgcatgggtcagcccgtgggaggccagggcgccgctgaccggtggacggcaccgagccgtacgcttgaacttggaagggggaggcctcgcggcctcccccttttttgcgtttacgggcttttgtctcacatagtagctgtgttttataaccctcgtttgtcgcatcttctgtgaacgggctacaataacttagtctgtgcgatatggaggtgaacatggctgaagctggtatcggcgttgatatcgtcgagatttcccgcatgaaatcaattcttgaaaagacgccgtcgtttgctcggcgtgtgtttaccgaagaagagtgtgcgtattgcgatgcatcatcgcgccccgccgctcactatgcgagccgctttgcttcgcgcgaggcggtgcttaaagctctcggcacgggttttagtcaaggcgtgggtcgcaaggatgtttcggtaacgcgtgataaactcggcaaaccgaaggcgctgctttcgggtcgtgcactcgagatcgctcaagagctgggtgttgttgaggttgctctttccattacgcttacaggagacttagccgttgcgaatgccatcgcgattaccgaagatgctcggcctaagccaaaagaggaaaaggtgagcaccaagaaacgcgttgcgcagacatttaaagaggctcgctctgttttagatgagcttgagcagctgcagaattcagcattgacggagcacctgggcgatgcttcgcaagatacgctaggagcatagatgaaaccggttttgagtaccgaagaagtcgttcgtctcgaggatatcatcgaacgcgaagggacttcgaaggccgagcttatggagctagcgggtgagtttgccgccaacgaggtcttgaagctcaatcccgatcgggttctcgttctggtcggttttggtaataacggcggcgacggttgggttgccgccgaaatcctgagccataagggtgtggacgtggatatcgtttctccggttgaaccggatgagattcctgctgctctggcacgtcatgttgctcgtcgtactgccggccgcgatgtgcacgtttgcgtcggcccttcgcgtgacgaactcgaggttttgatcgataaggccgatgttgttgtcgatgccatttttggtaccggttttcacgggaatctgcgtgcgccgttctccatctggattcctacggtcaatgaatgcgccgattgtgtcgtatccattgatgtcccctcgggcctgaatgccgagacgggcgttgttgatgacgactgcattcgtgccgagcatacggtgacgatgattgcgcccaagattggtctgtatagcgctgatggccctgagtatgctggcgatttgatctgcggcaatctttacgaccgtcttgacgaggtcatcgatgatgtcgaccacgccgccgagattgtcgagcccggtgacttagttgattactttgccccactacctacgaatatcgataagtattcccgtggctctgtgcttattgtcgccggatctgcgcaatatcctggtgctgccattatggcggccaagtctgcagctcgcgcgggtgctggttacgtggcagtcgcggctcctgacgcctgcgccaatcttattcgcatggcacttccttcgattcccgtctttgctattccgtctgattcccgcggctcctttggcgccgctgcgcgcatgactgtgtgcgagattgcaaagaagtacagctgtgtgctgtgcggtcccggtatgacgacatctgccggcgctatgcaggtggtttcgggcttgctcgagcttgatgtgccgcttatcttggacgccgatgcactcaactgccttgctaagattgccattgacggtattgatagtaatcccgagatgtatcgtcgcgagcagccgttggttatgacgccgcactatcgtgaactttcgcgtctggttgccggtgacgaggtgaacgaccttggtactgcgattgcagccgcgcagaaggttgtctgggctgcaggctctgacaatctggtggtcattgccaaggggccgacgacggctatctgtggcgttgagcgtgtgctgctgccgctctcgggtccggcttctctggcaactgccggttcgggtgatgttctcgcgggtattttggccggcacgcttgccaccatgcgcgacgagatggatcgttgggagctgctgtattcgtacgccgtcgcacttcacagctacgccggttttgccgcggcgacggagtatggtgagaagagcgtcatcgcgaccgatcttatcgacttgatcggtccggccatggaactggcggcaaaggatgcgctcgaagatctgggaatcatggacgaagggtcggatgactaatcatgaataaagccgatttgacgcgctggtcctgggtcgagatcgaccgcggggcgctccgtcgcaacacgagggcctataagaacttgctgaatccacgtcagcgcctgtgctgcgtggtcaaggccgatgcttatggtcatggagctgttgagtgcgccaagatcatgtattcggccggtgccgacatgtttgccgtggcgacggttaacgagggcgttgagctccgacagggcgggattacgaaacccatcctcatcctaagcgagccgcctatcgaggccattccgacgttgctcgagtttgatatcatgccttcggtctatacgtctgattttgctcttgcgtatggcgaatgtgccgtcgcggcgggcaaagtgggcaagtatcatctcgccatcgagacgggcatgaatcgtatcggcgttcactacacgcaggtgctcgactttgtccgcggtataaatttccatcgcggtattcagtgtgacggcgtatttacgcacttcgccacggccgatgaaccttcgggctgggactacaagctgcagtgtcagcgctttaccgaggccgttcaggccattaaggatgcgggttttgagtgcggtatcgtgcactgcgccaacacgccgtcctcgatgcttgacccctcgatgcattttgatatgatccgcgccggcgttggcttgtatggcatgcagccgtgcgagctgagtggccgcgtgatgcagcttgatcccgttatgagcgtccatgcgcgtgtgacgcgcgtggcacaccctgcgatgggtgagggcgtgggctacggttttacctaccgcgtaccgcgtacgcgcgttcagatctgcacgctgccgatcggttatgccgatggcctatcgcgtacgctttccaatcgtatggatgtgctgtatcgcggcgagcgtgtgcatcaggttggcaatatctgcatggaccagtttatggtcgccattcagtccaacccggcacacgagattcccgaggccgagtatggtgacgagatgatcattgtcggccgcgatggcgatgccgagatcactatggacgagatggcccgactgcgcggaacgattaactacgaggtcgcctgcggctttggcatgcgtctcgacaaggtctacgtgtaggagccgctatgggcgtcatgcacatccccggccatacccatcaggcaccacgtgaggtcgcactcgaggaaattgaggccgttctgggcgattgtcacctctgccagctctaccagtcgcgtcacaatatcgtgtttggcgtgggaaacccccgcgctcgcgtgatgtttattggtgaggcgccgggccgcaatgaggatttgcagggcgagccctttgtgggggcggcaggcgaggacctcaacggcattttgtcgctggcggggctcaaacgcgaagacgtctacattgccaacgtgcttaagtgccgcccgccgggaaaccgcaatccgcgtcccgaggaagtgctggcttgctcgccgtttttgcgtgagcagattcgaagcatctggcccgatattatcgtgacgctcggcaaccccgcgacacactttgtgcttaagaccgagattggtattactaagctgcgcggcaggttccaccagatggggcattttgtagtaatgcccacttttcatccggcagcagcgctgcgcaatccggcgtggcaggagctgctggaggaagactttaagatgctgggcgattatctggagcgacatcccgcaccagaggacgcctcggaataataaggagcatatatgtccctggagcgcctgggggtaggtacttacaaaacgacttgcgctgccgatacggagtactttggcgagctaattgcaccgtgccttgaggacggcgatgtgctcatcctgaccggtggcctgggggtgggcaaaactcactttaccaagggcgtctcgcgcgggctgggcgatgggcatatggttacgagccctacgtttgcgctcatggccgttcacgatcaaggtcgtattccgctgtttcactttgatctataccgcctggagcatgcctacgagctcgaggatacgggcattttcgatgtgctgggctatgagggtgcttgcctgctggaatggggcgaacaattccaggacgagctgacggatgagtatctttcggtgacgctcaagcgtgatgagggcgacagcgatgtgcgaacgataacgcttgaggcgcacggtgaccgcgcaatggagctttcccatttgattgatagggctgtacaagatgagcttgcataacgacaacgcgctggtggtggcgctcgatacctcgaccgacatgcttgcctgcgcggcaagctggattgatgggcagacgggcgagacgaagctcgtgagtggcgaccacatgtgtcgccgtcacgccaacgttgagctcgtgaataccgttgatggcgtgctggctcaagccggtctggatcgcagcgatgttggttgctatgtggtcggccgcggcccggggtcctttacgggtgtgcgcatcggcatctccactgccaagggcctcgcgcgtggtgccaatgttccgctgctgggcgtgtcgacgctcgacgcctacgcttggacggcgtggaaggctggcgtgcgcggcaagcttggtatcttggccgatgctatgcgcggtgaggtatatccggcgctgtatatgctggtcgatgagggtcccgagcgtcaatttgagcgcgaacacgtggtcaaggccgccgttgcgctcgatgagtggcgccaagcagcggactgggaccaggttcagctgaccggtgacggtctcgtgcgctatggcaagctgctgggcgaggacgagaccgcccgctgcgtggagcgcgacctgtggtggccttcgggcgagggcttgctgctcgcgcacgctgcgggtgacggcgatccggcccgcgtcttgccgatttacacgcgcctttcggatgccgaggaaaacgagcgcaagcgtcttggtcttgccgagagtgcgcagagcgaaattacgggtgttgccgatgagctcgccggtcgtcatctgcagttccgtcccatgggcgcggcggatgccgagggcgcgagcgcgctggaggctgcctgctttgaaggtgccggacacgaggcgtggacgccgggcatgttcctgtccgaactgggcgaggacgtcgctgcgccgcgtagttggtgggtggcacacgacgacggcaagctgctgggccttgccggcggtatggtcgtggacggtgatgtgcagattctggatgtcgccgtcgacccggcacatcgccgtgagggcattgcccgcaagctgctgtcgcatgtgagctatgatgcccagatgctcggctgcaccacggcttcgctcgaggtcgaggacggcaacgagggagcgatcgcgctttataacgctctgggctttaccgaggcaggacggcgccgcggctactatggtgccggcaaggatgccatcgtcatgacggcgccgctgcccttggtgctcccggtcgacaacgcttcgcccgagccgacggcggctgagcagcgtgtatggccgctgcctgcgcccgagcgaaccgttgaggagcgcgctgaaattgagcgtcgtcgcctagtgctcgctatcgagagttcctgcgacgagacggccgtggcgattatcgatgcggatggcaatatgctggccaaccaggtgtcgacacagattgattttcacgcccgctttggcggcgtggtgcccgagatcgcctcgcgcaagcacgttgaggtgattgtgagtgtcgtagatgcggcgctcgaggatgccgcggcatcgcttggccttgagggtggggcgattgcgcccagcgagcttgccgccgtgggcgtgacacagggtccgggcctggtgggcgccctcgtggtgggcgttgcctttgccaaaggctttgcctacgctgccggtaagccgctcatatgcgtcaaccatctggaggggcacctgtttgccaacctgctggcgcaacccgacctcaaaccgccgtttatcttcacgcttgtctcgggtgggcacaccatgctcgtgcacgtgaaggcgtgggacgattacgaggtgctcggtgagacgctcgacgacgccgtgggcgaggccttcgacaaggtggccaaggcgttgggcctgggctatcccggtggccccatcatttccaagctggccgagacaggcaaccccaaggcgatcgattttccccgcgcgcttaacagcaggggagactatcgtttctcgctttcgggcctcaagacggcggtgacgctctacatcgagcaagagaccaaagccgggcgcacgattcacctgcccgatctggcggcttcgtttgaggcggctgtctttgacgtgcagtacaagaaggccaaaaacgcattgcacgctaccggatgtaaggaatactgcatcggcggcggcgtctcggccaacccgcatctgcgcgagatgatgatcaagaagcttggacgtcaggggattcgcgtaacggtgccgcccttgtctgcctgtaccgataacgcagccatgatcgcggaggtcgctcgccgtaaattcgaccgaggtgaaatctcgccgttcgacgtcgacgccgatccaaacatgacgctgtagctggtacggcgcggtccccggacggaggggccggatataaggtttcctgctctacagtcctgcgcaagacgaaggccgcattaagtggccttctttgcgtgcggaactcgcgataaagttcatatgcgccgcccggctcccgcgactctcaggggcatctctcatgcaaaaactgtcgtggggtaaagtccgaggtcaatggcgttttgtaccgagaaattcaaaaaagttgaaaattcattacatatttgcgttgactttaggtaactaaagtttcatactccttttcaaccactgggggatgtgaacacgcacggatcgttcacatcatgattgaagaggatttcttagacatgttcacgcatcagctaaacattatcagcgtagtaattatctgatgcgggttagcacatacagctagcccgtacgataacgggcggctgatgaagatgagggccgtcgagcgcaaccgacggccctcattttttatgtctaggaagttctttttagaggaggaaatgtaatgaacggagttttgctcatggttgtggccgcggcggtgctcgcctgcggctatctgggctatggccgatggctggccaacaagtggggcgttgacaaagaggccctcacgccggccaagcgcatgaaggacggcaagagcttctcgcccgtctccgccttcaccgcgttctcgcaccagttcagctcgatctgcggtgctggccctgtcacgggtacgatcgtcgccatggcctttggctggctgcctgtcgtgctctgggtcctcatcggcggcatcttctttggcgccgtccacgactttggtgccctgtacgcttcgatgaagaacaacggcaagtcgctcgctcagctcatcgagaagtacatcggcaagaccggccgtcgcctgttcctgctgttctgctggctgttctgcatcatcgtcatcgccgccttcaccgacatggtctgcaagacgttcatgttcaccccggccgttgacgcttctggtgctgctaccggtgccatcgacttcaccaagtcctatgccgccggctgcgctggtaccatctccatcctgttcaccttcgtcgctatcgcctttggttgggcccagaagaagttcaacctcaccggcgctgccgagttcgtcaccggcgttgtcctcatggttctcatgttcgccgtcggtatgcagttcccggtctacctggataagttccagtggttcgccgtcgtcatggtctacctggtcttcgctggcgctatgcccatccagatgctcaagaccccgcgtgactacctcacttccatcatgatgatcgtcatgatcgtctgcgctgtcctcggcatcgtcgtcctgggcgtcaacggtcaggccactatcaccgctccggtcttcaccggcttctccactgcctccggcatgatgttcccggtcctgttcgtctccgtcgcttgcggtgctctctccggtttccacagcctcgtttcttccggcacctcttctaagcaggtcgagaaggagcaggacgccgtcaaggtcggttacggcgccatgatcgtcgagtccttcgtcggcatccttgccatcatcgtcgccggcatcatgttctccgacatgaacaccgccggtaccggcgccctcaacgccggtgtcgcttccaccccgttccagatcttcgccgctggcatctcccgcggtatgcaggccttcggtgttgacggcacgctcgctaccgtctttatgaccatgaacgtctccgctctggccctgacctcgctcgacgccgtcgcccgcatcgcccgcacttcgttctccgagttctttgcccagaccaacgatgccctggccatcgagtccaaggccggctacatgaaggtcctcggcaacccctggttcgccacggtcgttaccctgcttcccggtttcgccctcgcttttggtggctatgccaacatctggccgctctttggtgcttccaaccagctgctcggcggcatgaccatgatcaccctcgccgtgttctgcaagtgcaccggccgcaagggctggatgctctatgtgcccgtcgccttcctgctctgctgcaccttcacctcgctggtccagagcgccatgggctgcatggccgctgtccaggcttacggcttcttcggcaccatcccggctaccgccaccacggccgccgtctccgtcgccgccaccaagggcctgcagcttgtcttcgccgtcctgctgatggtcctgggcctcatcgttgccgttaactgcctcaaggagttcttcggcaaggaggccggttccatgcccgacgaggagcccgagtggtctgagatgggcaaggccgagtacggccgcgccgctgccgctgaggctcctgccgacgccgaggccgccaaggcttagttgacctgacgagttgaacgtcacatctatatgactcggaaagaccgggtccgcgatttcgcgggctcggtccttttttcatgcaaaagcgggtgacgctcgagtgttctcgcagatgttttgcgtggataagggcgcgcgttgtaccatatagacgtatatgtgtgcatatgaaaggggccccgtggccaagacggtatattccgataaccaaaataatgtcgatgccctggctgaacgtctgagcagccggacgtcgctttctgccgagcgtgccaagctggttgcctacgacctgctctgccgcaaggtgctcaagattaagtcgagtgcgctggcgcagattttccgctccgtcgataaggaatgtgacaccaaggcgatgcgcgatgagcttatcgcggcaaatatcgtgacaaagatcgagggtagcggcattaacgggcgcccggcgttctataccatcaatgccgagatccgcgatgtccaggagcagcctgccgagtccgtcgaagattttgtcgtcgaggattctgctgacgtgcctgctgtggaagaagttgctccgcgtgagcatgtcgataccgatgagttgctcgatgagaacgtcgtgcgtgcctttacggccaaggcaggacgcggcggttttggcgggggtggcaagcgcgatgcgcagcgccgcgcccagcaggagcgcttccgtcgcgccgttgctcaaaagggtgagacggatgctgaggccgtcgaggaaaagtccgtcgggatgcaggagccgactcgcgctcaagagcatgctgagatccaggaccccaagcgtcgccgcggtgcccactttaaggccgagcagcgaggtattgcatgcgaggtccaggattccgtcgaggctgctgacgcgtccgatgaaccggtcaagaaggctccgggttcatgccgtcccggacgtggttttgcggggcgcgcgtatcccgtaaggcatcaggagaagagcgagccggcttcgaccactcaggacgagaaggccgttgaggcggcggctcgcgaacagaagcctgctgagccgcagcttgaggttgatgccgaggccaagggccagcagcctactgatgagcaggcggagcagggcgcgtcgagcaagcctcgccgccgtcgccatcgtgggggccgcagttcccatgccgagactgcagccgagaagaccatgccacaggacgaggatgcgaaggtcgaggtttcttcggggcagcctaagcgccagccggcgaaggagagcaagtccgatcgtccgcagaagcaggcgcctatgccgaagcgcgagcgcaattcccaaggcgattctaagcgcaagtctcagaggaagccggagtctaccgcagcagatactgctgcccagcagcccaagtcggcagtccacggcgaggtctcggcgtttgcccttgcccgcgttttaggcaggcagctgctcaaagttgtccctacgcctacggcgctctctaagatcaaggagcagcagacacagatcgtaaaggtcgagggcaaggacggcaaaaaggctccgcagcgcactcagcacaacgagatgtccaaccgcaagattgccgaggaaatcgcaatcatccaggcttggatcgagcagaaccgaggtgccgatacgccggttgcctcgcgccgccagcgtgcctaccagatctttaacgacgagaaggcttttgacggcaagcacggtgagcgcctgatcaggcgtatgaccgaaaagggcatcagcatgcaggcgatcaaggtcgcccccaatcgccccgtgcactttacgggcttttttacgctgggagccgacaagccgttcattatggtcgagaacctggacacctacgacgagatcgtcaagctgctgcgtggccgcaagcacgccaagctctttggcatcaaggtgggcggcgtgatttttggcggcggatgcaaggcgagcgtctcgcatgccctggacgattatctggccgagattggctatcgctttaactacgtctactacgtgggcgatatcgatcgcgagggcgcgcgtatcgtcgagcagactcgcaatgccaatgtggttgagattcgcctgcatgccggcatgtatcgcgctatgctcgccgagcataagcgtcgcgtgaaggccggcggcgagtgcgagcccgcggctgccaaccagggcgtgccgcagaacctggcggcgacgatcaaggatctgcccatggttacgcgcgtgcagttccgcaacgtgctgcgcgagggcgggcgcattccgcaggagattctgatgaccgcagactatcgggatggcgactcgggaagcttcgaccgcatgctcaacaactagattccgccgttctaccgaacggcggtcttcctgacgctgcgaggggccctggcacggcaatctgacgttcaacttcggcggcgcgaccagaaggtcagcgccgccttgtttcacgtcaccttgccataccaggacccctctcgctgtcacgtccaaaacatcgaggtcgcgtggccttctttgcgtgcggaactcgcgacaagcttaatgcccggtccgccggggccacgcgccattttgtagatggcggctcgcttttcggaactgggctgatatttcttgatgcgaggtgttctcgactggtatgggacggagggattccgcgtccgccttttcggcggccgcgccccgctgcgtcgcttcgctccttgcgtgctgcgctggaaaacgcttcgcgtttcctcagctccgcacccttgcgggttcgaatccctccgcttgcccacaagaaagcgctccaggttcataagggcccggagcgctgtgttcttaagggctgggacggagggattcgaacccccaacagccggcaccaaaaaccggagttctaccgttgaactacgtcccaatgtgcggtgttgcccaaaagcaactcgtttagtttacctaatctgcgagggcatcgcaaacgccgtcgagcaggcgtacggcgagtgtctgcgcgtcgctggccgtgaaggtgccgttgtagcgcgtcatgcccgtgagctcaatgcgaatgcgtgccggcttctgctgcgcggcgacattggcagtgcggatgcgctgggccaggttgtggcactcggcgagggcgatcgtggcgcgcggcgctgcatctgcgggcagctcatcgcttgcgatctcgagcactaggtcaacgtcggttgggacctcggagtcgcagagcatcatgccgctgttgtcggtcgttgccgtggcgatattccacatgcgcgacgcaacgctgcgtgcgatggggtcctcgccgataacggcaatctggaagcgctcgagcacgttggcggcgcgagcaaaaccgatgcgggactcggcttcggtgaccgagggcttgccctcccacacatggtgcaggcggttgatgtaggcgtaggtgtcctggaaggccatgccgtcggcaaacaggccgacattttcctggaactgctgcagggcggcctcggtatgcggaccaaagtagccgtcgtcttcgccacaggcaaagcccaaaacgttgagagcgcgctgcagggcctgcacatcggcgccatggaaattgggcatgcgtagatagagggtgcggtcgcccagcttatacgaagcgtctacaagggcgctccaacaggggatatcgacggcatgaccggcagcaaggccgctgtcgagcctgaaggtgctgacggcctgctcagtggtggctccaaagtacttgtcggtgacttcggcggcatcaatcgtgtagccgagctgcaggagacgagactgcacgtcctcgacggctgctccttgcatgcccgttgtaataggttccatgaacgaacccctttcggcgtaccattcgtactatttgagcgtctgtcggatagacaacgcaaagggatgcataaacatgcactcaacagtgtagcaagttgtgcctaaatacgctgctgacaggttttataacccccgttagttaaggcgctccacaaagaaatctgccatggagaggaacagctcgcgtgcgtgcggatcaagctcaacgttctcgatggccgctttggccttagcggtcaggtcgagcgcgtaagtgtgggcgtaatcgatggagccggtctcctggaagatctccacggcgcgtgcgagctgcgcggggtcctcggtgcccgaggagaggatcgcttcaatctcgtcgtgatagcgctcatcggagagggcgtgtacggcgacaagcgtgcgcttgccctcggtgatgtcggtgcggaagtccttgttggcggcctccttggtaccgatcaagttgagcagatcatcttgaatctggaaggcaaggcccgtgtgcaggccaaaggcgcgcagcgcctcaatttgctcctcgctgcctccgccgatgatggctccggtggcaagcggcgtggctccgctgtagtacgcggtcttgtgcgtcgccatgtccaggtaatcgtcgaccgagatgtcgaagcgcccgtcgcgtacccaacccaggtcgagcgcctggccctcgatggtgcggacgatcatctcggtaagctcgtggagcacgcggagttttacgttgggctccagcgtggggtcgtcgagaaccgtcttggtgaccatggtaagtgccaggtcgccgcagttgatagcaagccccgtgccctcggtgaggtgcatgcagggcttaccgcggcgcagctgcccgttatcggcgatgtcgtcgtggatgagcgcacccgactggaaatgctcgatggccgccgcggcgctgcgggcgctctcaaagctgccgcccactgcggtggcggcgagcatgcagatgagcgggcggtggcgcttgccggcattggcggtaaatgccgagagcggggtatacaggtagcgctcgatatcggcagaggtcgcctgtccgtcaaagaacgtggccagatagtcgttgatctggtcaaagtgctgggctaaaaagctggtaaacggactggacacgggttctcgcattctttcttaggttgcatcgttgcggtgtgcagataccatattgccacattggagttgccggcgcgtctgttttggcgatttggggaaacgggacgtgtgcgcgtgccggctgcttatataagcctaaagtgctcgagcgccttgacgacgccatctttgtcgaccgagtcggtgatgtagtcggcgcgctttttgagatagtccggcgcattgcccatggcgataccgacatcgacggcgttcatcagcgagacgtcattgctggcgtcgccgatgccgtatacggttccgtggtggggatcgagggcgtcgagtacagactggatgcccccgcgcttcgtgcattcgcggggcgagatttcggttacctcgagttcgagctcgttaaagcacagcagcggctcaagtgccttatcttgagcgatgtggttggcgagcgatgtagacatcaagatcttgtagacactgtaatgttgcagctgcgtgactgcgtcgcccagggtgcgcgcgtatccgggggcatcgggggcatcggcactcatgcgcacgacgccgttgaggccctcaaagcggatgacctcgcccgattgctcaagatagggggcaagatgctgcagcatgctgggcgtcatcgacagatcgcgaattgcgtgtccgttgatctcggcgtaaccgcccgcaagacagacgatgccggtccagggcagctcaaaaagtttggggtggatgcagctgagggtgcgccccgtgcagataaaggccatgttgccgttggcgacaaactcgcggattgcctgcgaaaccgcctcgttgggatagggggagaggtcccgctcgtcttcgggaaggtcttgggcgagcctggggtcttgccaggcgagcgttccgtcgatatcgaagaagcagatatcgccgcgcttatgggctgcgctggcggcaggggaggccgaggtggtgggcacaaattccggctcgaggcccatgatctggtcaaaatgctctttaacgcggggaacggagatgccgatgaccacctgggcggtcttgccggtaatgatgaggcccttggcgcccaccgcgacaaacgacgcgttatctgcaacgatggaagggtctgcgacctcgacgcgcagacgcgtggcgcagttggttgcgcccacgatattgccaacgccacctaaaagctgaattacccgctcagcgaggacgtgatcttgatcggatcgactatcgacctcgtcgttgggagattgctctttggcaaagccgctttccgttaaacgatcgattgccgcgcgattggcgacatgatcctcgcggcccggcgtcttaaggtcataggccaagatgagtgctcgaaaactaacaaaaaagatgaggctaaaggcaaggccgataccgagcgccaaaagataggcaccggcatgcgtgcgcatgagcggaataaagttgaaggctgccatctccatgaggccgcctgagaagatgccgacgatgccaaagagattcatggttgtggcaaggcaagacgataagacggcgtagagaaaaaagagcccggggtgggtgaacataaagagaaactcgagtggctcggtaacaccgcaaaccaccgaggcgatgatggcgggaacaaggatgaccctgaggccggcgcggcgctcgggttttgcggtggagtagaacgcggctgcgatggcaggaaggccaaagagcttgacccagccagtggcggtaaaaccggcccacggcgcaagctcattaagggggcgcgtgctatgggagaggatggggagcaagctgctccacgtggcgtagatgccgtcgttaatgaccaggttgtcgtagtagatcggcatgtagagcaggtggtgcagccccatgggctcgagtgctcgctccaaaagcacaaagatgcccacgccaaaggggccgacgctcgtaagtgcatggcgcagcgtttcggtcattgcgtatacggagggcacgatggcggccgagatagcggcaagggcaaacacggcaaaaaagctgatgaggtagaccagcgaggagcccgagaaggtgccgagccaatcgggaaccttggcatcgtagaagcggtcatggatggcgacgacggttgccgataccgccagcgggccgataatgccggtgtcgagcgtcttaatgccgtcgatgacggtgataccgttggcgggggtcaaagatgacgggtacttaagtccaaggttgtctccgctcagcttaatgatctcgctcaaaaagaagcaataggcaaaataggccacgagtgcctcgaggcagcagcgtgccggttgcttttgggcaagaccgataggcagcgctacggcaaaaaggagcgggaggcgtttaaagaccgtccatgagccgcgctggatgatggtccaaaaaacgtaccaaggggttccgtatacggcgagatcgccgacgatgtccgcagtcgttgcgagagcggagacgccgaccatgaggcccgatatagaaaacagcatggcgggagcgaacatcgccccgccaaagcgttggattttttgcagcatgttctgccttccgaatatcgaggcgcgttgcgcgtggggaaacgtttaaacaatggattcattgtagaggaccagacgattgtcgtaccggcagttttgagcgaaaccgatttgggcacgacagaaaccgtcaacggttaaatcctgtcgctttaccgatattcggtttaaacaactttaagaaatgctatcgtgcctagccggaaataaattatgtagaggtgaaacaatgccaaaagcgatatacgaaggaatctaccgcgagatccgttcgcgcatcattaacgggacctatgcgtttcaggagatgctgccaaccgaagccgagctgaccgcggaatttggctgcacgcgcaataccgtccgccgcgctttgagcatgctggccgacgggatgtttgtgcagcccatacacggcaagggcgtgcgcgttatttggcttaagggcgaaaccgacatgttgggcgcactcgaagaggttgagtcgtttggcgagtttgcaaagcgcaacaatgccgttgcatcgacggtcgttaagtcctttgaacatttgatttgcaccgagcagctctcttgtcgcctgggctttagggtgggcgaggagcttattcgcgtagtgcgtgtccgaagcctcaacggcaacgcgcgccaagtggaccatggctattttttggcgtcgatcgccaagggcctgacccccgagatcgcggcagattctatttacggctatctggagcacaagcgcggtgtcaaagtgatggcgagccgccgtacggtgagtgtcgagctcgccaacgatgaagactgcagctatcttgacctcggcaaatacaactgcgttgccgtcatggagagtcagtcgtacacctcggatggcatcttgtttgaggtgacgcacactcgcacacaccccgagatcttccattaccgcgtcaattccaagcgatagccggctagctcgcagcctgacgagactcatgccctcaaagagaaaacgcccggtcaaaccgacgatgcatcggcttgaccgggcgttttctctgcattcgataacaaataattgtttatacaaaacttgtcaagtatcaagttgaaattaccgttcaccgaagtttttctaccgctctagtaatacttgttcaaacaactagccaaatagcgtatcgtacaaatcagcaaaaggggcaaagtccccgagccaatctccgaaggcggcggcaaagggtgccgccacggtgtgaaagggtggattgtaatgaagaacgaaatgagcagaaggcagttcctgggctttgctggttccgcggctgcggttcttggtctgggtctcgtgggctgcggtggttctgccggctccggctcctctgcttctggtgacgctgccgaggtctacttcctccaattcaagcccgaggtcgataaggagtggaaggagatcgccaaggcctataagaaggagaagggcgtcgaggtcaagatcgtgaccgccgcctccaacacctacgaggagaagctcaagtccgagatgtccaagagctccgctccgaccctgttccaggtcaacggccccaccggccttaagaactggaaggattactgcgccgacctgtccgataccaagcttcgcggtgagctcattgacgactccttggctctgcagtccgacggcaaggatctgggtatcgactgggtccaggagagctacggcatcatctacaacaagcagctgctcgagaaggctggctacaaggccgaggacatcaactccttcgacaagctgaaggcttgtgccgacgacatccaggcccgcaaggacgagcttggtgttgagggtgcctttacttccgccggcatggatgactcctccagctggcgctacaccacccacctcgccaacctcccgctctactacgagttcgagaaggagcacaaccaggaggacgacgagatcaagggcgagtatctcgacaacttcaagcagattttcgacctgtacatcaccgactccacctgcgatccttcgcagcttgcctccaagaccggcgacgacgccaccaacgagttcgcaaccggcaaggccgtcttctatcagaacggttcttgggcctacgctgacctcaccaaggccggcatgaccgacgatcagattggcatgatgcccatctacatcggtgtcgacggcgaggagaaccagggcctgtgctccggcggcgagaactactggtgcgtcagctcccaggcttccgaggatgcccagaaggccaccgaggacttcatgtattggtgcgtcacttctgacaccgccaccagcatcatcgctgacaagatgggtctgactgccccgttcaagagcgctaaggagaccaccaacgtcttctcgcagcaggccgttgccatggccaaggacggcaagaagaccgtcgcttgggacttcgtttacatcccctctgaggagtggaagaagaacctcaagcaggctctgattgcctatgctgccgacaacagcaagtgggacggcgtcaagaacgccttcgtcgatggctggaagaccgagaaggctgcttccgagtaagcagttgctgcccaagctatctgattagcgacagggggcgggcagacgttggtttgcccgccccctgcatattgaaaggacccttctatgggcaaagcactcaagcgctggtggccgctctttatgctgcccacgtgtctggcgtttatgatcgggttcgtgatcccctttatccagggtttctatctctcgttctgccagtttattaccatcaacaacacgcactttgtcggtatcgagaactacgtgcgcgcactgtccgatccgcagtttgccacgtcgttcttctttaccgtggcgtttgccttcctgtcgacggtgctcatcaacgtgatcgccctcgccatcgcgcaggcgctcacccgcaaagcgctcaagggcaccaacatcttccgtacgatcttctttatgcctaacctgatcggcggcatcgtgctgggctacatctggcagattctgatcaactgcctgctctccaacgtgggcgcccagctcatcgcccttaactctgctgctggcttctggggccttatcatcctgaccctgtggcagcaggtcggctacatgatgatcatctacatcgctggtctgcagtccattccgtccgactacatcgaggccgccaaggtcgacggtgccacggcatggcagacgttttggaaggttaagatccctaacctgatgccgaccatcactatctgcctgttcctgtccatcaccaacggctttaagctgttcgaccagaacctcgcccttaccggcggcgcccccgcgcactccaccgagatgctcgccctgaacatctacaacacgttctattcgcgtgccggtatcgcatggcagggcatcggtcaggccaaggcagttatcttctgcatcctggtcgtagccatctccatgattcagcttaaggccacgaggtccaaggaggtgcagcagtaatgaaacgcgataaggttatcaaccgcgcgctctcgattttctttacgattctgtcgctcgcgtggatctaccccgtgttcatgattgcgctcaattcctttaaaaaggcaactgcaatcagcaccaccacggcattcgatctgctcacgcccgagacgttcaacggcctcgcaaactacatgcatgcccttaacgagcagggctttgcctcggcatttatgtactcgctcatcatcacggtcacgtcggtcgtgctgattctggtgtgctgctccatgtgtgcttggtacgtagtgcgcgtcaacagcaagatctcgaacttcttctattacctgttcgtcttctcgatggtcgtgcccttccagatgctcatgttcacgctgtccaatttggcggaccgcatcggcttcaacacgccgttcaacatctgctttatctacctcggctttggcgcgggcctggcggtctttatgttcgccggctttgtaaagaacatcccgctcgagatcgaagaggcggccatgatcgacggctgcaacccggtccaggtgttctttaagatcgtccttcccatcatgaagcccacctatctttcggtcggcatcctcgagaccatgtgggtctggaacgactatctgctgccctaccttacgctcgactccaccaagtacaagaccattcctatcttgatccagtacttccgcggcggctacggccacgtcgagctcggccccatgatggcctgcatcatgatggtcgttatccccatcgtcatcatgtacatcctctgccagaagtacatcatcgacggcgtggtggcaggtgccgtcaagggctgatgccgtaactgttttgcaagtttctgcggcgccctcaacatggtgccgcatatcgaaaggtaaagacatggccgagatcgttctcaaacatgttcagaaggtgtatcccaacaccgagtccaaaaagaagggcttctttggcaaaaagaagaagaccgaggagaagaagcacaacctcaaggttaccgaggatggcgtgctcgctgttgaggactttaacctcaccgttcacgaccaggagttcgtcgtcctcgttggcccgtctggctgcggtaagtccacgacgatgcgcatggtcgccggcctggaggacattacctcgggcgacgtgctcatcgacggcaagcgggtcaacgacgtggcgcccaaggaccgcgacatcgccatggtgttccagagctacgctctgtaccccaacatgacggtgtacgagaacatggcgtttacgcttgagctcaagaaggtctccaaggacgagatcgaccgtaaggttcgctccgctgccgagatcctgggtattaccgagtacctcgaccgtaagcccaaggcgctttcgggcggccagcgtcagcgtgtcgctatcggccgcgccatcgtgcgtgaccccaaggtcttcctgatggacgagccgctgtccaacctggacgccaagcttcgtaaccagatgcgtgccgagctcatcaagctgcgccacgagatcaagggcacgttcatctacgtcactcacgaccagaccgaggccatgacccttggcgaccgcatcgtggtcatgaaggacggcgtcgtccagcagatcgccacgccgcaggaggtcttcaaccatcccgcgaacatcttcgtcgccggcttcatcggcgtgccgcagatgaacttcttcgatgcccagctggtgcgctcgggcaacggctttaccgtcaagaccgaggacatgaacgttgctctcgcccccgagacctgcgctcaactcgctcttaactgggacggcggcgacgtgaaggagatcacggccggcgtgcgccccgagcagatcctgcttgccgacaagggcgaggagggtgcgctccagggtaccgtcgaggtgaccgagctcatgggttcgaccgagcacgtccacgtgaccgcccccgacggccagtttgtcctgattatccccgtcgtcgacctcgaggccaagggcgcgctcaaggctggcgacaccatctggttcaagttcgagaagaacgcgacccatctcttcgataaggtgtctggcaagaaccttatctaggcccggtgcatccaggccctccctttgggcgactgcggtattgccatccttttgccgcggtcacatataaggctcccctcccgtccgctgaactgcaccccaaaacctggacggcttaaataagaactacgccgcaagggactaagcggtcggcggggccattgtggctcttgacagcggattgggtcatatgagcgagcgggtcgcatttgaggcaaggtgacgtgaaacgaaagggcgctgaccttctggtcgcgcccttgaagttgaacgtcagattgtccaaatgcggcccgcgcagcgtcgagtagttacgcggttcgtagaaccgcgtaactaacaaatgagcatcgcgtcgccaaagctgaagaagcgataacgttcttcgatggcagcggcgtaggcatccatgatctggtcgcgggtggcaagcgcgctcacgagcatcatgagcgtggagcgcggcacatggaagttcgtgatcagcgcgtcgaccacgtgataggtcgagccgggcatgaggtaaagctgcgtcgtggcgttctcgcgcaccacgatgtcaccgcggccaagcgtatcggccccgtcctcgcggccttcaaaatagcgcgccgtcacggccggatcggacaccggcgcgtccgtgtcaaacgcgctctcgagcgagcgcaccgcggtagtgccgacggcgatcacacgatgaccctcggccttggccttatgcacggcgtcgacaacctcctgcgacacgtggtagcgctcggtgtgcatgacgtgctgcgtggggtcgtcctcctccaccaagcggaaggtatcgatgcccacctcgagctcgacggcggcaaacttggcacccttggcctcgatagcggccatgagctcaggagtaaaatgcaggcccgccgtgggagcggcagccgagtgctcctccttcatggcgtacacggtctgatatttctcgggatcgccctcgtaatcggtaatgtagggcggcagcggcacgtgaccggcagcatggatggcctcgtcaagcgtgcgcggctcgccggcggcattgcaaccggccggctcaaaacgcaccaggcggccgccgcgactatcggtgacaaagtcgacgacctcggccgtcagcaccacgggagccccctcgggcgcatgagcgccaccggcgcgatactcaatctgagcaccgggcttcaggcgcttacccggcttgaccaagcactcccaaacatggcccagcgggtcaacatcctcgcggcgcttgagcagcaacgtctcgaccacgccgcccgagcccgtcttgcgaccgataagacgggccggcatcacgcgcgtctggttgatgacgagcacgtcgcccggctcgatatagtcgatgatgtcacggaagatgcggtgctcgacggtgccgccatgccctaacggcgttcctgtctcggagcctttgcgatcaaccaccagcaggcggcaggagtcgcgcggctcggcaggcgcctgggcgatgagctcttcgggcaggttatagtcaaaatcatcggtacgcatagacacgtcggattctccttatatagctaaagtccgctctacatcctagcaggctgacgtcccaagtgaactactttttggcggctttgcgctcgtcgcggatgcgggcgcggtccatggccgcctcgacggccgagaaacggcagccgcagtagttctgccgatacatgcccagctcgcgcgaacgacgtgtcgcctcggggtaatacgtgcgaaaatcgcgaatcaccggagtgagaccgcgggcagcagccagacgctccaacacatcattgcaggtttcgaacaactggtacggcgagacggcgagcgtcgtgcccacaaactcaaacccgcgctcctgggccacacggcacgcctcggccagacgcagggcatagcatgagcgacagcgacgggctcgatcggcgcccagcggggccacgccggcctcccagcgctcccggtcctcccccgcctcgataagctcgatgtcgccatcggcacaccaccggcgcagctcgtccaaacgccgctgccattcatcgtgcggctgaatattggggtttgtccagcagattgtgggctcaaacccttcctcgcgcagcaggcggaccggctcaagagagcacggcgcacagcacgcatgcagcaacaacggcttcatcgacatctcctcacccgaaaaagcgcacgccaaaggacgtatcctcgcaggcgacaatgcggcggtcgcgcaaaatggtccgcacgtaataccagtcgcccacacagcccgacaaatgcaagccggccgccaggtagcacagcagcggatagcccgaaaacgcaaaccccagggcaagcgccgccgtcacaacaaccgtcggcgccaggcaaaccgccatgtaccgccggcgcgaatacacaacgccctcggcgcaggcatagatcatcgccgtctcgcgattcgccccaaaggtcaccttcgcgcccgcaggcgccagcagcttaaaaaacacaccgtgcaccagctcgtgcacggcgaacgacgccattgagatcgcagccaagccgactatccagcccacgacagccatccagccgcccgcgtcagccgcatccaagtctgcaggcccacccagcaacataaacaccggcaccaagcacacggcaaacacgccgactacgaccatcccccacacaaagcaagcgtgcagaaaatcctcgtcttcaaacgcatgtatgttggaaatctcattcatagcatcttaggatagcgcccctgccacgtacccgtccgcatgtgcgataatgtcgaacgatatgcacgaattgaccaccgcgtcgccaggccttgcgcccggccgcgctctcaccatatgcgaaggagtcccatggcatccaaatactccatgaacgaccgtcccagctggcctcgccgcgccatcgttaccgccggcgagccctacggcaacaagggccttcactttggccacgtcggcggcgtctttgtccctgccgacttcttcgcccgcttcctgcgcgaccgtctgggccgcgagaacgtcatcttcacctcgggcaccgactgctacggctcgcccatcatggagagctaccgcaagctcaaggagaacgagggctacgacaagtccattaacgagtacgtcgagtccaatcactcccgccaggccgcgaccctcaacaactacaacatcagctgcgatatctacggcggctcgggccttgagccggctgcgcagattcacaacgaagtgaccgccgagattatcgagcgcctgcatgagcagggcaccatctccaagcgctccacgctgcagttctacgacgccaaggccggcacgttcctcaacggccgccaagtgatcggccgctgccccatccagggctgcaagtccgagaaggcttatgccgacgagtgcgacctgggtcaccagtttgagcccgaggagctcatcgcacccaagagccagctcaccggcgaggtgcccgagctgcgcccggtcgacaacctctacttcgacctgccggcctacctcgactttatgaagacctacaccgccaagctcgcccagaacccgcaggttcgttccgtggtctccaagaccatggaggagtggctgctgccggcccagctctatatccaaaacaagttccgcgaggccttcgatgccgtcgaggaccagctgcccgagcacaccgtgctggagcccgagggaaacaagagcagctttaccgtcaccttccccagctggaaggagcgcgacgacgcccatgcggtgctcgccaacggcggcgtgcgcttccgcagcggcaaagcgctcgtgcctttccgcatcaccggcaacatcgactggggcgttccggtgccccaggtcgacggcgtttccgacgtcacctgctggtgctggccagagagcctgtgggcgcccatcagctatacgcgtaccgtgctcgcgcgcgatgccaaggccgccggcgtgaccgagggcgtcgccgcccaggatgccgccctcatgggcgagcccgctgccgactccacacaggtgcccgcgcccacctaccagcacagctcgctcgactggcgcgactggtggtgctcggacgacgcacagatctaccagtttatcggtcaggacaacatctacttctactgcatcgcgcagaccgccatgtgggaggccctgggctgggacctcacgcagagcaccgtcagcgcctgctaccacctgctctacatgggcaaaaaggccagctcgtcctcgcagacgcctcccccgccggcagacgacctactcaaccactacacctgcgagcagatgcgcgcgcactggctgtcgctcggcctgtccgaaaagccggtgagctttagccccaaggcatacgacacgcgtgtgaccggcaaggacaaggacggcaacgaggtgcgcgcctgcgacgacaagcgcgttatcgatccggcccttaaggagagcgcccttttgaccggcgtattcaaccgtctggcccgcagctgcttctacggcgtcgccgtcaaggaaggcgacgagagcccctatcgcaacggctgcatccccgccggtgccgcctctgccgccgtggtcgaggctgccgagcaggcagctcttgcctttgagcaggccatgtacaagttcgagacgcaccgcgcgcttgccgtgtgcgacgactacctgcgcgccgccaacaagcgctggagcgacgcctccaaggccgccaacaagctcgagggcgacgaagcaaacgcagcgatgacgcaggccctggttgatgcctttaccgagctgcgcgtggcgaccgtcctgatgcacggtatcgtcccggccggctgcgaactcatctgcgagtacttcgacgtcgatccggtcgccttctttagctgggataacatctttgcctccacggacgagttcgtagagagcctgggcgagaagcccggcgaccaccgcgtgaagccgctgcccccgcgcttcgacttcttcagcaagcacgagagccagtactaaagcacgctagtagcaacgcgcccgggaatgattattctgggacggggattaaaaaatcattcccgggcgccacagtacagtctttttgtgacgggagtcatggaatgattatttaatccccgtcccagaataatcatttaggtggaaggaaagacggatgtccaagcagcgtcgtcgtaagcagaaaaagcaggttaagcccgagctcaagctcaggcagtttgccgctaccgagctttccgaccagcttgccgcccttccctgcgccgccgacctgccgcgctttatggtcgacacggtcgccggcgcctatgcgcccgccgatgccgagctcatgatcgagggcttcggcgccgcggccacacgcccggtcacgctgcgcgccaacacgctcaaggcgaccgccgaggacatcgctgcggcgctcggtgccgccggcatcgcccacaaccccgtcgcttggtatccggacgcctttatcctgcccgaggcccaggtttccgacctatgggacctcgacatctaccgcgacggcaagatctacctacagagcctgtcgtccatgatgccgcctttggtgttgggcgcccaggcaggcgaggacatcctggacatgtgcgcagcccctggcggcaagacgacgcagatcgccgccctcacccagggccaggcacacctcacggcctgcgagatgagcattccccgcgccgaaaagcttgagtccaacctccaccgccaaggtgccaaaaacgtgcccgtcatgcgcatcgacgcacgcgagctcgacgagttcttccgctttgaccgcatcctgctcgacgctccctgcaccggcacgggcaccgtcatcagtggcaacgagaaaagcctgcgcggcctcaccgagcagctgctcgtcaagtgcgcccgctcgcagcgcgcgcttctggaccgcgccatgggagccctcaaaccgggcggcacgctcgtctattccacctgttcgatcatgccgcaggaaaacgaggacgccctgcaagaggccctcgacaagcacatggattgcgagcttatccccctcgacggcacaccgagcgaaagtgaagcgcgtcgcgcccaggatgccggcgaggagccgcatatcgagtgcaacgccctcaccgaggccatcgccgccggccatgtctcggccatcgccaacggtatgcccggcacgctgaccattccgcctagccgcgattttgagggcttctacattgccctgatccgaaaacgcagctagcgcacggatcaaaaactcaacaagctatctctgtgcgcgtttgccctgctggtcgcgatgctgtttaagcatcgcgcgctccttgcgttcggcccttttgcccttaatggccgtgaccacaaagtagatgaccgcggcggcaacgattgcgcccacgcacaggccaatcgagccaaacattgctgtcaattccataccgcgtcacctctcttttaaacgggactttcaagatagcacctcgatcctcgccaccacagctccttcacgttctcccgcccttcggtctaacggatggtgcggcggggaaaaatcaactcgtcaaacgatttagcattcgcaattccggctgcatcgcgccggccaccatcgcatagaatcgagcctccatggataccctcaacgacctaaacgaacgcgtcgacgcctttgtcggcaccagctccttcgacacgcctgccgcggcaaacgaccaagctcccatcgatgtacccgccgaggttcacgaggacatcgtcgcctcggtcgatttctccgaggtcgagctcgcagacgagttcaccgagccccaggtagccgtgacccccaacggactgctccccatggagcccctgcccatcgacggacgtctgcgcaaggctgctcttcgcatgcccgacgagatcgaggaggccagcggcttcacgctcttcggccgccgcatcaagtcgctcatttacactaccgatgtcgcggttatccgcaactccaacgccgatgccgtttttgcggtctaccctttcacgccgcagcccgccattacgcaagcgctgctgaccgtcgccgagtgcccggtctttgtaggcgtgggcggcggaactacgaccggtaagcgctccgtgcagatggcagccgtctccgagatgcagggcgcggcgggctgcgtggtcaactcccccgctactgccgagatggtcgagcacatcaccaacatcgccgacatccccgtcatcgccacggtcgtacgttgcgacgacgatgcgcatgccaaagtgcgcgccggagccaagattctcaacatcgccgccggcaaaaacacgccccaggtcttgcgtgaactgcgcgagcactatcccaacctgccgctcatcgcgccgggcggcaagacgcccgagagcatccgtgagaccatcgccgccggcgccaacgccatcatctggacgccgccttcggcacagcagctacagaccgacatgatgcagcgttatcgcaagatgaaggaagaagccacacctgtcatctcgcgcgacgatgtgcccattatcgaccaggtcgccgccgccgaggtcagccaggtcgagaacatgaatcccgatgtgccgattcccgacgaagtcatcgagcgcgtcgcttcgatccacgagcgcgtcgaggagcatcgcgccaaccgcggcctcaagccgtcactgcacggcttcttcttccgcggaaagaaacgctaatcgtaacagcaaggcccgccccacaaacgtgaggcgggccgttatcgtttgagcaatcatgcagcgacgtgatggggcaaattaatccacgcgcttgtcgcccataaagaagagcgccaccgtaccaggtccggtatgcgagccaatcagagtaccgatgtcattgatctcaatcttgcctttaagctgcggaacctgttcctcaatcagcgccgcaactgcctcggcatcctcgcggcacgccgagtgcgacatgatgcacttacccgaataatccgcaccgtcctgcacgtgtgccatcatggtcttggccatctcggaaatcgcgcgcttcttagtgcgaatcttctcacgtggcgacagcttgccgtcgcaatcgaccgtcataagcgggcaaatcttaagcgccgtgccgatgatcgcactcgcagccgaaatgcgaccgcctcgtagatagctcgacagatcggtcgagaagaaccagtggtgcaggttgagtttgtgctcctcgatccaggcagccgtctcgtcgagtgaagccccgctatcgcgcacgttggcggcatattccagcaacaggccaaagcccgaagacgccgccagcgaatcgatgacgcgcaccttgccgccctggggatagcgatccgcgagcatctgcgccgcaacgcaggccgatccatacgtgcccgaaatacccgacgacaacgccaggtgcagcacgtctttaccctcggcaacaaacggctcccaaaactccttgtactcacccacgctcacctgagacgtcttgggcatggcgcccgcggcaatctgggcaaaaaacttgtccggcgtaatcgactgatacagatcgtccgtatggacaacatcgtcgatctcgtaatgaaaacacacgacagggatattgcgcgacgcaaagaactcacgggttcggtcggcggcggattcacaggtcaggacaaaatcactcatatgaggctccttactcattgctgcgcaaattatcgcacagtgagcctacatacggtacatatgtccactatttaccaaatcgaaccaaaaatagcgaacatctttaccaccatcgtctccaccggccccacgcataaatatctgagaaaacaccttctgtcgtctccactcaaccgccatatccacctcaactaaatcgatttaccaaaccgttcagccgacaattcagccgccggcgcaaaatcgaaacaaaagcggcgcatactgataaacgtttgacgctgtttatcagttttaccagccccatcggaaggtgtttcatggtcgcattcgatcgcaacccgcaagacttcaagtatctgcgcctgctgtcgagacagttccccaccgaacaatccgcgtttaccgaaattatcaacctctcggccatcctcaacctacccaagggcaccgagcattttatgagcgacgtgcatggcgagtacgaagcctttatgcacatcctcaacaactgctcgggcgtcgtgcgcgagcatgtcgacgaaatttttggcgacacgctctcctttgacgaaaagggcgagctgtgcacgctcatctactacccgcgcgagaagatcgacctggtccgcagccagcgcgaggactcgccaacttggtacaagacgatgcttgaccagctcatcatggtcgctcgctcgctttcaagccgctacacgcgctccaaggtgcgtaaggccatcccgcgcgactacgcctatatcatcgacgagttgttgcacacgcacccggacgagaacaactatcgcgtgcgctatcacgagcgcatcgtggagtccatcctggagaccgccagcgccgacgactttatcgagtcgctcgcctcgctcatcaagcgcctggccgtcgaccacctgcacctggtgggcgacatcttcgaccgcggcggcggcgcggccaagattatggaccgtctgctcacctaccattcactcgacatccagtggggcaaccacgacctactgtggatgggcgctgcggccggtgagcccgcctgcatcgccacggtgttgcgcaacaacctacgctacgacaactacgagatcctggagaacaactacggcatctcgctgcgtgagcttgtcgcctttgccgatgccacctacaccgccggtgagtccatcaccccgctgatcaaggccatcaacgtgctgctctttaagctcgagggccagattatccagcgccaccccgagttcgatatgaccgaccgcctgttactcgacaagatcgaccacgacaccggcacggtcacgctcgccgacggcagcgtgtggccgctcacgaccaacgacttccccaccgtcgacccggcggacccctacacgctcacgtctcaggagcagcacatcatcgacaagctcgtgtccgagtttgtcaccgccgatcacctgcatcgccatatcgatttcctctacacccacggctcgatgtacaaggtcgccaacggcaacctgctcttccacggctgcgttccactcaacgaagacggcaccttcagcagcatgaactgcctgggcacctggcacgctggccgcgattatctcgatttttgcgaccacatcgcccgccgcgcgtggcgcgtgggcgaccgcgatgccctcgactggatgtggtacctgtggattggcttcaattcacccgccagcggacgcctggtgcgtacctttgagcgcgcctatatcgccgataagagcacctgggtcgagccgatggacccgtactttacgcttaccaagtcgccctcggtctgcgatgatatcatgcgcgagtttggcgtcgcggccatggcatgctcgccgaccggccacatcatcaacggccacacgcccgttaaaaccaccaagggtgagcagcccatccgcgccgagggcaagctactggtcatcgatggcggcttctgccgcgcttaccatcccaagacgggcatcgccggctatacgctcatctcgagctcgcgcggctgccgcctcaagtcgcaccgggcctttacgacggttgccgaggcactcacgcgcaacgtggacatcgagagcgagaccaaccgttttgaccaagcagaccgtcgccgcatggtgagcgacaccgatactggcgccaagattcgcagccagatccaggacctgcgccagctgctcgatgcatatagaaacggtgctatcgaggagcgcgcctagcaccacccgcggggattggctaaacttgctaagtttgtcatccccgcggcgcttcggcgccagcttaaggcaggtaccatgcaaaagctccttgcgcagattatgaaatttggcgtcgtcggtgtcattgccacggttatcgactttggcattatgaatctgctccactacggtctgggcctcaacatcctaatcgccaacaccagcggctttatcatctcactcatctttaactacctcgcaagcatgaaatacgtgtttgcgcacaaggaaggcatgagccgccgccgcgagttcatcatctttgtcgtgctgtccgtgatcggtttggtgctcaacgatggcatcgtgctggcgctcaacgccggcctgggactcgaggccaatatcgccaagatctgtgccaccgcgcttgtcatggtctacaactttgtgacccgaaaaatcttcctggagggcgacgagacaaaatagctcgaaacccctgtagcattacggcgcccacggacgacgcgcactcagcgcagtatcgtccgtgggtgtcgctcgtttacgggcaaattttcaacgtttgcggattagctcttgaaaatttggcgagttcatatagttcttggcaaagaccttacgtttcccttgtaaaagctctaaagtatcctctgctcgattcatcaacgcattggatgtgattacgtgcgcaaggcgctggcacaacctcataccaagcagttcctcaagtttgccgtcgtgggtcttatctcctttggcatcgactggggcatgctcattgcgctcgtcgagctgttccacctcgactttttgatgagcaccacggtttcgtttatcacgtccgtcgtggtcaactactggctcagcatgaagtacgtgttcgaccaccgcgaaggcatgagccgcaagcgcgagttcacgatcttcaccatcctgtcggtgatcggcctgggcctcaacgacctgtacatgtttgtgggcgtcacgtttttgagcatcggctaccaggccatgaaggccatcgccacattcctcgtcacctggtacaactacttcagccgccgcttcttcctcgagggcgcacggtcgtagtcgattcactatttgcttgaatgtataaccggttggaattcccgttccaaccggttttttgtttgccgagagacccggcgatccagtcccattcgcatgaaaaacgggcggctcggatgttggtccgaaccgcccgtctggcgcgctatgtcgaggcctctagtctgtaacgtaataccagactacgttgtcgccgtttgagagaacgtagttactacaggccgtcatgggcgttgtgccgttgacggaatacatccagccgctcgtgccgccgtactgtttctcggccaaaccaccaatcgcagaaacatacgtgccgtacgatgagccgtgtgcgttgacagaaaggcccagcgcgcacagggcatcgtagacggtagcaccttcgttaaaggtaaaggtgccaccagaggacacaggattgtccacagcgctcgatgtgaccgaaaccgtcaccgtaacgtagttggactcctgtgagccgctctggccgcccgaggaggcgtttccaccattagaggatgaggctccatcagacgactggccaccgcccgaagaagcaccgccagacgcattggaagtatcactggctcccgtattttgggcagcggatttatcgccagacttcttgccgccccggtcctcggacttcttgctatccgagtttttgtccgattccttgtttgaagactcggaatcgtccttgtcgtcgttcgaacccttggactcatcttttgcgtcattcgatgacttggaatccttggaactggcctcgcccgaagtcgtagtcgagccagacgccttggtgtccttggtgacgacgctctcccccgtcacggtctgaatgatccagtcgatggaccaggcaccgcttgtggaaggatggacgaaacccagcgagacgacgatcagaatggtgcatgcagcagtcagaacgccgaggagcgccttgcgacgagaggtggacgccgccgaagcggtgcccttttgctttggatcatcgagctggataaacgaggagtcgggctgttgcccgctggtctccttgggcttatcgggcattaccgtcacccttgccgcgcttggtcagcacgaagacggcgatgagcgcgaggccaatcacgccggcggcgatgccaacgatggcgagcggattggtgccagtctccggctcggaagcactagaggacttcttagcagtggtcgtggaaacagcacccgtatcggacttggaatcggacttcttgtcggacgtgccgtccttcctgtcagacttcttgtcagacttcttctcgtccttcttatcggacttatcggagtccttcttgtcggacttgttgtccctggtctcggtcttggtcgacaccgtcgtcttggtcaccggcttctggcccggggcaataacgccgcccttcgagccggagccagaaccagcgccagcgccagtgccggaaccagtaccggtactagaaccgccgccgccattcgaaccaacgccaccgttgccaccattagcgccagaaccgccattaccgccagggttaacggcattcttggtccacttggcatacaacgtcaggtcggccgtcaccggcgtactgaagtcatacgcctgcgcgcaagtctcatcggtataccaaccgccgaaagtgtagccatcgcgcgtcggatcggctggcttgaccagcttgccatcggccgtagcaacaaacttagtattgcaagcagacccgccgttggaattaaagacaaccgtccaagactcaacggccccaagcttgaacagcgtgcccgagtcattgatgtagtacaggttgccagatgcatcggcaatgaccggagagtcacagtgctggtaatggccagccgcatcataaatctgcgtcgcctctgcatcaccgagcgtatagcgatacacgccaccaccagcagagtagttgacgtaatccttgctatccgcgctgttaacggtgaagtacacataggtcttgccaccctgaacactcaccagcggagtagcagcaataccgttaaatccggccggcagttctttaccgtcagcagcggtgaccatcgtggtcttaccggtcttcagattatagagagccagagcagagccagtagccgtctgtccgccgacaatcaagttttcgccagccaccgccggtgcgctcatgttattagtaagacccaggtcgaccgtcttctgctcgctcagtacgcccttcgccgaaagcgaaatcacatggagctttccatcgtgcgtcatctgatagaaggtggaaccattggacggatcggcgacacagtcggcgttcgcgagagcgccgagcttcatggtcgaaacgacatcgcccgtcgtcttatcaatgcacttaagcgtgcccgcgctcgtaggaacgatggcatacttatccgtcaaagccgcaccagtccagtaataaccctcggaagcgtcaatgttctgccaagaaacttcgcccgtggcaatcttaatgcgcataaaggagccgttgccgtaggtcgcgttgtaattctcgtcatacgaaatatcgaccgtaccaacatagacgtactcgccgtccgaaacgacggtgcaggagctctgcgtcaagtccgtcaaaccgggcgtcagccacttgcagatcagcttgtctgcagtaatcgcctggaccgcaccgccgttgagcggaacgatgataaggccattggtgtagatcggacgagaggtataactcaccttggaggcaagcggcgcagaggcaacctttttgcccgtggacgaatcgatcttaatgagctcgttctcggtcgcgatgtacacaaagccgttagcgatgacaggctcgctgcagttggcatactgctgaccagactcggccttccaatcgaaggcccacttaagaccggcggcctgcgcaggcgtcttggcatccgttacggtcgaaccgttgccactgttgccgtagccggcccactcggcatcccaatcaggagtcgtcgcgctcgggtccacgacaatcttgtcgggatcgggcatggccgaatcgtcggtggtataggcaagcgtaaccttatcgccgctcttgagcgtaatctgattggcgcagagtaaggagggctctccgttgatatacaggtgccaatatttattggtcgcagcatcccaggcatacggcttgtgatcgaacggcgagttgatggaattgaggaaccagtactcaccactctgggagccgttgtacgtaacgcccttggccttcaggaccgtctcaataaggttctgagccgtagagccctcgggcagggaaacattgcttgccgagccccagcgagtattgttgccgttgacatcgggaccgataacatcgacagacccaagaacctggccaggaagggcatcggcgtcagcaccatacataaaggtgacggcatcgccctcttggagctcataggcaccggcgccaacgtcggcgaacttgccatttacatagaagcgccaatagctattagtcgcagcatcccagccataggacttactatcgaacggcgaagtaatgccgttgaggaaccagccccaagacgattcgccagcatcgagagtaaggccggtctgctcaaggagatccttggcagtagagcccgccttgagactcgtctggcccgtcgaagcccaaacctgctgcttgccgtccttgtccttaccaaggacctggacggaagcatggacggaatcggacggcaacttatcgccccagccaccgtagaaccacgtaacggtatcgccagcatgaatggtgacattgtctgccgtgtagtcgctcgacttgccgttgatgaacagctgccaataggtcgaataatcttggggcgtacccagctcaacaccgttgtacttaaggctcagaatgaaggagccagcagcaacggcgtcgatgtcattcgcctcaagcgcgaccttcgtaaggtcaagtgcgctcgaaccggacgtcaccacatactgcgcgttatcgacccaagtctgagtcttgccctgggcatcgcgaccaatgacggtcacatttgcggcaacctagtccttaacgacaggggacgcgctaccagccgtataggcaaactcaaccttctgcccctgggtgagcttaacgctgctcgcgccaaccgaggaagacgcaccgtcgacgaacagctgccagaaggcataagtcgtcggatcgaaggcaagcgtacggccatcgctcggggatgtgatgcttttgaggtagaaaccgtatgccgtgttcggatcgtagtctgccttgaagcccgtcttctgctgcagcttaacgaaggcatccgcagccgtcgcgccctcgtcgagcttgagctgcgtgggtgccacccaggtctgagccttgccgtcggcatcggtgccgataatcgagaacgagacctcgacttgcttcttggcgacatcgccggtttctgtcgggttctctgtctgaacggcagccgcggcggcagatcctgcttggccagcggatgccgctgaagactgctcgctcgcggcagggctctcccccgtcgccgagccttcgtcgccagttgctgcctttgatgcggcggcactagctgcaggcgcgctcccagaatccgaaacctcggcgccgctctgctcagcggcaccgcccgcaagcgctgcgtcctcgcccggcgtcgtagcctgagccacagcctcggcaatgccctcggcgccctcggcccacagctgagccggcgtggtgctgaaggccatcgcgaaggccaggaatgccaccaggcagcgctttgccacgccgcgcgcgattacgccacggcgacgaagcgaggcacgctggcactcgtcctcaaacatatccatttgtctcctattgtctgtacttggagcgttgccttgaagctgccccacgtcatcgcgcatgttgcgcccgagttcccccatcggggtcccccttccctccagagccctatgcacaccggcggcatacgccgcagccgcatgcaagatgggaggcgatccgacttaaccttaacggctcaggcgcgccgtccgatctgcgacgcgaacatcccgagccaagaggaattacggttactggtacagccggggacttgcaccccgattcccccaaacgcgcaggaaaaccgcgcattcgtgcgtctccgcaccaccatctaggccatcgattaaaaccgtcaatatgctatcacgcaaaagggcctcgcacgcaggcgaagcccaaggtaaaagctattgtttgcgaaaggaaaatgcggtgacggtcgcagcctctagcgcttgccgccgtggctgttgagccagatattgcggcccagcataagcgccagcaccagcgcgctcacgtagcccataaagccaatgaccgggataccaaacacaaccggctcgatgcgcgcgtagtacaccaccgacgaaccgataaacaagccggcgataacaatagccatcgacatgcggtcgataattccacccagctgtcgcagcgccttatcgctgctcatgatctgcgtgttcaccttaagctggccgcgtgtgagcatgcgcgaagccaagcccagatactcggccgcctcgagcgagcccttcgccgcgcgataactgctcgctgcaaagtcgcggctcatctcgcgcatgcgggcgtaggtgctcttctcgtttttgatgtgcgtctggatgatctggatcatgttgacgttgggcatgtactcggtcaacaggccctcgagcgtcaccatgccgcgggcgaacatcgtcaccacgctcggcagctcaacgtcatttttgcgcgcgaggtttaacagcgaagtcaaaaactcgccgatatctaggtccttaaggtcaaggcccgcaaagtcagccacgataaagtccaaatcggacaaaaaggccgaatgatcgagctcagccgagtcgccacgcgtcacggcgaagcgcatgagcgaatccttgagcttgggcacgtcgccctcggccacggcgaaaatcatgtccttgacgataccgcggtcgtggctcgacatgcgtccgaccatacccaagtcgataaagtaaacgataccgtctttgaggatgatgtttcccgcatgcgggtcagcatggaaaaagccgtcatcaagcacctgcgtcgagtagtcctcgacgattgcggcaccgatcttttccaagtcatagccctcggccaccaagcgttcaggatcggcgatcgaaatgccgtcgacgtagtccataaccaccacgtgttcggtgcacaggtccagataggatttagggcacgtcacgccatgaacgctcttatggaactcgtagaagtcgttgaggtttttggcctcggccaaaaagttggtctcctcgcgaaacgaggtccacagctcctcgaccacgccgtgcaggtcaacgaattgatcggtgttgacgaacttggaaacgatacgcaccaccgagcggatgatatcgatgtcctgcgccataacctgctgcgcaccggggcgctgcaccttgacggccacgtcctcgcccgtcaccagacgagcgcggtgcacctgcgcgagcgacgcgctaccgagcgggttggggtcgattgcatcgaacatctcccccaggcgcaggccgtattcttcttccagacagctgagtacgacctcgtacggcaccggctccacgtcggagcgcagacgacgcagctcgtcgcaaaagcgctgcggcagaatctcggaccggttggccaaaatctgccccatcttgacgaacatggggccgagttcctcgagcaggcggcgcaaacgaaccggcgtgaggttatcccacacgcggtactttttgaccaggcgtacaatctgcccaatgcgttcgcgacgacccgccggcgtgagctggtattcctcgtccggcgccatcgcgtcgggctcctcgggcaccatatcgacggcgcgcggcttcttgcgagcgcccgagacggcggcgtcgacctcatcgacaaccgccgcctcgtcacccaagggatctagattgttgtaatcggtggtggaatctgccatctgcgctgctactcggcctcttcggtatccttcgcatcgtcgggctcaacggactcgacgggcaccgaggtcacgttgtcctcgaccgaatcgacgatgtcgcgcacatgggccaggaaggcagtgcgctcgggagcggtcatgacgcggacgcgggcaaggataagctcgtcaagcacgcgctgggccgcggtctcgccctgcatgcccagacgctcggtcaggtcggagatggtgccaccggcctgctcgaacatatcggacacgctgcgggcgatatcgggggtggcggtgtccttgcggacctgctcgcccttggtgttaaggtcgtcgaggaccttcttgccgccttcgacagcaacggcggcagcgccaaagccaacgttgatggcgccgttaacaagctgatcgagtttcataaccatggttgtctccaatcataaacaactgcattggcgttcttgtacccaagatcgagtgaaagcgacaaagcgttttagcgctattcgatcgacgggaaatccctacctcacgttgtcgttcatcgcgaaagagttcttcatggcgcagctcgtggtgtagagcaccttgcccagtagagcatcggtctccacacgaacacactcggcaaaggcctcattggcgcgtgcaagctcggcaggcacctcggcctcaggcagagcggctacggtagcatcgacgtcatggatctgcttgtggcccatgccaccgaccttctcctggtagtcctccacagcgcggccgcactcatggaaacggacgtcagccagggcgccgatcaggcggttggcccagtagaagttttcggacgtcacgcgagcctgcgtgtcggcatagtactcgggcatggtctcgacgttggcgtacagcggaaccagcgcgttaaacgagttggaaccaaaggccatccactgcacggcgcgatacgccggctgcgcataggggcgcagctgcagcacggcgagctggctgttgcggttgatgccgatggggcgataagcgccacgcgtggcgggcgtgcccttgctgccgtagcagtcgtactccgtgccctggtagtggctcgaaagcacgtacttaatgtcctcgatggtcaccttgcgctcgggcacgcggctccaggggatatcgtcgctctcgggcgtgtagtcggcgtcggggccatcccacacgtcactggggttgaggcagcgctgcatgtaccaggcgcgcggcgtgttgtagacatggtcgctgtcgctgtgcgagccaaaggcctcgcgcgggttaaagaccgcagccggaccgtcgccctcaacgcccagcgtcaggtccaaatgccactcggccatccaggagcgcaggtcggcggagcacatgtggtcggcctgggcgccctcggcgtcatccaggtcaaagctgtcgatacccagctggttgggcatggtcacataggcgtcgtcaggcacgcgctttgcgatccaatggtgaccgccgatggtctcgagccaccagatctcgtccacatcactaaaggcgatgccgttgttctcgtaggtgccgtagcgctcgagcaggtcgcccaggatacgaacgccgtcgcgggcggacttggcgtacggcaggaccagggtcaccatgtcctcctcgcccaggccaccgggctgtgccggaacgtatccatcctcgccttcgttgcccctagcgggcacgtagtccacaagcgggtcggcgccgcggacgcgctcgttggtggtgagcgtctcggttgcggacatgccaacattgagctcgttgaatccggcctcggcccaaataccgtgaccgggaacgacgtcggggacgctcgtgtagcgcatgggattgtcgggcaactcaacggtcaggtggctcaggacgctcgtgtagacacgcggctgctcgtcgggatgcaccacgcgcatgcgcttgggctcaaacaccccgttggacgagtcctcgttgcgggcgaccagcgtcgacccgtcgtagctcgcgttcttaccaaccaaaatcgttgtgcacggcatgcgcatcctccttgagcgaagaaatcaaacggcaacagtgtatcgcttcgacgcaaaaagggcgaaaccacggcctcggcagcccccgtggtcaaaaaatgccaaatatgagtactgtcaccaatttagtggcagcaaatttccctgtaacgagtgccgaaaatccccatttgcccaaaagcaagacaacgttattccccataagttcaataaaataggcttcctaacgataatggataccgttaggaagccaaaaagacgtaagacatatgtgactatcggtggcgcgcgcagacgtggtgtaagagtgtcctgaggtccgtcgctgcaagcccggaaagaaactgcaacgcgggggaggcgaccccaatggctttctcatatcgtctatcgagcgagctcgcaacgcttatctcgggccgatatgtcgaggtcaagatgcagcctctcacgtttagcgaatatcttgattttcgctcgattgatgcggtcgccgctgaagggcttggtgagagggtcgaacttgtttccaaaacgggcgatcgccttaattcaaataccgtgcttgagcagtacataacctatggcggcatgccgtttctggcccatgatgagccgagacgtgagctgtgccgcgactatatccgtagcctctaccagacgatcgtcgcgcgcgatatcctgtcgcgtgcgacgcgtaggggtcgcggagctatcaccaagcgcgatgttctcgagcggctctgtgcgtatctggcagacaacatctccaaccaaacctcggtcaacaaaatcgtagggacgctcaacgaatcggcgggcggtaagaccaacgcatcgacggtgtcggcatatattgacgctctggaagagacgtacctgtttaccaaagtaaaaaggtatgacatcaaggggcgggagcttcttaagacaggcggtaaatattacatagctgatacgggaattcgcagctatcttgacggatatagaggtagcgatagcggaaggatgctcgagaacgttatctacaaccagcttgtatttgaaggatacgaagtgttttgcggccatctgcgcgcgggggaaatcgactttgtcgcaatcggcgagggatcggaccgcaaatatatccaggttaccgagcggatcgatgccgaggcgacgagagaacgcgagctgcgaccgctcaagctaagcacgctaggaaaaattcctgattcgtatgagaagatcctgattgtcagggatggcgaccatccaacggacatcgatggcatcagaatcgtgggggcagtcgacttcttgttgagaaataagattacccgcggctaaacgcaaacagatccgtttcgatgcgacaaaggagcagtcctttttcgcattccgtgcgagccctcgtgccgtctgggggtataaggctaacaagtgtttatttgcgaggcctaaggggcgccccgtatggatatcgataactttgaatggtggtatagcgagggtgaggctccggacgaggggtgggacgagcctacgccgcgtgacgtgtcgagcgacgaggacgagaccggcaacgacgtcgccgccgactcggacgccgccctcgattccgtcgagcccctgaccttcgaacaagcttgggcccaggccgaggcagacgaggccaaggccgacgctacggccacgctcggcgagccagccgacatgtcgatctcgccggcaaagaccccgcagccgcgtcacaccatcgatcccgacagcacggcatccttcagtattctcgacgtgccctcgcagggtgcccaggcgcccgcgcccacacgtcgccccaatctgtctcgcgaggaagatgcaggacgtcgctctccgctcggccccatccttatcgccttcatggccggcgttatcgcatgctcggtaattggaaacgtctggagccatgttgagcaacagcgaaaagacgccgccaaggtcgagatgtctgtcgagcaatcgctcggccgcacgcgctcggtacatgtgtcggtcgaggtcaaggacggcgcgacgtgggacaccgcgcgcggcgacagccaaatgctcatccatatcgtggggcgcacgctcaaagggcagacgatcgacgagtatcaatacgtcaattccgctggtgacggcatcgagctcaagcccggcgactacgagctcaccgtcgatgaaccgcccgtcgccaccgacggcacgcgcttccgcgcctcaaagcgcatggtccccgtgaactttaactcacaggcgcccgacacggtcgacactacaccgcagggcgggttcgacctttacgtggatacccagtaggcactcgccgctcattccgctatggctactcaataatcgcctgccgtcccgtcccgccgccaagagtgggacaatagccctcgacactattgtttacttttggaggaagtagcatgtctaccgttactaccatcaagcgcggcggcctcaccgcggccatcgattccatgggcgcccagctcacgagccttgccctcaacggcaacgagtatctgtggcagggcgaccccgccttttggggcaagcacgcgcccatcctgttccccattgtgggctcgctgcgcaacaacacggcaacgtctgcggccggtacctgcgagatgccgcgccacggactcgcgcgcattgtcgagcacaagctggtcgaggtttcggaggacggctcctcggtaacgtacgagattaccgatacgcccgagtcgctcaaggcgttcccgttccactttaagctcaacatgacctatgccttgaccggcgacgccaccctcacgcagacctttgccgtcaccaacaccggcgacgtggacctgccgttctcggtgggcggccaccccgcatttaacgtgcccgcccccggtgccgaggacgaggcgttcgaggattacgagttggcgtttaccgaggcttggaccaacgaggctcccatcatcacgcccgacggtcttatgacgttcgagggcagctacaaggcgcccgataactcggacgtgctgcccatcacgcaccgcagcttcgataacgatgccatcatgttcaccgatactccgggctccacgctcacactgcgcggccgcaagtcgggccacggcgtcaagatcgactttgagggctttaagtacatcggcgtgtggtctgccgccaacgacgctccgtttgtggcgctcgagccctggaccggtcacaccaccatggacaccgaggacgacgtctttgagcacaaggtcaacaccatcaccttggctcccggcgagacggatgttcgcagctttagcgttaccttgctctagaggttccgccgctcggtcgatgctgcgcgtcgtccagagcgacaagttgtcattcaaaaggcaagacatagaccttctggtcatgccttgcctttttcatgccacttgttcgctctggacgtcgctcgccggcattgccaaaacatcggcgtccccaatggctaccgtgtgtctattaatttttcgagcttgtgctgcgctgctggtcgctggcgtatatcctgttaagtcgtcagcatacgattcaacagggaaggcagattatgcattctccccaacagtgcgatgcgcagcgccagccggtatgcagccgtcgcatctttttgggtagcgccctcgctgcgagcgcttccgtcgtcgccggcgcgcttgccggctgtcagcgcccgtcaacgctcaaggtggttcagcccacgacgggcggcggtcgcgacgacctgtccgattccgtgatcggcaaggataagatccgcattggcatggaggcggcctacgccccgtacaactggcaggtctccgaggccagcgagtacaccatccccatcgacaacgtgcagggtgcctatgccgatggctacgacgtgcagatcgccaagatcgtctgcaaggccctcggtggcgagcccgttgccgtcaagcagagtttctcgggccttatcgattcgctcaacaacggccagatcgacctcatcattgccggcatgagcgccacgcccgagcgcgaggagtccgtcggcttttccgacccgtacttcattggctactttggcctgttcgtaaaagagggctcgccctaccaaaatgcgaccaagctcagcgactttagcggcgctacggtcctcggccaaaaggacaccatgctcgataccgtcatcgacgaaatcccgggcgttgtgcacaagaacccggtcgattcggtccccacggtgttttcgaacctgctgcagggcacctgcgacgccgtgacctacaacaccgagaacgagaagggctatatggcccaaaacccgggcatcgtccccattcaatttgccgagggcgagggctttaagcaggaggtcacggcaaacgtcggctgccgcaagggctcggacaaactgcttaagctcatcgacaagacactcaagggcattagccaagaggagcgcgaccaaatgtgggacgcgtgcctcgaccgtcagccggcatagggaggcagcatgaaaaccatcaatcgcctggcctcctttatcaaggcagaccaccgttatgtatacctgggcacgagcgtcatcgcggcgctcggcctggcgtttagccagcgcaaccccacgccgatgagtttcttggcgcctacgggcgtgttccaagactgcctctgggcaatcctttgggcctggctcgtcgtgtcggcggcggcgctggtcaccaagctcatgcactggaacgactatcgcgaaaagtcgccgttcgcatccgagcgctgccgtcgtggcgcacgcctgggcagctacgtcgtggtcgccatcgcggcgatctttttcgtggaccgctgcgtcatgtcgtttatcgacctggtgcaggtgagcattgtctcggattccaaccccagcgactttttgtcgagcctggtctacatgacctacaagagcggtgacttcttcattcgcggtatcgagatcaccatcgcgcttgccaccttcggcaccgtcatcgcattcttcctggcgctgctctttgtgttcctgcgtattcagaccttcgaccgcgtggataacgacctggtgcgcttctttaagagtatcggccgcggctttgcgaccatctactccaccatcgtgcgcggcacgcccatgatggtccagggcctgctcatctattacgcgggcttcaccgttttgcgcggcatgggcttcgagaccgcccaggccaaccagatttggagcaccttcaccgccggcctcgtcaccatctcgctcaactccaccgcctacatgatggaggtcctgcgcggcggcatcgagtccatcgatcccggtcaggccgaggcggcgcgctcgctgggtctttcgcagtggcaggctatgcgcaaggtcgtgttcccccagggcattaaaaacgcgattccggcgctcaccaacgagctcatcatcaacatcaaggattcgtcggtgctctcggtcatcggcgtgtttgacctcatgtacgctaccaccaccgtcgccggcgtgtactaccgccagatggaggtctactgcgtggcactcgtggtctacctgatcttgacgctcgtggcgagccgcctgctcgaggcctttggcaaaaagctcggcgccgaggctccggtcacgctgcccagctccaactaggctcaagacgaggagaatcatcatggcagataccactaccaccggcgctgtggccgccgcacaaactaaagagtcgctcatccgcgtcgagggcctgcgcaagagcttcggctcgctcgaggtactcaagggtatcgacttgtccgtcaatcctggcgaggtcgtcaccattatcggcgcttcgggttcgggtaaatcgacctttctgcgctgcctcaatctgctcgagaccccggacgcgggccatatctggttccatggccaggacctcacggccgagcgctgcaacattaacaagctgcgtgaggacatcggcatggtgttccagggctttaacctgttcaacaacatggacgtgctcgacaactgtacgctcgcgcccgtcacgctcaaaaagatgggcaaggtcgaggctgaaaaaattgcgatggagcatctgacgagcgtgggactcgaaaagttcgcgcacgccgccgtgggtcgcctgtccggcggccaaaagcagcgcgtggccatcgcccgcgccctgtgcatgaacccgcagattatgctgttcgacgagccgacctccgcactcgaccccgagatcgtgggagaggtgctcgaggtcatgcgcaagctcgctgccgacggcatgaccatggtcgtcgtcacgcacgagatggcctttgcccgcacggtgtccgaccgcgtggtctttatggacaagggcgtggtgctcgaggacgccgctccggccgagctcttcggcaaccccaagcaccagcgcacccgcgagtttctctcgcgttatctcgaggacaaataaccgaccgcaaacgcttatgtggcagggccgctccggtggggcggccctcgtcatcacgatcgaaaggacgttatggccgaggtttggcgcttctttgcgcatgaggatgattttgccgatttggacaaggccggcgcatgcgagcgcctgagccgcgtgctgtcgtttccgaccatttcgagcatggatgccgaggcggtggactggcagccgttcgacgacctgcgcgcctatatgcagcaggcctggccgcacgtatttgcggcgggcgaggtcgaactcatcgaccactcgctgctggtgacgttttccggctccgaccccgcactcaagcccgttatgctcatgggtcacatggacgtggtccccgtggtgccgggcaccgaggacgattggacgcacgccccctttagcggacaggtggacgacgcctacatttggggtcgcggcgccgtcgacatgaaagatcaagttgcaggtattctcgaggcggttgagtatgcgctggcccacggctgggagcacgagcgcaccctgctgctggcttttggccaagacgaggaaaccacgcagttcggtgcgggtgccatcggccgcgtgctcgaggagcgcggtgttgagctcgagttcctgatcgacgagggcgactaccgcatcgttccgactgccgagtacagcgcgggcgagggctggcttatgcatgccgatctcgcggagaagggctacgccgatatcgtgttgaggacgcgtagcgagggcgggcattcctccaacccctacggtggcacttcgctcgaggtgctgagccgcgccatcgccgcaatctgcgatatcgaatggccgacgcgcgtcacggacctgcttgccgcacagctcgtcgagctggggctctacacggccgacgagatcgcctccaacaaggacgccatcgtgcgcgagtgcctcgccagcaagaagctctatccgctcgtgacctccacctgtgcaccgacccaaatcgagggcggtagcaccggtgctaacgtgatgccgcaggatatgtgggccaatatcaatttccgcatgctcgagggcacgagtgtggccgatgtcgtggcccgctgttgcgtcgccgtcgccgaggcggggctcgccgaccgcgtcgagatcgagctcggccctggcagctccgaaccctcgccgtctccgcgcatcggcggaccgggactcgaggccgtccgtgccatcgccgcccgctatttccgcgatccaaaggggacggaggaaaacggatcatcggcggcgggcggagctcctatcggcatcgttccctcgaccgtgattggcgcgaccgatgctgccaactaccagcgcatttgccccgagtgcattcgcttctcggcctttgtggtagacgatgacgagtgcgagcgcggtgtccacggcaccaacgagcgcatcacccgccgcgcctacctccagggcgtacgcttcctcatcgctctgcttcaaacgctctagaatgtgacaaagggactgagccgatttcatcggtaatgagacaaaaactgtcatagaaaaagactaagatatcttaagagacatatgctggggttggtattccttgaacgactgcgggcatgtgccagactgcctcgccccccggggagtgcccgggcaggtcgccgtgtgactggggaggaaattatgcaggagctcagagagatgacgtctcgactcgtgaatattgctaccggggggggtgtctaagcagggaacttcctggtgaacatcggccgcgcgagcggtggtccgtcatgtcttatggccgccgtcgtgggctgcgcccggtttcgccatatgcgattgttctggccctcgccgtcgcgctgacggcgagtttcttcctgccgcttcgtgccgaggcggcgatctccgaccacacggttccgacgacctcgccctcggggacgacgatcaacctgtttgattactgggtgaatcccgatgaccatctgtcggtttccggcagcggcggcgtcaacgcaggccacaagttccagtttaacgacggcaagggtgatgggccgctcaaccaatggacgggcagcacgagcccgcggcccggcatcgtcaacaacacgctttcagacggctacccgaagctttccgaagccttgggcgacgagtccctccgctacctgttcgattcctctgcccagaccggcaagacgtcccattttggcgtgacgggcctcctcaaggttcagggcggctactacgtctatgacagctccgaaaactacgcagcctacaacgctgacaagaatgccttcgacatctatggcacctggggcattgacaaagtgggcgattcgtcccaccagggtcagttcttcccgttcgacgcggcagacaaggtgttcaaagaggaaaacggccagctcgtccaaaccggcatcaaggcagacaacaccggtgattcgcactacaacggcggcaaacccgtcaaccaccacttcggtctctcaatgtccacgcgattcgtgcagcccaagggcggcctgacgaacaataataatgacatgaccttcgagttcgccggcgatgatgacgtctgggtgttcatcgatgatgtcctcgtgggtgatatcggcggtattcacaaccgcgcgagtctgagcatcaactttcatacgggcaacattaaggtaaacgacaattacaacggcacgctgaagagcaagtaccagaaggcgggcaaggccggcgacacgagctgggaaggcaacaccttcgccgacgacaccaaccacaccctcaagttcttctacctggagcgcggcgccaccgactccaacatggagctcaagttcaacctcgtgacggtgcccgagtccgacatcataaagttcgaccaggacggcaagttcgtacagagcgccgagttcgcgctgtacaaaacagacgagaactttacagatacgaccaatgacaagaacgcgctcctcggctccggcaccacggacgaggccggccacctaacgctcacgaacgacgatgacaacggcgtcatcaacttcgacgatctctacaacaagaatcacggtaacaagtactacctcctgaaggagacgcgcgtgccggagggataccgctcgagtctcacggcgacaggtggcagcatgcagctcgagtacgtgcccgcgagcgctgagaacggcgcgggcggcgtcatcatcaaccgcggcggtatggatgcggacagcgtcgtgtggaagactggtgcgtttgccggcgcgaaggagaccatcaccgcaccggtgaacgtgtacaaggcgaatgatgacctgacgaagtccgacgagaccgtcaacctgaagtctggcatactgttcgctgtggtgctcaagcgcgataaaagcgcaaacgcagatatcaaaaatcagaacaattggtacgccgtgtcgggcgacccatcgacgggaatggggtacaccctcgccgagaagccgagcaaggccggcgctatcgaggcggcgaagaaggacctgcacgccttcacgctcaacacgagcggccagtaccaggtagagattcaaaatctgcccggtgacatctccaagtactactacctgctgagcggtgatgcccgcaaggatgccgagtacacggtggccatctaccacacaacggcgagttccatcgccaacgcgaatacggacaacacggtccacgtgttcagcgatgacctccccagcggcgagaagaatttccagcgacagttcgccacgcgcctgctcgtcacgaacatccagaaccgcctgttcgtgcagaagaccgataccgcgggtaagcccgttgagggggcgaagttcggcctgtacacggccgatcaggtgacaacagacgcaaacggcaaggtcgtgctcaagggcgagcagaccccctacgacaccctgacgacggggtcggtcggcaacccggtcccgctcgaaggtgcgggcatattcccgaatacgagcaaggagcacaagccgcttacgaaacgcacctactacctgaaggaaatctcagcgccgagcggtttcctgctcaacgacacgctcaccaaagtgattgtggacgattacggcgtccatgccgatgccggtacgcgcgatgacggcgtttcgacgtttgtgggcccgggcgcgctgatgaagagcctgggccagtttggcgcagagagcgacatcgacaacacgctcacgtggatcaagggtgtgcggcagacctcgaatggtgtgaccgatactgacggtaatctgtcgtggagcaatgtcgatcccgccggtgccggcgacacggtgcacctcaagtacggtgccaacggacgtgtctaccagtatgggcccaccgaggagggcaaaccctaccgcctggagaccgagacgggctggatacgtatgggtatcacccaggacgagcagcccaaggggaccaagtcgaaaggtgcccgtgccgatctgcgcgacatgaacaacctgaatgccctgtttacgggcgccacctgcgtgcgcgtggctaacaagcgcgaggcgagcctcgaggtgacgaagaaggttgacgtgcccgatggactgacgggcaataaggatgcggagttcaccttcaagttcaccgtgcccaaggggaagacgtataaggctgcagtcttcgagaaggcgggcgcggccgatgagaagcaggtcggcgatatgttcgacctgacgaacggacgcgagcagaccatcacggccggccagacgatccgcgtgtacggtctcgccgagggtgacaagtatacggttcaggagctgacccgcgcgggcaagatgccggccggcttcacgctgaccaagcgcgagcagggcggcaacgccctgggcggcgagggcgacagcatctccggcacgatcgcgaaacagaatgccgacggcacgttggccgaagccaacaagctggtgttcacaaacacctacagcgtaaagtcgccggtgacgctcaccaatgcgttctgggcgcagaaggtgctccagggccgtgactggaaagatggcgatagcttcaagatttacctgcgcgcggacaagggcacgccgatgcccgacggtgccgagaatgcacccgtgagtggtatgaagcaggttgtgaagactgttgagaacggggacaagttcgacttcggcgagattgagtacaccaagcccggcacctacacctatctcatcgccgaggccacgccgtctcaaaacgacgctagctggctgcccgggttcgggtattcaagcgcttcctaccgcgtcacggtgacggtgaaggatagcggcgacggcacgctgtcgcagccggcagtcaagatggagcagacctacaccgacgacggcgtgagccatgaggacagcccgatcgaggttgctgacaaaatcgccaagataacgaacacctataacaccgatgagaagaccatctccttccacgtgcagaagacgtatgtcgaccagtccggtgcaaatccgcttgtgaaggataagttcacgttccagctcgaggcactcggcgggatgaagaatgatgccgtgccgagtggcacccttaagttcggcgatcttgcctacagcgtcgatgccagcaaggtccccatgcctatggggtgcacgtccaccacgaccacggcgaagaacgatgacggcggtatcgccgcgttcccgcagatcacctatacgatgggcagcgagaacctcacttacgtgtacagggtgaccgaggtcaaggattccgatacatcgacgtccagtggcatgggctacgatgacgcggtgtactacgtgctggtgaagaaccagcaggttgataacgagtctgggacgggtaggtgcctgtcctccacggtcacgtattggaaggccgacggcacgcagctgacggacgccaacggatacattccgttcaagaacacctacacggtgacccaggcgacgtcggcgccaatcagggtgcagaagacgttcaccgggcgcgcgtgggagacgagcgatacgtttgatttcacactgacgccggcggatgacgccacgacgaaagcggttaaaaacaaggtcgttatccaaaagacgggcacgggcgaggacgttggggatattgctgctaagatttcgatctccggcgatggttcttccgtgacccgtaccgcagcctttggtgtgggcgacctggtgtttaccaagcctggcacgtacaaattcaaggtgaacgagaaggcgtcggagaacgtggacaagaccggcatcagctatgacggccatacgtccacggtgacctacacagtgaccgatatcgagaacggcacgcataccggtaagctgaccgcgacggttgcgtacgacaacaagcaggcgatgacggatgtcgaccgacaggtgacgggcgctgccgcgtttaccaacacctatacggcctccggtacctatgcgggcatcgatgtgaccaagactctggttggtaccccgctgaagaatggcatgttcccgttcaccatcgaggcgatgacgtataacggtacgacggccccggagccggctgataccgataagtcgttcaagaacaccgtgggcaaggatgacggtgacgatacgcagaccgccacgatgtccggcaagctgaagatgaacttcacgcagctgagctacaacaaggtgtatgtgtacaaggtgtctgaggcgcatggcgccaacgctggtggatacacgtatgacaccgagtaccccggtgacgcctacgtgctcattgcggtgacgccgaatccggacaacaaaggccagctctacaccgagacgaccatcgtgaagggcccggacgtgacggcgctcgttggcgagaacgacaacgttgatgcgctgacggccgaggcgattaagggcctcgataccacgaccaactacgtgaagacggtctcgagtcgcaatgcgaagcccgctacgcctaccgtcccgttcaagaacagttacaagtcagacgccagcgacgagctgaccccgcaggtgacgaagaagatctccggtgttgagagcacggagaaggcgttctcgttcacgctgaccgccacggaagagacacagcagaagatcgccgccggcgacttgggtgtgtcggacgacctggcgggcgacgcgcacgcggagtccaaggtcacgagtggcaagatcatcaaggacaagggccagacggtcgacttctcgaatatggcgttcaacaaggcgggcgagtacacgttcacgctcaccgaggtgcacaacgctgatgatgatcccgcggcggacggcgtgcagaacgccggctggacgatggacgattccacctacaccgtcacggtgaaggttgaggacaagaatgccaagctgactgtcacaggcgtgacggtagagaagggcggcgatgacaagagcgagacgcttgaggtcaagaacggcaaggtgaacctcgccaccttcaacaacacctacgacgcaaagggttccgtaaccctggcggcgaagaagcactttacaggcggcacccttgagaaccagcagttctcattccaggtgaaggagggcaataaggttgtcgccgaagaaaagaacgatgccaatggcaacatcaccttcccggccatttattacaccgaggccggtgagcacgactacaccatcaaggaggtcgaaggcgccgacccgactatcgtttacgatggcaagacggtgaaagtgcacgttagcgtcaccgataacaagaacggcacgctgagcgcggccgccacctacgacggcgagaaggccgtgccgaccttcaccaactcgaagccgacggccgacgccactatcgaggcgacgaagatcctcaagggcaaggacctgacggctggtgcgttcactttcggcctatatcaaggcgacacgactacggttgatcccatccagactgtccagaacgacaaggacggcaagattaagctcatcctcaccggtctgaccataggcgagtacgactacacgctcaaggaggtcgctgacagcgattcgaccatcacctacgatttcacggcggtgaaggtccacgtctcggtgaaggcggacggtgacaaggcaaaggcgactgtcacctatgacgacaagaatgatgccccgaccttcactaacaagtatcagcctgccgagaccttggctacactcacggcgaagaaatcgtacgtgaagtccgacaacacgcaggccacgctcaggggcggcgagttcaccttcgacctgtacgagggtgatctgacggctgagcagctgaagggcaagcagcccatccagaccgctaagaacggcgaggacggcaccgttaccttcccggccatcaactacaccaaggccggcgagtacaaatacactatcgtggagcagaagggcgacctgtcccacgtggtctacgacgatgcggttcaccacgccgtggtgaaggtcgtggacaacgccggccagttggaggcgagcgtcacctacgatgacggcaagacggtcgcccccaccttcacgaacacctacaccgcaaagggatccgtggagctgacggcgaccaagatcgttgcggtcgcgccgggcttcacgcacgacaccaagctgaagggcggcgaatacacgttcgagctgaaggacgccgacggcaaggtgctcggcaccacgacgaacaaggccgatggcacggtgaagttcacgcgcaagttcacgctctccaacctgggcggcgctgcgagcaaggacttcacctacaccatcgcggagaagccgggcacggagccgggcatggtctacgacacccatgcgctcatctacaaggtgacggtcgcggacgatggcaccggctcgctgacggccacaccgcaggtaacgagtggagacaagaccttcacgaacacgtaccacccgaaggagacctcggtaacgctcaaggcgacgaagcgcttcacgggtggcgagctcgcagggggcgacttcacgtttcagctgctcgacaaggatggcaacgtgatccagaccgtccagaatgacaaggacggcaaggtcgccttccaggcaatcagctacgacacgccgggcgatcacgactacaccatcaaggaggttgccggcaacgacccgaccgtcgtgtacgacacgaaggacgtgaaggtccacatcaaggtctccgatgagaagggcgagctaaaggcgaccgccacctacgacggcgaggccgacgttccgacctttaccaactcgaagccgacgacggacgttaccgtcgaggcgacgaagatcctcacgggcaaggacctgacggccgacgcgttcaccttcggcctgtacgaccaggccggcaacgaggtcgccaagggcaccaacgaccggggcggcaaggtcgagctggccgtcaagaacctgaacctgggcgagtacgactacacgctcaaggaggagaaagccggccagaccgtcgacggcgtggcctacgacgccaaggaagtcaaggtccacgtcaaggtagagcagaaccagggcgacaacaacaagacgaaggtgaccgtcacctatgacggtgccgctacggctcccaccttcaacaacacctacgacgcaaagggttccgtaaccctgacggcgaccaagaccatcaaggttgcggacggcttcgaccacacgacgaagcccgcggacggcgagttcaccttcgacctgaaggacgctgccggcaacgtgctcgacaccgcgaagaacgatgcaaacggcaaggtcagcttcacgcgcgagttccagctctccgacttggacggcgccgcgagcaaggacttcacctacaccatcgtggagcagccgggcgcggagccgggcatggtctatgacagccatcccctcacctatacggtgacggtcgcggacggcgggaacggagcactgaatgcgaaggcgatcgtgacgagcgcatccggctcggataccttcaccaacacctaccagccggccgcgaccggcctggccctcggtgcgcagaagagctatgtgaagaaggacgacaacacgccgatcgtccccaagtgcggcgagttcaccttcgatgtgtacgagggcaacctgacggctgagcagcttgccggggccaagcccgtccggaccgcgaccaacggcgcggacggaagtgttaacttcgacgccttctcctacgcgaagccgggcacgcacgagtacaccatcgtggagcggaagggtgatctggcctacgtgacctacgacgccgcggtgcaccatgccgtggtgacggttgcggacaatgccggcacgctgcaggcgagcgtcgcctacgacggcacgaatgtcacgaagcccagcttcaccaacacctatgaggcacaggcgacggactccggcgcgatcgccctcaccaagagcgttgacgtgcacgacggcagctatcagctaaaggcgggagacttcgccttcgagctggtggggtctgacggctcggtgatccagacccagaagaacgatgcgcacggcaaggttgccttcgacaagctgaccttcgaccatgcgggcacctttacctacacggtccgcgaggtgcagccgacgggggacgcgccgggcgtgccgggcgtgacctacaccggcaagacgtacaccctgacctacgtggtgaaggacaacaacgacggcaagctggtggtagagaactccacggtgaagccgagcgagggcaccgagaacggcgtcacccccaacaccatgacgtttgcgaacagctaccagccgggcgcgacctcctaccagatctccggcaccaaggtgcttgagaataccgattcggccaccatgcggacgcccgccgatggcgagttcacgttcgcgctgattgacgtggccaccgggcaggagatcgaccggaccacgaacgtgggtaacgcgtttaccttcaaggccatctcgtacaccgcgactggttcgcatgcgtaccaggtgaaggaggttgcgggccaagatggcaccatcacttacagcgatgcggtgttggatgtgacggtgagtgcgaccgacgacggcagcggccagctgaccgcgacggcgaacaagacggccgcggatctgaccttcaccaacacctacacgccgacggcaacgacggcgacgattaccggaacgaaggccctgaccggccgcgacctggccgagggtgagttcttcttcgacctgaaggacgccgacggtaacgtggtgcagacggtgcagaacggcgccgacggcacgttcggcttcgcgccgctgcagctggacaaggtggggacgtacgtctacaccgtgtccgagcgggcaggggcgacggcgaacggcgtcacctacgacacgacggtctttaccgcgacggtgacggtgacggagaatgcggagacgcacgcgctggaggcgcaggttgcctacagcaagggcggcaaggctgcggatgcggtggcgttcagcaacagttacgcgccggccgcgactgaggtgaagctgggggcctccaaggtgctgagcggcgaggacctgaaggaagggcagttctccttccagctgaaggatgccgacggcaaggtgctgcagaccgcaaagaacgcggcggacggcacggtgggcttcgaggcgatctcgtacgacaagcccggaacgtacgcctacagcatctccgaggtggacgacggtcagaagaacgtgacgtacgacgcggccgagcaccgggtaacggtgacggtgacggacgacggtgcgggccatctggtggcgacggtaacctatgacggcgccgtggcgccggtgttcaagaacacgtacacgccgccgaccaccccgccgacggagccgcccaccaatccgccgagcaagtcaccggtgccgaaggaggagaagccgggtctgccgtatacgggcgataccagcttgtcgccgatggccctgggtggcatcgcgggcggcgcggtggtgctgatcgccgcaggcgttatcctgcggcgccggaaccggtagctacggcggccgagaagggctttgattgagggcgggtggtcgcagggcgcggccgctcgccctttttggtgaaaggctatgttaacccgccgtttgcacgtccggctccagatggaactcgtactccggctccatcatcttcttccggatcttttcgtagcgcccgtcgtcgagctgctcgcgcatgagcgacgtcctgtccccgacgcgtgcggcctcgcgcagccatctgaaccacatcaggcagctgtggagcctgcgggtcgatacgcccttgaacctctcgaggaagtggccgagcgaaccctgcgcttcagcatcctctggaccgtgtcccgctcgtacccggtgagcctgccgtgggtcctcgggaccgccctcgcggcgcccttcccgccctttccggacatggcgtcctccgatctcccggggccggccgatccggccctcagggtatcggattcccaaatttatccgtatatgtgcggatgaatgcgggaggcgttcggatgaagttgtattcaaggaaagagactgaccctttgtcgcattccgtgcgggttatatgcaggtatgcctgcgcacgctatcatgtatgggttagaccgcaactatgtacctcatacgcgaagggatgcgcatgtatctgaagatcgacatgttctagctgggcttacccccgcagtggcgccgcgcgccccatcaactctgccgattttcgccttcacgcacataaaggagtcccgccatgcgcgacaagctcgaaaagatcattaaggcctacgaggagctcgagaagaagctttccgacccggccgtcgcctccgacatcaaggagttcacgcgtctcaacaaggagtacgcacaccagtccgacctcatcgctgcctcgcgcgagtacatcggcgcgctcgatgacatcgaggccgccaaggagatgctccgcgacaccagcgatgcggacgagaaggagatgctccagatggacatctccgagaacgaggaaaagcttccccagctcgaggaagacatcaagtacatgctcatcccgagcgaccccaacgacgacaagaacaccatcgtcgagattcgctccgccgccggtggcgacgaggcagccatcttcgccggcgacttgtacaagatgtaccagcgcttctgcgaatcgcgcggctggaagaccaccgtgctcgattccagccccagcgaggccggcggctttaagtccatcgagttcaaggtcgagggcgaccgcgtctactccgtcatgaagttcgagtccggcgtgcatcgcgtccagcgcgttcccaagaccgagtcccagggccgcattcagacctccacggctaccgtcgccgtacttcccgaggccgaggaaattgacgtccagatcaaccagtccgacctgcgcatcgacacctactgcgcctccggccctggcggtcagtgcgttaacactacctactccgccgtgcgcatcacccacttgcccaccaacaccgtggtgcagtcgcaggagcagcgctcccagattcagaaccgcgaggtctgcatgcagatgctgcgtgctcgtctgtacgagatggagctcgagaagcagcaggcagagcttggtgctgagcgccagagccagatcggccacggcaaccgttccgagaagatccgtacctacaaccagccccaggaccgcgtgaccgatcaccgcatcggtttcaactccacctacaacggcgtccttctgggcgatcagctcggcaccgtcatcgaggcgctcgccgccgccgagcgagccgagaagctggcgcaggccgtgtagtaggttccgccgttctaccgaacggcggaccggccgacgctgcgcgccgcccagagcgacaatttgtcattcaaaaggcaaggcatgaccagaaggtctatgccttgcctttttcattcaagactttagtccgctggccgcgcagcggccagctttaaaccacccgctacgcgcgattggcgaaaatgcgttggtggaaatggtgaaaattatattgacgctaacagatgcgtctacgacaggccgtgcaccgacctgttcttcgatgtcgtcgacaggcgctacgagaaggaggggccgaacgcgatggtcctcacgagcaacatcgccccgagcgggtgggatgagttcttcacgggcgacgacacgctcctctgcgccctcgacaggctgttcgacaaggcgtcggtgttcgtgatgcggggcccgagctaccgcggcagggagcttgacacctactcggtggaggccgtcccccaggcggtgaaggtgagggggatccagcccgaggggatgtaggaatgcgataggaaagtcatagatgcgggcgtgttggctaaaatgggtcggccgggattggtcaatctcggccgactatatttggctaaattattccggcgctaacaattcttaatgctgatcgggtgctgccgttgattggcccgggtattctcgtagctgacgccgggaatctggcgtgtttcgtcaagaggatttgagtaaaaagagcatcgggatttgagctgggcgcgctccggtcgtgcgcgccctttttgaggcatttacccctcctgcatgagggcgtgacgcacgttgcaggactccctgcggaactggacgagccttccgtggtggacgatgtagtctatgacggcggacatctggtcgtcgccgaatgccgatccccacctgctgaactccaggttcgtggtgatcaccgccgactgcctctcgtgggcgtcggcgaagacctggaagaggggcctcgcgccgtcccgcgtcgagcggcgggacacgacgtgggcccattcgaggtcgtgaatcagtagcgatcccggcgctatcctgccgcccatggcatccctcacgcgcgccgaactgggcttcccgtggccgcagacgaccgcgacggggttcttgtggatatcgatggtgacgcaggtgcagagctcctggcgggagaggccgcgcttgagggcttgcccgtagcccttggagaggtcggtgtcgctgatgcagatctcgtcaacccagacggtgtcgcgcatcatgattcggtcccggcagccggacgccgtggtgagcgcacggtgccgccactcgaaggcggtcttgtggttgacgccgcacagatcggccgcgcactcgacggggacgttgtggcgcatgagcctgatgaaggagactcaggcgaggagcggctttctgcagtgctcgaggacggtcccggtgagggagttgaatctcctgccgcagcagcggcagcgccacctcggtactcctgctgcggtggacctgtcccttcaggcgccctcggcgccgcactccgggcaccccgggtccggccagtatgccgcggcggccacggcgagcgtgccgaccccgacctcgttgcggcagtgcctctcgccgacggcttctctgagcagcaggaactcgtcggcggtgaggcccgccacgagcgccctgaaggggttcgctctttccatatggatctttcccatccgcccgagcgcccacccggagggattgtcgccaaacaaagatccgggtgggcgctcgggcggattctttgtttggctgggaagagcataacattcgggaaccttccggtccccgaatcatcacctgttatctaaactgttagagacgaaaaaaagcttgctgagtacgcctgctactttttataagggcaggtgtccatctgcttttagaacaattcccatgctttgaataactggacttccgatgcgggggagattgtaagataatctacccttagtatcattatttgtgatgggggatacgatatgaaaaaggcattgcgtgcctcaacagcgttttctttagctgctcttttaacgatttcacccttgatgagtcctgtagccgctgcttatgctgcgaatagcgtgcaagctgaggatatttcatcagatgctgtgtccgcagacgatggtgtagcttcacgcgacgagggcgttgccgacggagacatggatgtcgagcagtcgttgccgacggacgttgacgagccagctgatgaggatttcggtgtagatgcttcttcgactgagccgcaaaccgaatcggctgattctccttttcaatatatatatcttgcctacccgaaccttatcagtgggactgaccaagtcgtcgcgtttgcgactcctaatgacagcgatactatcgcttccgcgacacttaactatgtgagcgccaatggagttcagggggctgttgacgcttccgcacaggatgctaattctgctgcatttacatttggctcggagctagaactcaatacatactttcttacttcaataacctatgttctgcagggcgatggtactgaacatgagattaatctctctgacagagattattcttttacggttgttgacggcactgctaattgcgaaggcacttccgtttactatgcagacggcgatggcaatgccgttgaggcccaatcgatcaagcaggcgttggagtgtgccgattcaccggacggcatttctacctatgctgcgcgctcggcgcgaaaaaacgttcggataattgccctcgatgctggccatggcggcaccgaccctggtgcgcagggaaatggaaagagtgaggcggatctaacttggaagatcgttgctgcttgtaagaataagcttgaggcgtatggctttaaagtcgttcttgctcgcgagcaaagcggtggctactcaggaaatgattacctttatcgtgtccaacgatgcgtgagtcaaggcgcgcaggcctttgttagcttccatatcaattccggttcgcctgttgctcacggcgccgaggtatatgcgcccactgccaatgaatatgattacacgcaagtttctgtggagcttgcgaataaagtgatgaacaacctcgcttctatgggactcagctatcgcggtgtattccaaatggaagttggagatgagtttgcggtcatccgttgcgcccgcgaacaaggtattcccggcattctaattgagcatggctttatttctgatgcgggggacgtattgaattattttagcgatgagggttgcaggcgtcttggcgaggccgatgccgatgcgatcattgcgcaatttcctaagtcaacttggctcgattactcttccgtattcgatgctaattactatttgtcgaataatcccgatgttgccaaagctacggctggaaatagtgaattagctctagaccattttattaactatggtatgagtgaaggtaggcgcggctctgcttcttttgacgtacagagctactttaatgagtatccagatttaagggctgcctttggctttgatttagtgaagtactacgagcattacgtcacagctggaaaagcagaaggaaggcatgggaccggatgctcaaagattgagggatacgctacgactatcaatggcgttgactattcttccgtctacgacccctcgttttatctatcgaataacgaagacattcgcaacgctttttctaaacgaagccccgctggcgttgtaatgattgacgatgctgccgtgctgcgccatttcgtcagctgcggcatggcggagggccgtcgcgggagcgagtccttcgacgtgctgagctattacaacagataccccgaccttcgtcgcgcattcggtgccaacctcaccgctctatatagtcattacctcagcagcggtcgcgctgagggcaggatcgcgaccggttgcgcttccctcgcgggcgccgtcgcttcgcagggcggtacggattattcccccgtttacgatttcgacttctatacctccaacaacggagacgtcctgagcgcctttacaaccgtcaagggtggtctgaggttcgttgacgatgctgccgtgctgcgccatttcgtcagctgcggcatggcggagggccgtcgcgggagcgagtccttcgacgtgctgagctattacaacagataccccgaccttcgtcgcgcattcggtgccaacctcaccgctctatatggtcattacctcagcagcggtcgcgctgagggcaggatcgcgaccggttgcgcttccctcgcgggcgccgtcgcttcgcagggcggtacggattattcccccgtttacgatttcgacttctatacctccaacaacggagacgtcctgagcgcctttacaaccgtcaagggtggtctgaggttcgttgacgatgctgccgtgctgcgccatttcgtcagctgcggcatggcggagggccgtcgcgggagcgattccttcgacgtttatggctatcgaaatcgttatgcggacctgaggaaggctttcgggcagaacctgaagagctattacatccactatttaaattgtggcattaaggaggggcgtaatggtgcaagtgcgactggatacgaaggttttattatgtcgtccgcctattcaacctatctagatgccgctgatcatttcacaaagaccgtgggcccaaaaggattcccttcagccgtttacacggataggggagcgtcgaacatcatagatttctgcaaaattctatatgaagaggctcagtcggagggtgtttcacctgaagttttatatgggcaggtgatgaaagaaacgggatatttgaagtttggaaatttggttcagcctaatcagtgcaattttggaggccttggcgccactggacctggtaacccaggctacaccttcggatctgtccgtgagggactgcgggcgcaggttcagcatctaaaggcgtatggttcaacggagccattgattaatccgtgtattgatgctcgctttaaatatgtcagtcgtggctgtgctccgagaaccgttgatttaaatggcaaatgggccgttccgggtgttggatacggcgaaagcattgatgcaatcgccaaagaggttattggttaggctttaaaaagtagattgaaagttttaaatcgattgggttaatttgactgacaatttaaagaaaaacatcacatggaataccgttggctcgattgcataccttgcttgtcagtggttaacgacagttgccgtagttcgtctttcatcggattttaactatgcaggtgatttgtctttggcaatgacaatcagcaatctatttgttccaatcggtttatataagattcgatcctttcaggtatccgatctttcatgtgagtattcttcgggggaatacattggttttcgtctaatcacaatagtgttggggtttgttttcgtattaccttatgcattctttacctgtcagcagtcttcccttctccccgtgtacttctattgcatatataagtcaatagaagtgatggtcgatgtgttccacggcattgatcaaaaagcaggaaatatgatttattgtggcatttcgatgctgctgagaggcattttgtcacttctcgcgttttgtgccggaatgcatgtctcacattctcttgtattgagcatcgttctaatgattgcggtgtctctccctgtaatggttgttgatgtacgttgggcttcgaatttcgatgcgattgttccttcttttaggttcaaggcgatgtctgaactgttttataagtgtcttcccgctacggttggggttttttgttgcgctgcagttacatctgtttcgcgtcaagaacttgctgctgcattgggggcatcaatgttgggtgtttattcctcggtgtgttctcccgcggcaatagttcaggcgggtgctgctaatgcctatgcccctttgctcggcgcttttgcgagcgctagtgagtcggaggataaaaaagcatttaataccatgttggtgaaggtcattcttggcgcccttgtcttgtgtattcttattttgttcgcttgtttcatctgcggcgactacttgttgggactacttttcggtgaccaaattcatcagtattcttttttgctgtacggtgcggtaattagctctctgattacggcgtttatcggtttcttttccgacctgacaattgttaaaagaaagatggttggtaatcttgttggtaatttagttgctttaatcgttgttgtccctctttccagcttaatgattcacttgtttggacctaacggaacgagtattgcaatttcgcttgcttattttgtcgggtgtgtcgcgatgcttccctgcattattcggaataatgcagtagagattcgctaaatacttagatataaaagtgtgcggccggtgcttaatatctacctgaattgacttctttaacgccaatggaggggttatcagttctggcgcaggtattaacgctttttaattctaatttatgcccagcaggcgtcttttcgtttagcataagacacgtattagtaggttaagcaacaacttcaaatttgtttaagtttcattcaccttaattttgtttattggagcttgaaatgtgcgatagcgtattcaaagacaagaccctcatgatcacgggcggcaccggctcgttcggcaacaccgtgctcaaacacttcatggacaccgacctagccgagatccgcatcttctcccgcgacgagaagaagcaggacgacatgcgccaccgcctgcaggagaggtcccccgagctcgcgtccaaggtgcgcttcttcatcggcgacgtccgcgacgcccagagcgtccgcgacgccatgcacggcgtggactacatcttccacgccgccgccctcaagcaggttccctcctgcgagttcttccccatggaggccgtgcgcaccaacgtaatcggcacggacaacgtcctgcatgccgccatcgacgagggcgtggaccgcgtcgtgtgcctgtccaccgacaaggccgcctaccccatcaacgccatgggcaagtccaaggccatgatggagtcgatcatctacgccaacgcccgcaacggcgccggccgcaccaccatctgctgcacccgctacggcaacgtcatgtgctcgcgcggcagcgtcatcccgctgttcatcgaccgcatccgcaagggcgagccgctcaccgtcaccgaccccaacatgacccgcttcctcatgaacctggacgaggccgtggacctggtgcagttcgccttcgagcacgccaaccccggcgacctgttcatccagaaggcgccggcctccacgatcggcgacctcgccgaggccgtgcaggaggtcttcggccgcgtgggcacccaggtcatcggcacccgccacggcgagaagctcttcgagaccctcatgacccgcgaggagcgcctgcgcgccgaggacatgggcggctactaccgcgtcgcctgcgactcgcgcgacctgaactacgacaagttcgtcgtggacggcgaggtggagacccaggccgacgagtcctatacctcccacaacaccgagaggctcgacgtggcgggcaccatcgccaagatcaagaccgccgagtacgtgcagctggcgctcgagggccgcgagcacgaggcggtgcagtagggtgcgcatactcgtcaccggcgccaggggcttcgtcggcaggaacctctgctgcgccctcaagaacataagggacggcaaggaccgccgcgagaaatactcgggcctgctcccgctcgagattatggagtacgacatcgactcgacgcccggggagctcgatgactgctgctcccgcgccgacttcgtgttcaacctggccggcgtcaaccgccccaaggagcagtccgagttcatggagggcaacttcgggttcgcctccacgctgctcgacgccctcgagcgccacggcaacacgtgccccgtcatgctgtccagctccgcgcaggcgagcctgtcgggccgcttcgagggctcggtctacggcgagtccaagctcgcgggggagggcctgttccgcgagtactcggagcgcacgggcgctcctgtcctcatctaccgcttcccgaacctctacggcaagtggtgccgacctcgctacaactccgccgtggcgaccttctgcgacgccatcgccaacggccgcccctacaccgtgaacgacccctcggtcgagctggagctcctctacatcgacgacctggtcgacgagatgctgggcgccctgctgggggaggaacaccgctgcggctacgagggcctcgagcgcgtcgagggggaggacttctgctacgtcccccagaccgacgtgaagtccctgggcgagatcgtctacctgctcgggtgcttccgcgacagccgcgagacgctttccgtgcccgacctggcggagggctccttctccaagaagctctggagcacgttcctgtcctactacgagccggggcacttcgcctacggcctcaagccgaacgtggatgaccgcggctcgttcaccgagttcctgcgcacgccggagcgcggccaggtctccatcaacgtctcgaagcccggcatcaccaagggcaaccactggcacatgagcaagtgggagaggttcctggtggtctccggcaccgcgagcatcaagctgaggaaggtgggggaggacgccgagggcaaccagttccccgtcgacgagtacgtcgtctctggctcggacatgcgcgccgtggagatgattcccggctacacgcactccatcaccaacctgtccgacaccgaggacctcgtgacggtcatgtgggccaacgagccttttgaccccgagaaccccgacacctactacgaggaagtctagaggttttgaccagatacgctcacattaatagcgttccaaatggatccactgggcgcattatgatgaaggagcattttgctcttatagatcagggatgcgaatcgcttgcttgctggggtagaagaaggccagcaagtagtgccagtgagtactgctttgggtcatcggctaattttatactcgacgttggacttactttccttgacgggaagattggttttcattcagtgaggcaaaccgaggcgttgattcatcgccttgatgagtttggtcctgatgtggttcacttgcacaacattcatggttactatttgaatattgataggctatttaaatggttgtcgatatctgattgtcgtgttgtatggactttgcatgactgttgggcttttaccggccattgtccgtatttcacatatgctgactgcaatcaatggaaaagcggctgcggtaccacgaaatgtccacagcttatgggatatcctccaactatcaattctggttcatgcaaatggaattatgaggctaaacgttcgttattcacttcgttgccttccgaccgattgacaattgtcactccttctaaatggttggccgaactggttgcttcaagctttttgtcaaagtatccgatagaagttgcacataatacgattgacctcgatatattcaggccgcgatccaatggcgaagtatctagtgttaaagagaaatacggtctcgattctagaaatattattttaggtgttgcgtctccatggtcaaaacgcaaggggttatcagacttttatactctcgctgacaggcttgatcgctccaagtattccatcgtactcgttggtttaagtgccaaacagatgcgggcgctgccgccagagatcgtcggtattccacgaaccgactctcagatagagttggcctcactttatagttctgcctctgttctattcaatccaacatacgaggataactaccctacggtcaatcttgaggctgaggcttgtgggctgccagtcgtttgttacgatgtcggcggatgctctgagactttgcacagggacgattcgaaacttgttgaatgtggtgacgtgcaggccgcctcattactgttggcaaaatactagactctgttttaaggaaacctatgaattccaatatttgttttaaagacgacggccgcctgaagctcctgatcatcgtgggcacgcgccccgaggtcattcgcctttccgaggtcatcaagaagtgccgccgccacttcgactgcctgctggcgcacaccggccagaactacgactacacgctcaacggcatcttcttccgcgacctgtcgctggacgatccggacgtctacctggacgccgttggcgcggacctgggcgagaccgtcggcaacatcatcgcggcctcctacaagctgatggtccaggtgcggcccgacgcgctcctgatccttggcgacaccaacagctgcctgtccgccatcgcggccaagcgcctgcacatccccatcttccacatggaggcgggcaaccgctgcaaggacgagtgcctgcccgaggagaccaaccgacgcatcgtcgacgtgatctccgacgtcaacctggcctactccgagcacgcacgccgctacctcaaggacaccggctgcgcacccgagcgcacctacgtcacgggctcgcccatggccgaggtgctgcgcgccaaccttgacaagatcgaggggtcccatatcctctccgagctcggactggagcccaggcgctacatgctgctgtcggcacaccgcgaggagaacatcgacaccgaggcgaacttcacgagcctgttcaccgcggtcaacgcgctggccgagaaatacgacatgccgatcctgtactcctgccacccgcgctcccgcaagcgcctggaggccaccggcttccagctggacccgcgcgtgcgcatgcacgagcctatggggttccacgactacaactgcctgcagatgaacgccttcgccgtggtctccgactccggcaccctgcccgaggagtccagcttcttcgcgagcgtcggccgcccgttcccagcggtgtgtatccgcacctccaccgagcgccccgaggcgctggacaaggcctgcttcacgctcgccggcatctccgagaggggcctgctccaggccgtccacaccgccgtcgagctcgatgcggaggggtcgctgcccgaggcgcccgtgcccgattacgccgacgagaccgtgtccaccaaggtggtcaagatcatccagagctacaccggcgtcgtggacaagatggtgtggaggaagagcgtttaatgactagctcatgtgctggtaagaaaatgcttgttgttacgcagcatttctatccggaatcttttcgaattaatgacttggtgaggggatttgttgaagacggaataagcgtagatgttctctgcggcatccctaattatccttcaggcgaatggtctgatggatatggttatttcggtcaccgccgagacgattatttcggtgcgtccgtttttcgatctggtgaaatccgtcgtaagggtaatacttcgatacgcatttttctgaactatattagctggccaattactgcttcttttagagctatgaggctcaaaaagaagtatgacgttgtattttgctataacacaagtcctattttgatggtaattcctgcaagggttgctgcatggcgaaataaatgtcctctagtaacttatgtcttggatatttggcccgagaacctttacacagtcttgaatgtccaaagcagttttctgaggtcttttgccaaatctttttgcgacaagcagtatgcggcctgcaataagctgattgctttgagcgactctttggctgataacctgtttcatagagtcaagcctttgaattcggatgtttcgataggcgtaatacctcaacattgcgaggaaagttacgagcaaaagctagtctcatcggaactaagatctcagttcaaaaatcaatgcgtcttcctatttgctggttctataacccccgcccaagggcttgatacggttattgaagcattctcgcgtgcagtttcagagaactctatcgagatgaagctgttaattcttggcgatggcatgtctagggcagaactgcagaagctcgtttcaagcaaggggcttgataagtctgttttgtttttggggcgcgtggatcccgaggtcgtgcccatgtactccgatattgcaacggcaatgattgctccatttgccgataatcctgagttagagcttactattccagccaagatatcaagctgtatggcttcttcaaaggcaatacttgccgtaatgcgcggagaaggggccaatgcggttcgttctgctagatgcgggtttgtctccgatccttcagatgtaaatgcgcttgctaacaacatggtaaaaattggttcaatgaaaaaaggcgctattgatgctttgggatctaatggcttcaattattatcgtgagcatttttcgagacaggtttgtttggataaaattaagcaggttttattttcaatttaggtccaatctggatcgttggggttttaatggatgacatgttgcgagtgttggtaatcattcctgcttataatgagcaagccaatattgttcagactgtttcatcggttgttgaggctggctatgattatgttgttgtgaatgacggctcaaccgataatacgctatctatctgtcgtcagtacgactttaatgtccttgatcttccgcaaaatttaggcattggtggtgccgttcaagccggtcataaatatgcgctcaggcaaggctatgacgttgatgttcaggttgacggtgatggtcagcatgatccttcttatattgggagcttaatcgagccaattattgatggtgccgatttagccattggttccagatttgccgtgcccacagaaggctttcaatcaacatttttaaggagagtaggtatccgatggctttctggttggttgagattatttaccggaaaaacgattaaagatccaacttctggatttcgcgcgtgcggtaaaaaggctatagacctgttctgtagggactatccagacgattaccctgagcctgaatctattgcagcagcattaaaaaccggtctttcagtggttgaggttcccgtgcttatgcgtgagagacagggtggagtgtcatctatttctggcttttcatcaatttattacatgattaaagtttcgctcgcaatttccatggcctgttttgtttatagaaaggcggctcaccaatgagtatgataattcgcgtgggcgctggcgtaatttttagtggtctattcttttatgtcgtttctttagtcggcaaaggaaagcttcttttaaagtactcgttactatggctctgcctgtgcgtggtggcattatttagcgtttgctttccggagttgatttatcgaatttcagattgtattgggtttatcagtccttcgaatttcgcctttctcgtcgcagtagtacttttattgatgatttctctatctctcagtattgcgatcagcagactcgttacggcttgtaaaaacttaactcaacgcattgcgattcttgaaaatgagaacgatactttgcgcaaccagcagggttagataaagatggagtttaataactcgtatgaataagtaccttacctcagaagaccgaagcaataatttgcataacgataattttcatctttatcgggctgcttgttttgcgctatcttttttgtttgcgcttatttacttatctttatttgttaactatgtttgtagcttctacggaaagatcggtgttacaactgctagctcgctgctcaataacggtatgtctgttctcatcatcggtggattgaccgttgcgtttttattctcagcaatcaagctgatcgagtataaaagcgattttatatataaatatcgatggataatcggtatttctgtcgcaatgcttgcggtggtgtttaaagtcagcggctcatcgcttggcatgtggagcattatgcttcctgagaacgccgggactcccatctggggtatacctaggtctcttcgaagcgatgagttttcagtcggtactttatttcaattgtctcagtctcataatgattatgcgccaatttcggaaatcttaagaggagatataacagatgtccggatggtttatggtgctgcctgctggagtgtaatttcgttatttcgtccagtgctttggggctatttggtatttggttttgaatcgggtttagcgtttgcttggtccatgaagctatgcattatggtcctggtttcctttgactgcgctttcctcatgattaaatcaaagccactcagtttgctcttttcaatattgctttgtttttcgccgctgattcagtggtggggtacaggcgaggtggttctttacggtcaagcccttgttttgttattagataagacgctctttactcgtaaaaggagcactagagtcattgcgattgttgctattgcatggttatgcggttgttacataatgctcatgtatcccgcttggatggttccttttttctacatttttgccctcatgggagttttcagggcaattgattattgtcgaatccttaagtctggcgagtaccgttcggtgcttgcgtggtcaattagtgacactttaacttcgatcttctgtttgctggtttcggcaggacttgtatttttagcttttttccagtcctctgaagcaatggcatctgttgttaatacggtttatccgggcgcgcgctttgaaaccggaggaagcgggcttcccgaacttttttcgaatgcgctttctcttttttatgcttttgatacgcctttggtttcaaatgaatgtgaaattgccaccattctctgctttttccctcttgggactcttgcgtctctgtcctgtatcatcaaaaagcgagattggcatttaattgcactactagtccttcagttatttttccttctttttgccttcgttggcttcccgtcatttttatcccgaattaccttgatgtataacgtacctgttctgcggcttttatttcctattgggtacttagagcttcttcttttcttgatatctgttaaaaaagccaaagaattccaagaggctaatagccaaattagttctttgttggttttgctagtgattggaatctgtttaagttcagtattccagatttatattcttctttccgccaagtatcttgtcgcaaggaaattgtatcttttgatgctgatattgctttgtgcagtttcctgccttttgttcagcgcatttatccttggtaaaaactgcattggtttatttgtcgcatttgctatttgcttcggtgtaattcctggttgctgtatcaatccaatacaaattggtgcagctccgcttaccgaaacggagttggcgtctcttgttgatcagttcgctgacaaggatgattattcagttaaatgggttgtcgatggttcttggacagttgccaatctttgcgctgcgtatggagcgcctgtaattaactcgaccaatgcttatcctgatctggcgcgttggaattctatcgatgataataacgagaatgagtacgcatacaataggtatgctcatatcattgcaaatgtattcactccgtctacgtcttttaattccactcaggatgatctcttcacagttaatttgactgaagataatctaagacagcttaatgtgaagtacgttttgtctagtagggatttgacggagttttcatctgatcaactgcggattacgcaattaggttcagcaaacggattcgttctatatgaaataacctattaggaagaatggggctgtcggttaaccggcagccccattctccattctttacgtgctcatgagttaagcgtcatgacacttttatatttgataatacagatttccactgacgatatttatgtttatatacggatcgcctttcacgtagtactctggccataggtagttgagcaatgagtattcccgatggaacctcattttcttttcatcgctgatctcatagcctcgtgataacgactcgtaatgatacagctcagtatcgggtgtatatacaaccaaataattgtgactcctcactttgaggcaatagtcaacatcattaaaggcgacagccaattcttctctaaagccgccgacttcgtcgaaaacagctctctttgtcatgaggcatgctgcggtcacggcacttaaatcttgtgtacgatcgcatagattgaagtagccccatttacctctggggtagtcttttccgaggtggccggctccaatccctccgatgccgacgcctgcatgttgcagagtattatcgctgtagaaaagtcttgcaccaacaatgccaacttcttttcgcgaacaaatgcccagcatgttttcgatccagtttggggttataacttctgtatcgttgtttaacaagagaagataatcgccctttgctttgctagcgccaaagttcatcagttttgagaaattaaattccgcatcccaatattcgatgcgaatcgtatcgggatagcttttctccaattctgagtagtactcgaatgtttcttggttctcgctgttgttttcgataatgatgatttcgtagttatcgtacgttgagcgttctatgatcgacttaatgcacgtatcgagaactgtgggatggtcctttgttggaataacaattgaaacaagtggatgactttccggaactgcataggcaactttataagtgaaggggtcgtttccgcggtaaactttcgctgcaattccaagcctgtccaaatgggcctgtacagctttgacgccagcatcccatgcatatagctttgagttcgggtcacctgcagttgagttctcgctaattctccagtgatacaggattttagccacgtgcaccacatgccgtgctttttcgattgccttaagcgttaagtcgtggtcttgggctccatcgtactgttcgtcgccgtacccgagagaatcgaatagcgtttttctgattgcaaggaaatggcaaatataattaacgcttcgcagcaaatcgatgcttaaatctggcttaaagaacggatcgccatagctgccattgacaaacagtttgtcttcgtcgcagtaaattagatcagtattgttttcagcattaattgcatgcgcatattcataaagcgccgagggctcgagagtatcgtcgtggtctaagaagcaaatgaaatctccatttgcttcttttgtcccagcaagagtgtttttggaaatgccggcattgtttgctagctctatcaccttaatgcgagcgtctttaatcttagcggcttcgattatatctgcaagcgcactgttatctgggcttgcattgactagcacaagctcccagtttgcatagctctgtataagaaccgattccaccatttccctgaacagattttcgggtgtgttgaataggggaacgacgatgctaaacaaaggcatttccttgaaggtaaccatcgattgtttttcgagtatcgccgagcttgccttgtgttgctcgagccaatttggatatgcagatggatcaatcgaaataggtttcattttcgatgtggttaaaatgcgtagcttatcgagctcttcgttgtccacaacagcgaagctgttaaagcttgggtggttgtcgtcttcgattgtgaagataagcctatttgtgctatttgggattcggaccgagtattgaatttcgcgacgttttttattgggagcaaaccacaaggggatcgtaatgtcatcggttgtgatcggctcgatctcaatacgattcatcgaggtatcgaagcagctgatggctattttgttgtcttcgcgctgaggaagttttactgagcagcgaagaatggcctcatctccatcttcgataaactcgtgaaaacgcatgcttgctacatccaagtcgtgcttatcgtcatagttcctaatggaatgggacaaatcattctttaatttatagtttaatcttgacgcccattttgccgtgctaaagctgattttaatgacatcgtagacgcatcgcgcactcaaatcattaatctgaatatcgcaatcaccagttccaaggtcgggaagaactacgacgtattgatttttatttgactcgtatggatagatagagcttggtattgtcgttccctcgctcttcgctgctgtcacctgaatatttgatgcgtctatctcaacattctttaggagaacgtacacctttccgcttccacggcaaatacaatccatgctaattttcatttcaatttacctttccgttgcactgaggatgcctgcactatttcactttgatctcaggtttattcttgcattgaattaatccagtacaggtagtctctcgattctttcttggtaccgaatacgcgccgctgttattcgacgttcatgccatgtggccatagttgaattgctttgctcgtcttgcggatgaatgttttcatatccaattggatgcatatattctttaggatttgctatatacatttgcgctgcctcgagatttgcgctgcacctacttcttaaatctggatttccattcagaagagagccgatagaaaaatgtggatgtgcaactcgattttcattaatgccgattgcgatgaaatgttccagcgctccaagggggtcgtctttatatctatcgaatagatcctcgtaatgatttacataaaaggaacaatcaaataccgatgaatagtctactccgttaaatatggcattcgtagagcacgagcatgtaagttgcggtctccttcgaggccacgtgctttgatcgatcgtgagggcctctttattaattgggttaaagatgtggcattcatagcatttaatgccttcctttttaaggaaggcattaaacagtcgttctgagataaagccaggcatcctttgttgatagctatcgcgaccacttatatagtcaatacgcttctcaagttgtttttcgattttgaaaagccatttacaatatcggtccatcagctcctttttgcaaataaacatattgcatggcgaaaaagaacactcctcgcaaattgctttatcaaaagcatccaagtagccagggcatttcgtcctgatgatttcccttgcctgtagcagatctgtcgaagaatggatcattctatactgctcagcaacagtgattaagttgcacccgattgagcttgtgcagggttctttggctgcaacagtacagtcataatgagtaagaatgttctcaatttcatagtctttgagcatctgctttgagtcattgggggactcaaacgcccttcgataatgcgtgagcccaactatcgactcaggagaattcttccatatccaatagaggccggtaagctcgcagtagtgtttgtttttctgggaaatattatcgccttgatcgtcgtacagccatccagcctgacgattgtctggtggaatggagcttgacccaacgtagagcggctgatacggcgcttgcgcatcaatgtcaaagtgcttatgcgctgcgatgtaaatcttcactgttcctgacgctctttccgtgccgaggcaattagatggcctgttcaatgggtatcgctcatatatttttaattgatatgaccgatagagattattatataagtcgtaactaaatcagttaaatgacacggaggactacatgaaaggcattatcctcgccggcgggtccggcacacgcctgtacccgctcacgctcgtgacctccaagcagctgctgccggtctacgacaagcccatgatctactacccgctgtccaccctcatgctggcgggcatccgggacatcctggtcatctccaccccgacggacctccccaacttcgagcgcctgctcggggacggctcgcgctacggcgtgaacctgtcctacgccgagcagccgagcccggacggcctggcccaggccttcaccatcggcgaggagttcatcgacggcgagccgtgcgccctggtgctcggcgacaacatcttctacggcaacggactttcgcgccacctgacgcgcgccgtccagaacgccgagtcggggagggccacggtcttcggctaccacgtggacgaccccgagcgcttcggcgtcgtggagtcgacacgcataaaaagcctcccatttctcgtgtccaagaaatgggaggcagttcactctttgcggagcgcttttttataccgagtgctcaaaacagaatgagattgttctagaatgttcatactgtcacacaaacgaacaggagcgaacatgcatatctactctgtctctgatcccgagttcaagtcctatggcaacgtttgggataacgttccgtccgagcttacgtcgcccgtgctcgaggcgctctctgccacgcccattcccgagggcagcaagtacgttgcaagtgcgccggagctcgaggacgtcaaggatgccgacaagcttggctttctcatgtttggtggccgtcccttccagctcggctggtgcaacggccacaatacacgactcaactgcctggagtatcaccgcgcgagcgaattcaacttgggcgctcgcgactttatcctgctcgtggcgcatcgctgggagatcgaggacggcaagctcgacaccgcgtgcgtcaaggcgtttcgcgtgccggcgggtacggtcgtcgaagtcttcaacaccacgctccactacacgccgtgcatggtcgacgacggtggcttccaggtgatggtggcgctgcccgccggcaccaacggcccgcgccccgaggccgcggccgacatgcctgcggccggcgacagctactgctactggaaggccgacaagtgggtcctctgccatgctgacagccccaaggcagccgaaggcggctacgttggcctcatcggcaaaaatctcgacatcaccgtggactagcgcatcgccccaaaccaccacaaaggtgcctgtctcctttgcggtggtttggggcgggcggatatcgggaagtgccagacgggggaggctgccgggcgccttgccgtctgcggattttgggacatgcggcccgctttttcgacccatctgtcggtacactaaaagcactatgggtacccgcgagcgacatatcggcaacgcggccgcccgatccgcacccgtggcggatcccaggggcggcaggctcttcgccatgccgcgattccttgttggcataacacatcaggtgtaccgccaccgcgtctttgctatcgccggtgtcatcaccgcgatgttcctcatgcttttggcagtcttgccggcgctgttcgccttcgaccccaaactttctaacgccgtgcccgcctatagcgaggtgtcagaagaggtcgtggatgcgctcgtccattcgagctctctgccgttgcttgttgccgcaattgcattttcgatctggggcgtatcggtctatctgcgctgtttggactatgtgctgcgccgccgccttgttgccgtcgccaccatctgcgccctgtggatgatcgaagtcattctcaagtacaagtcgttcacgccgttctatgccaccgtgctgtggtacctgtactacgtgcccatgacgctcattccactgctctaccagttgtgtggtctgcgccttgcgggcctggagcaacaccgcctgggtcgccgctactgcgctgcgctgtggattgtggccatcctgcttatcggatttgtgctcaccaacgattttcaccagcaggtcttccgctttgaccgtacaagcgacacctggagcaacgattacacgtacggctggggttatttcgccgtcctcgtgtggacggcctttgacttcgtggccttttttatcctggttggtcggtcctcgtcctttcgcatccaacgtttctcgggcacggcggcgctcgtgctgctgggcggcgctttctttgccatctcatatgctctgcgcgtgccctgggcatggaggctcaacttttcgctcgtctattgcgtcctgtgcgtggtggcgatggaaatctgtctcgattgcggtgtcgttccgtcgtatcacgacatcgccggcatcttcgacaccttgccgcttgacctcaaagttctaacgcgcgacctgcaggaggtctatgccacgccggtgtcaaagccaacgccggtaggcgtgcgcgaggagttgcggacccaggagcacggccgcgcccatgcctttgccgtggcgtccgatcccgatgtgatgtaccgtgccttcccactgctgggcggatcggccctgcttgcccaagacgtgtcggagctcaacgagcttaaccgtgagctggcacatcgtcgcatggagttgcagcgtcaaaacgagctgctcgccgccgactacgaccttaagacgcatttggcagatcaagaggccgagaccttgctggtccaagacgtggaccaggcgcttgcccgcgcgctcgaagggatgtacgacctgctgagttcgctgccgccgttgaccgacgaagcgtcttcacacgagcgttaccgcatgctgcagcgcgccaagatgctcgtcgcctattgcaagcgcaagggatcgctcacgttggcacaacacggggagagcggttttgatcgcgaccgcattcagctcatcgccaacgagctcgcaagcgacctgcgcaccatcgatatcgattgcgcctcgattatcgccatacggcgcccgatgcacgccagtacggtaagcgccctgtacgactgcgtgtatgactttgcgttttttgcctacaccaccgaccatccggcgcttatgtatcacttgggcgaccatgaccgatgcagtgtcgagctgcgcgccacgcttttttccaacgatgatgaagatctttcgcagacgcccgctgcgcaagagctcgaaagcgctctgcaagggcgcaacgtggcataccgccttgagggcgagcccggccagctgcgcatgatcgtcttgatgccgagggcgggtgagtgacgatgcagatttcgctcattcttccccaaatcgttgcgctcgatgttgtctttgccctggctgcgtctctgcagacgatccacgtcccgctcatcgcatcgcgccgctcgtcctataaccgtaaggtgatttgtgcctacgaggcgagccttgtgcttcacctagttatttcggcgctcatcttgttcgcgtcgtctggctcatatctggtggcgccgcttgacgtttgcgccagggcaatgggcggagcgttgtggctcaatgccgtgatctttgcctacggcgtggtgcttatggtgcgctatcgtcgccccgtcatgctggtcgagctgctgcttgttgtcaccgttacaccgccggtggtttttgccatgggctcggcgtggaccgttgtccttatcacagagggagcgttcttcctgttccgttccatcgcggcgctcttgatggacgtccgtaaccgccaggaggatatcaccatgttctcgacgatcgagaccatcaacgtgattcccgtgggcatcctgtatctggacccgaggggccgtccgctgctcatgaaccgctgcatgcgcaaaaacctggtggagcttcatatgcccaccgacctaggcgatatgagcggtacatggaacgacctgcgcaaactcagcatgcaaatgcccgaaagcagcaggaaccgtgtgcggattaatctggaccgctttggtgaggcgcgcgttgtggtcgaggtttctcccgccgagattcgcttgttcgtgcacgatgacgttatggtttcgggccgcctcttcgagcgcattatcggtctggatgtaacagagtatgcgcatgcccatgatcgcctagcgcaagccaaccacctgcttgagcttgcgggccaagagctccaagcccagatcgaagaagtcaaaaaagttgctgacaatgcggcctatctgcgtatgcgcgctcgcgtgcacgacgtgatcgggcagcgcctgtccatcctccatcgttatctggaggaggggcgcctggacgacgagtcactcgagcagattgatccgttgctgcgctcaatcgctgccgatctgcgcagcgggggcgacaccgaaccggcagagcaattgggcgatatcgtccatgcctttggcctggtgagcgtgcagatcgatgtggagggcgagctgccaaacgacgcgcgtgtcgccgcagcatttttgcagattatccgcgaagcctcgaccaatgccaccaagcatgcacaggcccatcaggtccatgtgcgcctgtggcaggaggggacggaagacggcgctgttgcgcgaatggccgtttctaacgacggcgcgcctgcacccgtatcgtatcgcgagggaacgggtatcccaggtatgaggcatgtcgcacagaatctgggcggcagcctggaagtccacaccgccccgccctttacgcttacggtgtccatcccgctcgcctccagcgccacggtccaaaggagaagctcatgattcgcgtccttatagtcgaagaccaggccattctgcgcgagagcctcgcgcgctccgtcggtgaccagcccgacatgacggttgttgccgcgatcgccgacgcctcggatgccttggacgttgtgcttaaggagcgcccggacatgatactgatggacgtatgcaccgagcatgattccaacggcatcgtggcggcggcgcgcatcaaagaacaactgcccgagtgccgcgtcattatcatgacgggtatgcccgaaatcacctttgtggaccaggcgcgcgaggcgggcgtcgacagctttgtgtacaagaacgtcggtatcgacgagctattcgccgtgatgcgctccacgctggcgggttactgcacgtttcccaagccgcccgagagcatcttctcgggcacggcggccctcgacgatgtcgagctgtcgatcttgcgccttgcctgcgagggtaaaagccgccgcgagatcgcggccgagctgtttatgagcgagggcaccatcaaacgccgcatctcggagattctcaataagaccggctacgacaacatcatgcgcttggccgtgcgcgcagtaacggagggcagcatcgttcccaacatggagcgctagcgctcgttacgcatcggcataaagcggcggggccgcaggatcaactcctgcggccccgcctggtgtgcgcggatgtgtccgccaatccgcggctatcggtgtctgccgttacgcgatggttgcgctgtaagaggcgacgtcctcgtaggaatcggttaggtaggcgtcgatgccgatggtcgtattgaccaggtcgtcaaggctgtcaagctcgccgttcgagaacgtgaattcctcggtggcgttggtgccgggcatcaggtgagccgagaaccagggttccttcatggtgccgttgacgttggtcttgccggaaggagcgtagaaggtcaggtccttgtcgctcttgttggtgatgttgacgacaaagccgatgtcgccccagtcgtccttgaacttctcggtgatggtgatggtgcacagatcgtcatcggcgacggtgacggcgggggagatttcgacgctctggacatcgtcgtcttcgacggcctcatcgatctcatcttccttctcggccgcctcgcgatccttcttcaccgtaccggacaggtccttgtcggacttggtgaagataaacttgtcgccgtccacctccaggacgagcttgtcgtccttgagcttcagatcgtgcgattcatcttcggcggtgacggttgcggtggtggcgtccttggcctcccacttaaggtcgacaacctcaaggaacaggtcgagggtgcctgtgccgtcctcatcgaggatcaggatgcagttgacgccccactcttcgagcatatccatgtactcatcggtgagctcttcgccatccaaggttccacccgagtactgccagctgccgacgaagttggccttggggtctttgccgccgccgctgcagcccgtcagggcaaaggcgagcgccagggcgcatgtcagaaatgcgagtacggactttttgaacgttgtcttcatggtgtcctccttcttgtgtgaaagcccatagaagcaaatgcgggggtggcggacctccccgccaattaccagatagaggggttagggcctgggcgttccgcagttgctgcagaacttgccaccgttttcgctgccgcagttggggcagaaccacttggccggtgccggggcgggtgcgggactaccgcactcggagcagaacttgccggtattgatggcaccgcagctgcaggtccatgcgccggccgcgggggcagcggcaggagccggtgcgggggcgggtgccggagctggctgcggggcggcctgctgctgtgcctgaccggcggcgaacagctggctagcgttcatgccgcccatgccacctgccatgcccatgcccataaagcctgccatcgcgccgttggggttggccgccgcggcgcgcatcgcatcgctctgggcgctggcgatattagcggctgccatggtgggatcgcgcatgaccgcggccttctgcaggtctttgatcatctgctcgtcctcttgcgaggcggcgatggagttgacgccaaagctcacgatctcgacgccgcgcaggtcacgccaatcggcagagaggacctcgttgagcgcgcgggcgagctcggtggtgtggccggggatggcgctgtagcggatgcccatctccgagatcttggcaaaggcgggctgcagggcggtgagcagctcggatttaagctggctgtcgatcttatcgcgcgtgtagctgtcggtcacgttgccgcacacgttggtgtagaacagcagcgggttggtgatacggtacgaatactcgccgttgcagcgaacggagatgtcgacatccagaccgatattgttgtcgactacgcggaagggcacgggagaggcggtgccgtacttgttgccgatgatctcttttgtgttgatgaagtagacgcgctggtccttgcccgcgtcgccgccaaaggtaaagcggctgccgatattggcgaaggtctccttgatggagtcgcccaggttgccgctgaagacactcggctcgctgccggtgtcaaagacaaactcgccaggctccagcgcaacctcgatgatcttgccgttttgcaccacgagcatgccctggccgtcgttgacggcgatgacggagccgttggagatgacgttgtcctcgccgcgcgtgttggagctgcggccgccggtgcgcttgctgcccttgcaggccaagacgtcagcgggcatcgattcgcaatagataaattccttccactggtcggccatgacgccgccggcagcacccaatccagctttcaagagtcccatggtgatcttcctttctcgtcaaaggccgggtggtattggtcagaatggctaatcgtccttgttgtccttcatgacaacggtggtctcggtgtggctgaaggtgtcgtgcttctcggtcaggtcgagctcgccgcagtagcagtcggcgtgggtggcctcgttggccgtcttgagctggcctaccagcagcacgtctgcgatgatcacgatgatcagcggcgcgacgatgttgatgaggatgccctcgacatcaaaggtgaggtaatccggatcgaaggcgttctcgcccataaagagaatctgggaaaggacaaatccgatcgcaaagaacagcaccgaggcgatagcgagcttgggcttggagcagggaagctcgccgaccatgcggccggtttggccgttcatagcaaacaggtaactcttgccgttccacgaggtagagagcatccacacggggaacagagcataatcgttttcttcccaggtgtagtcgagctgcttgctttcgaccgtggcgtcgtcgtactcgtcgacgacggtctcgcgcagggccgagatcgtgctctcctccatgcggcgctcggcgcgcgccttgcaggtttcgcaatcctcgtcatagcggttggcgatgtagccgggcatataggcgaccgagaacgggcgcagcgcgtcgtagtcaaacggctcgatggcgtccatgtggccgtcgggcatcttggacgatccgtcgacgggcacgcgctcaaacgagatattgcccttacggtaggcgtcgtagtggtcggtggttgtgacggtgcggtcggattcctcggtcacggtctcgttggtcgcgtcaaagtacacttcgccgtcaacgcgggcgccgtagagccaaaacggcacgtaaacgccttggacctcgtcgatgtggttgccggtgacaaagctcttgggcagcaggattttacccttgtagtggtctttgagcgcggccatgacatcgtcgcgcccgagcttaaatgggatcaccaggtcgggtgagaagtcgcccgagagctggccgggtgccacggcggagttgccgcagtacgggcaggtggtgacggcgacggtgccgtcggacacgagctcggcgccgcacgacgagcagatgtagccggcgttttgagccagctcctgcacggcatcgtcgacagcaggcttgggggccgcggctgcggcatcggctttggcatctgccttgtcctggcgctcgcgatagagggcctcgacttcttcgacttcaaaacgcgaatcgcagtagtcgcagacgagcttttgctcggcactggcaaaatgcaaggggccaccgcaggcagggcactgatagttaacgctctcgaaggccatgatcggtcctttcgctgccggaggctatgcgccgatggcgccgccgcagtattcgcagcgcccactggcatcgggaatggtggtggctccgcagaaggggcaggtcaccgcggtcttgggggccttggcggccacgacgctgtcgcgcgtctcctggcgcagctgcaccagcgcgtcgcggacctcggttgcctggcgcttggcctcgcggtattcgatggagccgcgctgatcgatggtggagtcgttcacgcgcaggttgatctcggtaaagtacggcgtgttgacgtgaatggtcaggttaaagtcgtaatccaggtcatagcgcggcgggttgtagctctcgcgctcgccgtccttggtctcgcgatagatctcggtgcgctgctcgtcgatatccatatcgcagccgagtacctgcgagaactcgatgatgtcgggattggcgtcgcgccagcggctctgcgaagtgatgatcagcaggcccgcgtcctcatcgagcataatattggtgcgcccggcagaaagcgtgcgcgtggggttgaacgaagacaggcgctcggcgttggcctcgcggtaggcgagttgctcacggatatcgtccgcggtgctggagcgatagccgtgaaagtagggggagagcttgccggcgcactctttgcacaggtagccttcattgatttttgtcttacctagaagtcccagctcggtaccgcaaatcgcgcactctttcttctcgaacatcttgtcaaagaagcccatggctgcctcccatcaactggtagcgtgtgtcacttttgatgatgggggagtgcgcgatccttcgcgatacccagacggctcaaggagtctccacaactgggacacatggcccatttttgactagtcattggggacgtacttaaacgactagtcgcgggggacactcttcggccactcattggggacgtacttaaatgagtggtagttggagacactcctggccgagctagagatcgcgcgcgtcccttctggtccatgcggctcaaaatcgcggcgtgatgtggacgactggggccgaattagcagcatttcgagtctgactctgatatcgagattggttctttattaaaatagaattccagacaattgagcggccgggggttagccatgaggggcatgggagacacaaccgcatatttgcgtcggggcattcgggagattatatgcctggcgctgttcttcttcacgtttttgacgtgcgagtatctctttgatgtgcgcatagccgagttcgtgccatcgagtgaggtcgttatctacgagagtatcgtcgttggcgcgagcgtgattggctttttcgtgcgcccatttctgtactatcgccgtccccagacgatcgatgcgacgagcgatattacaggcgtgctgttggtatcggcgttgctgctgatgattatggcagtgcggtttgaggtgctaattgccggcggcctggtggcgtgctgtgcgctgggctattgcggatcgaccgcccatgccaatcttgcgcggcgttttgcgcagacgccctgcctggcgcgcgccgtggcggtttcctatgctgcgggcattttggtgcaggtgctcaaccatatggtgatgcctgcgggcattccccagaagtctgttctcattgcctgtgcgattgcgctggtggggctgcttcacggtgcccgccgcgctaaattgcgtgatgagcctgcgtccgagttcgagattgccgagctatcggtcgatgcgtcggagcgtggcgccaggtggcacgatgaccccgaggcaaaggcggcctttcagggtgccgtggtacgtctgacggtggcgaccgcttgcctcaccggcgtgttcgcggccctcaatgccggccttacgacctcgcatgccgctggcgctatcgatctgggcgactggccgcgcttgctgctggttgtgagcgcccttgccgccggcgtcctgtatgacctgcgtgggcgttcgtatatgaatatcatcatgacgtgcgccgccatgctgtccacgctctcgttctttgtgcttatcaccgatggcaacggtggcaacacgcttgccgccacgattatcttttaccttggcacgggctttttcgtggtgttcttcaccgcgaagttcgccgcgatttcgatgtatgcccgctgggcgtatctatggccgtgcatgggccgtgttatcaacaacgtttgctcgatactcgtgacggctccggcggtggcgattgtctcgagtcaaaacgtgctggcggcagtgagcgtcgtgctcgtgctgtttgtcggcatcgcgatttcgctgttgggacagtttggacaagacggtgagggcgaggcgacgcacggcgggctggcgcttgccaccgacgatcttggcgtgagctgtgagcccggccaggccgacacggtgcccctggaggcgccggagctttcgtttgacgatcggctcgatggcttcgttgccgcctttgggcttaccaagcgcgagcgcgatgttctggaggcgctggtcgtttcggacggcagcgtgcaggacgtggcggcggcactcttcctttcgcgctccacgctctatcgccacatcgcttcgatcaacaaaaagaccggtgcctcctcgcgcgtagccctcatcaacttcttctggtcctggacaccccaagactagctaaccaccacaaaggggacaggcacctttgtggtggttttttacctgcaaaaatatgaatatgagacatttgtcacctgccgttttggtgctcaaaggcatatgaatgtgatgctgagcggagcagaacggagggggtgcacctatggcgtctcggggttgcgcgtctaataaaactgcgggcgcgcttatcgccgtggtggtctttgccgcggcggtgacacttatgcgagtttacgttgccggcgaccatggcgctcaaggaaagactgccgcgcaagtgtcgctcaacgattgcgctgccgttccggtggcggtcaagcttgtcgaggacggggaggcgcggacggtctatgagaccgacgattccgaactggtcgcatcggcttttgccgcgctcgatggctgcaccgtgggggatgcggtggatgagcggatgagcgatgccggccgaacgctcgtctttgtctatgcagacggttcggagcaatcggtagagctcgaaggcaagaatatcgtgctcgataagacggcgtaccgacttaacggtgccgatgagttatggcggcagcttgccgcgatcaaaaacagctaacgaaattagggatgtacgggatgagtgacttgagattctgcccggcgtgtggggcgcagctgcctcgggtcgccggcgtgccggtgcgattttgcccggggtgcggcgtccgacttgagggcgttgcatgcggctcggatgccacggggtctgtgaatgacgctactgccgatgatggcgcgagcgaaggccgcgagccgagcgtggctgtgccgacgcagagtgccgaggccgcgtcaccgtctggcgacacaacctcggcggacgctcctcgcgctgttgaccttgagcttcatgccgcatgcgatgcctctggcgggcaggcgctcgcgcaggtagcgctgccgcggggttggcaaatcgaagaggcgcatcttgagcgcagcggcagtttcgactgcccgatttcggttggcgtgacggcagcgggtccgatgggtgagcggattatgtaccgctccgagctctgctacgtggatgcgggcgccgttgccaagcgtatccccacgcaaaccgagcgcaaggcgtttatgcacgtggaggcagcttgcgacgagctggctcaggcctgcgcggcacagctgggcgcacgggcggaggttgtggccgggcagccgtacccatcgaacgcggcgctcgatatcgagcgcgagcgtgcccgcgtaaagcgcgaggcggtaaacgactttgcgattcagggcttttcgatggagccgagcaatgtgatctatgagtgccgcatgcgtcgatatcggctcacgggcgctccagtgcccaccgagctcgcggtggcggccaaagtcgagggctatgtggcctcgatcggcggcgtcgcaggctctaagggtaaaggcattgccgctggggccgaggcgctgctgggcgcaggcctttcgagcggactgatcggcggcgttttgggcaaacgcctgcgcgagcgccaggcggcggcagcggcgggacagggcgtcgcgcaaggacagcccacgggtcgaggcggttgcccggacggagcgtcgttcgagctgggcgcggccgacctgctgcagtggcgtatcagggacagcttctgtctggttgcgccagaaggtcgcctggacgaggcggcctctacggcgcttgcctcaatggcgtcgaccttgcggcttaacccggctattgcacgtgaggcgtccgctcaaaagcaacagatggtgctcgaacagcgccaacgcacgcagatgaacattgcccagcagcaacagcagtttgcagcctggcagcagatgcatgcctcgcagcaggcggcgttcgacagctaccagcaggcatggttcgatcgcagcgatcgtcagcacgccgcgaacatggctgccagcgcagccagtttctctagcgcgggcgtaggcacgggtgcggcctcgtattccgatgccattcgcggggttaaccattacaccaggcccgacggcaccgatgtcgaggtctcggtgatggccgaccaggcctgggtcaacggttcgggcgatgtcatcggcacgcgcgatggctttgagcctggttttggctggacggagctgcctcgccaatagcgtgagacggcttgtgtgtgaatcgatgccgggcgtgtttctcggcattgtgataaagaacgggaaaggaacaacgatgagggagacggtactttcgcgcacggcatttgtcgcggcggcgggaacggcgctgctgacgcttgtggggtgcggcggacagcggacgcaggatgcgacgggttttaacgacgaccgcccggtaaaggacaagatggacgcgggtgcgacgtcgggcgattccggcgacgcggacagcgattcgggcgcggacagcggctcggcggatgcgttcgatacgtggtcggatgattgctgggatgcgcaccgcaacatcagcatcgcggcactcctcgagcttaagggctggcagttgcaggagtttgtcacgcagcagggctatacctggcaagacgcgctcgagatgtacgaggacgaggcgggacacgtgctcagcgtctgcaatatcagcaaggacggcgcgaccgaatggctcggcgaggacgaaatcggaaagctcgacaagggcggcaccggaagcaccgtgatgttcacgctgcaactttcgggctattcgagctgcgaggatgttatcgcgggcttttccgtgccggtcgaggaccgggcgcagattacttcgggctcatggatcgcgtgcgtatacggttccaacatggcgcggcacgtcgccatggcgagcccgatggaaaacggtgactaccgcttggatctcattaccgaggaggctatcaagaccggtacgtttacccagggcggcggtgctccgacgatagacgaattttggcaggaaaagactggacgcgcgctcggctaggtgcgacgtggccaataccatagcgaggaacgaacatgatgaatgaagtgacgatgagccgtgcagcctttgtggcaggcgcgggcgtgctgacttgtgtgctggctggctgctcgggcggattgggcggcgcgggcggtgccaagaaggcgaccacggcggacgccgcctgtgtagacgacaacgccaacgtgacggtctatgctgcgatcaacttggacggcgccgacctggtgcgcctgctcaagcatcaaaactatgagtggcaaggcgagagcgtgggctacggtgccgccgatgacgcggggcttttcgcctttaccttttctaagatttcggatgatgtggacgaacttgcgaacagcgcgataccgcttccggagtccgagtacgaggaacttgagccgggcggcggagacgatagcgtggcgattttgctctcggtgggtggctatacgacgggcgatcgtgcgctcaccggcgcaatcggcgatgcggcgatagtgcaggagaagtgcgcaatcgacgattccgtgtattggctggtcaaggcgctcgacggcagccgttacgtgatttcggcctacaacaccgaagatgatggcgacagcgcgcatgacatctatatctatagtgagtcttttattcacaccggttatctgagcggcggcgaccaaatcgatattgacgaactctggagccgcctgactaacgcctcatagcgcaccaaaaccaccacaaaggggacaggcacctttgtggtggttttgcccttgggctgtctactgtggcggctcaccgtgctacagcagctcgccgtggcgtgcaatgtagcggcgctttgccagctgggtgagcgcgatataggcggtgacgatgccgacgagcagcgcgaaaaagctcgtcggcagcggcatgaggcccagtgcatcggcgatggggcttgccggcagccaggtgacgagcgctaggcccagcacggtaagaacgcacaatgcgggcgcggcgtggtcgcgcgggctcggcagatgcggggagcgcagcatgtggaccacgagtgtctgcgaccacatggactcgacaaaccagccgctctggaagagcgcagcaaaggtcgccatacccgcgacgtcgcccgcggcggcaagctcggaccagcttgcgtccacggcggcggggcacacgacaaagaagagcgcggcgaaggtcacgatgtcaaacagcgagctcacggggcccagctcgagcataaagcccttgatggacgcggcgtcccaggcacgcgggcgggcagtccaggcgccatcgacggtgtcccacggcagtgcgatgcacacgatctcgtagaccagcgacagcagcaccagctgcagggcgctcatgggcaaaaacggcaagaacaggctcgcgacggtcacggacagcacattgccaaagttggagctcaccgtggtcttgaggtacttgagcaggttgccgtaagtgcggcggccttcgatgatgccgcgctcgagcacgcccaggtccttctgaagcaagatgatatcggcggattccttggcaatatcgacggccgaatcgaccgagatgccgcaatcgctcgcacgcatggcggcggcgtcgttgatgccgtcgcccataaagcccacggtgtggccgagcatctcgcgcatgacacgtaccaggcgcgccttctgcagcggcgagagcttggcgaagaggtgggttttctcggcgcgctcggcaagttcggcgtcatcgagcgcatcgatctcggagccgagcaagacgttgctcgcatcgataccgatctgctcgcagacggtggcggcgacgcggtcgttgtcgccggttaggaccttgatcgccacgcccttggcctcgagggtggcgacggcgcccgcggcacttgctttaggcggatcgaggaaggccaaaaagcccatcagcaccatgtcgcactcgtcggcgatgccaaactcgcccacgcagcgcggattggtcttctgcgccacggcaattacgcgtaggccctcggcgttaagtccggcgatctgcttgcgaatctgggcgagcttctcgtcggtgagcggctgagcgatgccatcgatctcgacaaaggagcagatctcgagcatttcctcggcagcgcccttggtaaccatctgggttttgccttgggcgtcggcgacaactacgctcaggagacggcgcgagaaatcgaagggaacctcgtcgaccttggtatagcggtcgcgcagactctggcccagcatagaatcgggcacgacggtcgagggcgtcacatcggcacggtcgattacggccaggtcgataaggtttttgaggccggtttggaagaagctattcaaaaatgcatggcgcagcacgcgtgcgtcttcgttgccgtcggtgctgagatagcgctcgagcacgatgcggtcttcggtgagggtgccggtcttgtcgcagcacaggacgtccatcgcgccaaggttttgaatcgccggcagctccttgacgataacctggcgacgggcgaggtccttggcgccctgcgataggctcgtggtcacgatgacgggaagcatttgcggcgtgatgcccacggccacgctcgtggcgaatagcagcgcgtcgatgacgttacccttggtggcggcgttgatggcaaagacggccggcgccataacgagcatgaggcgtacgagcaacatggagacgctcgagacgccgcggtcaaacgcgctcttttcgccgcgcccgttgagcatcttggcgatgccgcccaggtaggtgtccgagccggtggcaacgacaagcgccatggcggtgccgttttgcacggaggtgccggtaaagacgatgttcttgcaggcagagagcggcagtgcggagccgtcggcaccctcgacgatagtgacggcggtggtcttctcgacggcctcgctctcgccggtgagcgcggactcgatcacaaacagatcgcgcgcagtgatgatacgggcatctgccggaaccatatcgccggcagagaggcggaccacatcgccggggacgagctcgtcgaaggggatctcgatgcgctcgccgtcgcgcagggcacagcaggtgttggagaccaggtccttgagggcctcggcggcattgccgctgcgggcttcctggataaacttcatgccgcccgataccagcagcatgatgccgataacgatgaccgtggaggggtcgcgctggggctcgggcacggcgagcacgtcgatgtagagcgagaccagcgcgagcgcggcgaggatgccggcgaaggggtcgatgaacgcgtcggcgatgcggcgggcgagtgtcttggtcggcgcctcgatggtgttggggccggaggcgtccaggcgcttggttgcctgctcggcaccgagcccgttagcggttgtgtcgagcagcacgagggtgtcctcggcgctatgggtggcggcgaatatggtgttcttggacaggccggtgtgagcggcagggcgcgccgtgcggcggcgcttggagatggcttcgagtaccgtggcggttttgagcatcagcatagggtcctccttgttgaagggagttagcgtacgtgtcgtatttgcttcaaaaacctagatgtcgctcacgtcaagctcgcgaaccaccacaaaggggacaggcacctttgtggtggttttgacgattggttagtggcgcttatgcgaatacggaatcctcgcggcgtgccgagggcgacatgcaggtttttcgactatgactgccttccatggcacacctccttaaggacgggcgcagcgcgctttgggtatctcgtatcccttttaatccgcccgtattcttgacgagggggtttatcgtgtcaaccccattgttcggaaaaccattgcccctgacaaagcctttacagaatgccgtggcctcaaagcgcacccgcatcgacgccctgcctgcgctaaactggaaggcacgtacgcgattacgagaggagcccgcatggaggcttacaagcaagagttcatcaagttcatggttgagtccgacgttcttaagttcggcagctttacgctcaagagcggccgtcagtccccgttctttatgaacgccggcgtctacgtgacgggctatcagctcaagaagctgggcgagtattacgcccaggccatccacgataactttggcgacgactttgacgtgctgtttgggccggcctacaagggcattcccctggccgtcgtgaccgccattgcctaccacgagctgtacggcaaggaggtcaagtactgctgcgaccgcaaggaggccaaggaccacggcgccgacaagggcaacctgctgggctatgagccccaggacggcgaccgcgtggtcatggtcgaggacgttaccaccagcggcaagtccatcgacgagacctatcccaaggtcaaggctgctgccgatgtcgagatcaagggcctgatcgtgtccctcaaccgcatggaggtcggcaagggcggtgtgaccaccgcgcagaaggagatcgaggccaagtacggtttccccgtcgcgagcatcgtctccatggccgaggtcgtcgagaccctctacaaccacgagatcgacggcaaggttgtcatcgatgacgagctcaagaccgccatcgacgcctactacgagcagtacggagcacgttagttacggcgttttaccaaacgccgtaactgctcgacgctgcgcgggccgcatttggacaatctgacgttcaacttcaagggcgcgaccagaaggtcagcgccctttcgtttcacgtcaccttgtctcaaatgcgacccgctcgctgtccgttctctacccgcggcgtcgtcttgctccgaatgcggcccgttcgctcatatgacccaatccgctgtcaagagccacaatggccccgccgaccgctcgacacgcataaaaagcctcccatttctcgtgtccaagaaatgggaggcagttcagtatggagcggttttgccctttatatatcgagcgcctcggccatcgcggccgtagtgattgccgtggttccacagcaactgcccaccattgcggcaccggcatgtctccattcgatgcatgcgcgcgcgaaagcttcggggttctcgtgccatacggggccatcctgagtctggaccggatcgcctacgttgggacgcaccgtgacgggagtagtcgccgatgcaaccatcctgggcaccgccgcgttcgcggccgcaagcgaacagcaattaacaccaaccgagtttgcgccgtgtttttcggcgtacaaaacggccgcctcgatgttgaggccatcgcccaacaggtcgcctttatcgtcaacgacaaaactcaccagaacaggcatgccgtcggcggcatctcgggcgccggcaagcatgggctgcaaattacggatagacgtcaccgtctcgatcagcagaccgtcaacgccggcattgagcaaggcgtgcgcctgttcgcgcgcaatgcctcggatttcacgatactcggcagagtcctcggcaaaccactcaataccgatcgggcccatcgagcccagcagcagttgcgggtgcgcctggcgagcatcgtcgacggccccgcgattgacctccgccacggacggcgcaatctggtcgtgcttgagggcatagcttgatgcctgaaaggtgttggtaatgagcacctgcgcgccggcagcgacatacaagcgatggatacgagaaacggtctgcggctctgccagattccaaaacgccggtggaatgtcggcggcatcgtactcactcaacagaacactgcccatggggccctgcgccaacaaggtctcgctcgacaagcggcgcgcaagttcctcggcaccaaagcggttgtaataactcgtatccatatatatcccgctattcctcgacgctgattccctgcttttcgagataggcgagccagcggttcatcgtgtcctcggaaagcgcatgctccatcatgcaggcctcggaatcggctcgctcaaattcgacaccgagctcctgaaccaaaaacgtgcggatgaggcgatgacggtaccagatagccgtaccaacctcgcggccgcgatcggtcaggactaccttgccgtagtgcgattgctcgacaagttcggatgccttgagcgccgaaaccgctttattgaccgatgccttggagacgccaaggcgctgcgcgatgtcgaccgatcgaacgccgttggtttccccctcttcgctttcaatgcgaaccatgcactccaagtagtcttcgttcgccaccgtcagatgtagttcgcgcgagctatttgtcgtatccatgatcttccgtcccttctgcattcaatggctgattctaccccatccaagcgtcgcggtatgccgtggcataccgtgctagagttcttgttgcacacgacgaccaagattggagcggtctttatggaaaacaccaccacgaaccccgatgtcctcgagcgctttttgcgctacgtccagatcaacacgcagtccgaggatgcaaactgcgaccaggtaccctcgagcgccgttcagtttgaccttgccaacgtgctggctgaagagctgcgcgagcttggtgcggaagatgcccacgtgaccgagcacgcctatgtctgcgcgcatatccccgcaagtgcgggcgctgaggataagcccgccctgggcctgatcgcccatctcgacaccaccgaagttgcaccgggcgccggcgtgaagccgcacatcgtacaccacgaaggcggcgacctggtctgcggcacggttgacggtaagcccgttgccatgagcaccgccaagcttcccgccctgaatgacctcgcgggtgaggacctggtctgcagcgatggcaccacgctgctgggcgcggacgacaaggcaggcgtcgccgagatcatgtcgcttgtcgcgcgtatcgctcaggacccttctctgccccatcctgcactcggcatttgcttctgccctgacgaggaaatcggccacggagccgagctgttggatatcgatacctttggctgcaagtacgcctacacggtcgacggcggccccatcggcgagctggagtgggagtgctttaacgccgccgaggcgaccgtccgctttgagggccagtccatccacccgggcgacgctaagggccgtatggtcaacgcaggcaatctgttctgcgacttcaacgcgttgctcccctacgtgcagcgcccggagtatacggaaggctacgagggcttttatcaccttgagggtgtatctgcgaccgtcgatcacgccacagcgcgctatatcatccgcgaccatgacgccgccaagttccagcagaaactcgaccttattgatgccgccgcctcgatgctcaaccagcgtctgggtgaggagcgcgtgacagtcgagattaagcagcagtatcgaaatatggccgagatcgttcgtgactatcccgagcttattgatgttgccaaggaagcctaccttgcctgcggcgttgagccccaagtgctgccgattcgcggcggcaccgacggcgcccagctgtcgttccgcggtctgccctgccccaacctttccaccggcggctattgctaccacggcgtcaacgagttcgtcccggttagttcgctcgtcaagatgaccgacgtgctccaggagctcgtcgcccgctttgcatagggaactcgaacaatccaggtaagcaaaaccgccccgtcctcaaaaccgagaacggggcggtttttggtgcaaggggagtagtcagcaccgcaggttgagccaacgtcagcgagcgacgtccaaggcgaacaagttggcatgaaaaaggcagggcattgaccttctggtcatgtcctgccttttgaatgacaaattgtcgccttgggcggcgcgcagcgtcgagccgttacggcgtttggtaaaacgccgtaacttagtagttggcttcgtagccgttgccgtcgccggtgggctcttcgtagtagtccgaatcgctcgaatcgcttgagtcatcggaatcgtcagagctgaccgatgaggttgcggtaccgtttgcgtagtcgtcagacgtgttgttgttcaggtcgccgatcgtagagctggaaccgtcggaaagacccatggtgttgggacccttgggatccttgccggcatcgacacgctccatcatttccttgagctcgtcctcgtagacaaagacgtagctcacaccgtcgatcatggtgctgtcgtcggcatacgagggcaggttggccgagtagatgccgtcgacatccataccgcgcatggcattgaccgtagccacgatatcctgaacgctcatatcggtcacgagcatatcggacagcgaattaaccaggccaaagatcttcgtggcatcgaagttattgagaatctggttggcaagggcgccaagcacctgacgctggtggcgcatgcgcgtgtagtcgccgtcggcatagatgtagcggcagcgggcataggtaagggcggtggcgccgtccatatgctgctgaccagcggtaatcttaatatccaggtgctcggggtcgtcaacatcatcggttgcgttaatgtcgataccgccaaccgaatcaatcagcgcctgcataccgtcgaagctgacctcggcatagtgggaaatctgaacaccgcacagctcgttgaccgcctcgaccatggcctcggcgccgccaacggtatggcaggcgttgatcttcatggtctcgcccttgtactcgaccttggtgtcgcgcggaacggaaatgagcgtcgcctgcttttgcgtggggtcgatgcgtgccaggataatcgagtcggcacgatacgtatcctcgcccggacggccgtcggtgccaagaagcagcacgtagaacggatcctttgcctcatcggtgtcaaccagaacccgacgcagattgtcggtaatgacattagaatcgccgagcttgcccataatggtggcaaaccacaggccggcagcggtagtggcactcagcagcacgccaagcacgacaatgagcgcgacgtgacgaatcgtgtggctacgacgacgttggcgagcgcgctcggaatagcgagccacgttatcgcgactgtagatcttggcctgcgcaccagttgagggtcttcgggtggcggtatccgcgaggggctttttattaaacataggcaacctgtattagtagatgacgggatcggggacggtagcatgctcgacatgcgcgccgagcgcctgcagcttttcgacaaactgctcgtagccgcgcttgatgtgatgaatggccgaaacctcggtcgtcccgtcggcgatcaagcccgctacgacgagggccgctccgccacgcagatcgggcgaggtaacctgtgcacccgagaagcccttgacgccatgaatcatggcgtgatggctctcgatacgaatgtcggcacccatgcgcaccagctcagaggcaaacataaagcgattctcgaagatgttttcggtaataacggaactgccatcggcaagggcggagagtaccataatctgcgcctgcatgtcggtcgggaaaccggggaacggaagcgtctggatatcgaccggcttgatacgctcggcacggttcacatggacgccgtcgtcggtacgctcgcagtcgatacccatgagctccatcttcttgagcaccatgcccaagtgaatggggcaaaagcccatgacatcgacaccgcgatcgtcggccatcaacgcaccggcaacgataaaggtaccggcctcgatgcggtcgcccactacgcgatgggtaacaggatgcagttcttccacgccctcgatggtcacgacgggcgtacccgcgccgacaatcttggcgcccatctcgttgagcatgttggcgagatcgacgatctcgggctcgcgggcggcattgtcgataaccgtggtgccctgcgcgcgcacggatgccatgatgaggttctcggtcgcaccgacgctggcgaactcgagcgtgacggtggtaccgcgcagaccttggggcgcattagcgttgatgtagccgtgggcggtatcgaactcaacgcccagggcctcaagaccaagaatgtgcatatcgatcttgcgagcacccaggttgcagccgcccggcatggcgatcttggcgcgatggaagcgacccagcaggggtcccatcacggcggtggaagcacgcatcttggcaacgagctcgtagggggcctcccaagaatcgacctgagaggtatcaatctcgagcgtgtgctcgtcaaggacatcgattgtggcgcccatacccttgagcaccttgcccatcacgtggacatcggaaatatcgggcacgttctgcagcgtcgtcttgcccggcgccagaagcgttgccgccatgagtttgagcgcggagttcttggcgcccgaaacgggcacagagcctccgatggcgtggccaccctcaacgcggataatatccaaggtctaccctttcaaaaagcatgcccgggatggctgggccatcccgggcatgatgtgttcgcaaatggtcgaacgctaaatcgtttgactattgggcaagcttgagcttacaccatgcgatttcattatagaggtaggcgcggcgtgcatcatcctccgacaaattacccagcttctcttcaaaaccttgaatatcagctttaagcttgtcggcatcgacggtcgccaaatcgcaagcgcgctcggcgagaacggtcacgacatcgtccgcaacctgggcatagccgccggccacggcaaacgtgtggtcgacagtgcccatggccttatcggaaacgcgaacgtaaccgcggtcgatcgtgcagatctcgctggagtgagcaggcagaacgccaaactcgccatccgtggacggaatcgacacaaacgcagcgtcgccctcataggcgcagctcacggggcacacgatgcggatacgcataacctacttctcccccatcttgcgggcgcgctcgcgcacgtcctcaatcgtggaagcatagcggaaagcctgctcgggcaggtcatcggccttgccgtcgacaatctcggcgaaggagcggacggtatcctcgacgcggacgtagacaccggggttgccggtgaacttctcggcgacgtggaaggactgcgagaggaactgctggatcttacgggcacggttgaccgtaaggcgctgctcctcggacagctcgtccatacccaggatggcgatgatgtcctgaaggtcggagtactcctgcaggagctcctggaccttgacggcgacacggtagtgctcctcgccgacgatcgagggatcgagagcgtcggaggaagacgcgagcgggtcgatagccgggaacaggccgagcgacgaaatactacgcgaaagaaccgtggtggcatcgaggtgcgtaaacgtcgtggcaggcgccgggtcggtcaggtcgtctgcggggacgtagacagcctggacggaggtaatggagcccgtcttggtcgaggtaatgcgctcctggaggtcgcccatctcggttgccagcgtgggctggtaaccaacggcggacggcatacggcccagcagtgcggaaacctcggaacctgcctgggagaagcggaagatgttgtcaatgaacagcaggacgtcctggccacgatcacggaaatactcagcggtggtaaggccggccagaccgatgcgcagacgcgctccgggcggctcgttcatctgaccatagaccaagcaggtcttgtcgataacgccagactcgctcatctcgaggaacaggtcggtgccctcgcgggtacgctcgccgacgccggtgaacaccgaggtgccgccgtgctcctgggcgaggttgttgatgagctcctgaatcagaacggtcttgccgacgccggcgccgccgaacaggcctgtcttgccgccacggatgtagggctcgagcaggtcgacggccttgatgccggtctcgaagatctcggtcttggtggtgagctcgtcgaaacggggcgctgcatggtggatggggtagaactcctccacctcgggcatgggcttgccgtcgacgggcttgcccatgacattccaaatgcggccgagcgtcttggggccgaccggcatcttcatgggctcaccggtatcggtggcgatgaggccgcgctgcaggccgtcggtcgaggacatggcgaccgtgcggacgacgccgcccggaagctggctctcgacctcgaggatcgtgctcagatgaccgatcggggtctcggcctcgaccgtgagcgcgttgtagatcgggggcaccgcgccgtcaaacttgacgtcgacgacagggccgatgatacgaacgatgcgaccatcaccggcagtcgtcttcttggtggcttcctcgaccgcaagctttacggtgttattagccattactgttcctccaatgctgaggctccgccgacgatctcgttaatctcggtcgtgatcgaagcctgacgcacgcgactatacgtgcgggtaagggtcgagatgatcgcggtggcgttttccgtcgcggagtgcatggccttgcggcgtgcaccctgctcggcagccgccgaatcgatcagggcctggtagatgaccgtcaggatatacgacggtacaagcttgccgagaacatgctcgggagagggcacgaactcgaacgtggacgagatgcgcttaggggcgtcggtctcgttcttacgcggaccgtgggccatagcgatcatctcgggatcgagcggcagcaagtgctcgacgcgaagctcctgatccacgcggttcttggcgtggtggtagacaagctcgacacggtcaagctcaccggcacgatacgcatcgcagatatgagaggaaatcatgcgagcctgattgaaatcgggctcggaggaattgccctcaaagtgcatgatgacgttcgcgcggtcgcggaaatacgtggccggcttgcgtccgcacgcaatgatctcgcactcgatgctattgttcgcccaagaagcggcgagcttttcggccgtgcgctccaccgtcgtattgaaaccgccggcaaggccgcggtccgaagcaatgacgacaatcaggccgcgctttaccgtctcatgcctctgcagcatggggtcggtacccgagcaggaggcgtcgccggcaaccgtcaacatgacgtcggtcagcgcctccttatagggctcggcctgcttggagcgatcgagggcacgacgaatcttggccgtagagaccatttccatcgtgcgcgtgatctgcttggtcgtggtaaccgaggagattcgcttcttaatgtcgcgaaggttggccatagggcttagttctcctctgatccagtcgtatcggcatggtgctttgccatgaactgctgcttaaagtcgccgatgacgcgcaggagctcagccttggtgtcatcgtcgatcttcttggcgcgaaccttgtcgagcaacgagccaaaaccgttgtccatgtactcgatgagctcggcacggaagggaagcacgtcggcgatctcgagatcgtcgaggaagccctcgttgccggcaaacagcgtaacgatctgctcggaaacctcaaacggcttgtagcgcggctgcttaaggagctcggtcatgcgagcgccgtgggtaagctgcttctgcgtagcctcgtcaaggtcggagccgaactgcgtaaagccggcgagctcctgatatgaagcgaggtccaggcgaaggttgccggcaacctgcttcatggccttggtctgagcgtcaccaccgacgcgggacacggagatacccacgtcgactgccgggcgctggccctggaagaagagctcggactgcaggtaaatctgaccatcggtaatggaaatgacgtttgtcggaatgtaggccgaaacgtcgccatcctgggtctcgataatcggcagggccgtcatggagccgtaaccgttcttcttggacatcttgacggcacgctcgagcagacgagagtgcaggtagaagatgtcgccaggataggcctcgcgtccgggcggacgatgcagcgtcagcgacatctgacggtaagccacggcctgcttggacaggtcatcgtagatgacaagcacgtgaccgccggggttggtctcgctggcgggcttaccgtcctcgccgttgtacatgaagaactcgccgatagcggcaccggccataggcgcgatgtactgcataggggcagaatcagcagcggttgccgaaacgatgatggtgtagtcgagcgcaccgtgctgagcgagggtctcgcggatgttagcaaccgtggaggccttctggccgatggcgacatagatgcagaccatgcccttgccgcgctgattgaggatagcgtcgatggcaatggcggtcttaccggtcttacggtcgccgatgataagctcgcgctggccgcggccgataggcaccatggagtcgatagccaataggccggtctggaccggctcgcacaccggggtacggtcgatgacgccgggggccttgaactcgatgggacgacggtgcgtggcgacaatgtcacccaaaccgtcgatgggctggccgagcggattgacgacgcggccgagcattgcacggctcacgggaatatccataatgcggccagtggtgcggcactcgtcgccttccttgatggagtcgacggcaccaaacagaacggcgccgacctcgtcacggtcaaggttctgggcgaggccgaatacggtctcaccggtatcggagctcttgaactccagaagctcgcctgccatggcactcttgaggccggagacgcgcgcgatgccgtcgcctacctcgtcgaccgttgaaacctcatgcgtatcgaccgtcgcggagaggctcgtgagctgctcctgcagtttcttggcgatatcctgggcattgagggtttcggacattaggcttcacctccgtacgaattagcagagtttgcgagggtctcctgcgcgatgcgcagctgcgtcttgacggagatgtcacgacgctcgccgcgggcctcgagcaccaggccgcccacgatagacgggtcgacctgctcgataaggaataccttgcggccgaagtcctgctcgcatttcttagtgatggtttgacgcagctcgtcgtcgagcgggatcgccgtggtgacggtcacgcccactacatcctcgtcttcctcggcaacatacttaaaggcagctgccaccttgggaagaaggtcgagctggtcgcgcttggacatggtgtcgagcacggcgatgatctcggggctggcagaagccaagcgctcgaccatctcgaggtcctcgaacacatggttctcggccttggcggcttccaaaagggaacgcgcgtaggtctcgagcaccttgtcctgatagcggctagtcggcattcaggctacctgcttcctggatgtagcgctcgatgagcttcttctgctcggcatcgtcctcgagtgcctcgcccacgatcttggtggcgacggcaacggacaggtcggcgatggagctcgcggcaccggcgtagatggacttgcgctcgtcctcgacggtcgtatgggccttggcgatgatctcctcggcctccttgtgagcagcctcgatgatacgggcgcgctcggactcggcgtccttacgggcctcgagaacgatgtcggcagcctgacgacgggcgtcggtgacgatcgagtcggactcagcgcgcttggcgatagcctcctgcttggtcttctcggcctcgtcgaggctctcctcgatcttcttgccgcgctcctccatggttttcatgatgcccggcagggcgaccttggccagcacgatccagatgatcaggaaggcgataagtgccgggatgaactccgccatcttagggatgaggatgtccgcaccggcagcgccgtcctcggcgaacgcggaaaccggcatgagcagcgcggccgcggacgcggagagtgcgatcgcgctcttctgggatgaaagattcatacttgacgctccgtgctatttaacgatcagcgcgacaacgaagccgatcagagccagagcctcgccgaaggcggagcccatgatgaagacggtgaacacgcggccctggacctcaggctgacgggccatagcacccgtagcacccagagcagacaggccgatagcaagaccagcgccgataacaccgagaccgtaaccgataactcccacgattcctcctttgtcgtgcgtgtcttatttcacgcaggataaccttatttataactgccgggctccatgggtacgggcaccagcggtttaacgaattgccttacctttaaggcgcgaacggaagactactcctcctccgcaacctcctctgcctcggagacatacacggcggtaaggaccgtgaagacataagcctggatggcgccgactacaagctcgatcgcatagatcaggatgaggatggcaagccaggccagcgaaggcagggcgccgacggcgtgagccgcggaaacctgctgaagcagcggctgcatgaacatgctcgccatgatggcgaacgagcccatgaccacgtgtcctgcgaacatgttgcagaacagacggacggcaagcgtgatgaggcgcaggaaggtcgagaaaagctcgacgacccacacaagcacgttcatcgggaagctcacgccctgcggggcgaggctcttgatgtagccgatcacgccgtgagccttgcatccgtagtagatgaagtacacgaaggcgaagatggcgagcgcggcggtggagccgattgcgccggtgccgggcttcattcccggaatcaggccaatcatgttattgatcaggatgaacaggaaaagcgagcacaggaacgggaagtgcttcttccagttctcacccacgacgcccttgccgatatcgttctcgacgtactcgatgatgtactcgaaaccgttgacgaagaagcccttgggaaccagggtctgcttcttcttgaacacggccaggacgatcaggagcacgatcgtggagacgatcagccaaaacgagtactgcgtgatgccgcagctcagatcgcccacgacaggggtggagctgaactcgctgaccagatgattaatctcatcaggcagcttttcaaaaatttccacgacttacctttcgacctcatgaggatctcgcagcaccttggcgacgcgaaccgcgcaggcggccataaaggccacgaagccgatcgcctcgcccaggaggaacatgcgaaacgcctctccgaacaacgcaaacacaaccaaggtaaagacgagcagggcgattgccgagaccgccaggctcaccatacccttgagcatgtccgcattctgtttatcgtcaagaaccggcttgagcgtaaaaacaaagggaagaaaggcgaccgcgcccgcgatggcgcctgcaacgatagcgagcagatcggctatctgaaacactggcgtcctcactttctttttttaacgcttcccagaacagttcccgccaaacattggtgactattgtacgagccaatcgctaaagtacaaccgaaaaagcatcggttaatacgcacctgttcgttttcttaagaccttctttatgccgcaggtaggtaatacgtttttctcgaacccctctgggctaaacgtccgttaacaggagtgcgcgcggtcgccttttgttcgaccgcgcgcaccgtttcttcgtatttgcagccgcggccgtcttagcccagcgactagagcgtgccgaagatgcggtcgccggcgtcgccgaggccgggaacgatgtaggcggcctcgttgagatggtcgtcgatagcgcaggtatagatatgcacgtcgggatccttctcggtcagtgacttgaggccctcgggggccgcgacgatgcacagcatgcgaatgtccttgacgccgcgctcgcgcagatagctgatggccatctcggccgagccgcccgtggcgagcatagggtcgacgaccagacagatacgctggtcgatatccttgggcatcttgcagtaatactcgtgaggttcatgggtaacctcgtcgcgctccatgccgatgtggcccacgcgagcggagggcaccaggtcgaggataccgtcgaccatgccaaggcccgcacgcaggatgggcacgatggcgagtttcttgccggcaagctgtttgaacgtggcagtagtgatgggggtctcgacctcgacgtcttccataggcaggtcgcgcatggcctcgtagccgtcaaaaagcgcgagttcgcgcacgagctgacggaactggttggtgccggtgtttttgtcgcgcaggatcgacagcttgtgctggacgagcggatgatcgacaagcgtcacacgggacgcatcgtaggtgacggtcatgggttgattgcccctttcgttgcagccgcaaaacggccttgctgacaaggcgcgcagcaatgttgccgccgcacgccatgcataagtttagcggtttgttgtatcgagcagcccatcgcagccctactgtgcggtactgagcgagcgcttgactgcatcacgccagcccgcaaggttttgctcgcgacgctcggcggacatatggggaaggaaggtcctaacgatctgggcattttgctccagctcttcaaggtcttcccaatagccgacggcaagacccgccaagtacgcggcaccgattgccgtggtctccaccgtctcgcattgcagcacggggatatccagcaggtcggcctggaattgcatgatgaactcgttgcgcgaggcaccgccatcgacagacaggcgctcaatcgaaagccccacgtcctgctccatggcgcgcagcacgtcgtagctctgatatgccatggattcgcaggcggcacgtacgatggtcgcacggctcgaggcgccggtcagaccgcacacgataccgcgggcatgcgggtcccaccagggagcacccaaacctgcaaaggcgggaacgaagtagcagccctcgttgtcgctaatcgaagcggcgagttgtgccgactcgctcacactcgagatgatgcccatgttgttgcgaagccagttcatcgttgaaccggcggcaaaaatagagccctcgagcgcatagctgactttgccgtccgcagcgataccgatggtggagaccaggccattcttggattcgacgatctcgtcaccggtgttcatgagcataaagcagcccgtgccataggtgtttttggtctggccgggatagaagcagcagtggccgaacagcgatgcctgctggtcgcccgccacgcccatgatgggcggcatgttggtcatgatgtcgctcgcgacgcggccgtagtcgcccgagctccagcgaacctcgggcatcatggaacgtggaacgtcaaagagcgccagcaggtcgtcgtcccaatcgagcgtatggatattaaagagtgccgtgcggctggcattggtgtagtcggtggcaaagacctggccgccggtgaggttgtagatgagccaggtgtcgatggtgccaaacatgaggtcgcccgccgccgcgctctcgcgtgcgccgtcgacgttgtcgagaatccactgcaccttggaggccgagaaatacgggtcaagcgtaagtcccgtgcgggagcgcaccagctcctcgcaaccctgttcaaccaacgcgtcgatcgccggcgcggtacgacggcactgccatacgatggcgttatagatgggctggccgctcacgcggtcccagaccaccgtggtctcgcgctggttggagatgccgatggcggcgatgcgatcggaatggatgccgctcttaaactgaacctccatcatcacgccgatctggctggcaagcacctccgtgggatcctgctccacccagccggggcgcgggaagctggttttgacgctacgacgcgcctgggcaacgatgcagccgtattcgtcgacaatggccgcgagtaccgaggtagtgccgcagtcgagcgccatgatgtaggaaccgccaaagttaaacgaggcatcttccatgcccaggctgcccagattcaacgacatcgcttacacctttctattgcatcgggtcggacaggacccgttcgatctctgatgcgggaagtgcgccttggcgcaggatctggagcccgccgcgctggaacgacacgatggtcgaggcgtcgcgacacggggtctcgccggcgtcgacggcaacatcgaccccctccaggatgcgaccttcgacggcggcaaagcttgccggcgagggcgcgccgtgtgtgttggcgctcgtgcaggcaaggggactgccgcaggcgcggatgagcgcttggaccacgggagaggccgaagcgcgcagggccacggtgtcgtcggcagcacgcataaaggtcggcacgcagggagccgccttgaccacgatagtcagggctcccggccagcatcgtcgcgcaagtacgcgggcatcttccgggatatccacgccatagcggtcgagcgcctcgacgccatcgaccagccaggcgaccgtttgggtgagttcacgttgcttgagagtgaagatgcgtcgatagccggtgccgagcgcagggactgcggcaccgttgacggcagcctgcggatcgcgcggccacgatgggaattcgcttgtatcttggggcacggcgtccgagaaggcgttgactgccacggcgacaccgtagacggtctcggtcggaatcaaggccaggccgccgcggccgagcacctcggctgtgcgctcgacggcaagccgatgcggctcgcgcgttccctcgtatacccgatagaccgtctgcatgtgtatgccagccccttacgctctggtgaaagtttgtttactgaggggcattctcgcacgaaacgttcaacctatttggccagagtgcatgttggtttggtgagcggctctagtagtcggtgaaagtgagggggttaattgaagatttttagcgcgcaagcgtaacggtacgatcgggaaactcgatgcttgcaaccagttttccgccgaggctctctgcgtacctgctcagcgtgtcgagcctcatcgaacccaactccccacgctcgagctcggatacacgtttttgagaaacgcccatcgactgggcgaccgacgcctgtgttagatcttttaacctgcgaatctgagcaagcttataggcttcgatacgatcgcgagtcctctcctgctcggcggtaatggagtcgcgtgttatcccgcgagattccatatactcatgcagttccatctcgatcgagcctccttacgtggcgacggtatatttgctcggcccttggaatgttgatcgcataccaaccgttccattttgcccttgacgatcccgctcgcgacttatcacccgccaatagcaataccgcctggcgcttggggtcaaaggcgaagaggatgcgaatcacctgcccaccacacgacgtcactctcagctcctttaaatgatgaagcttcgagccctttacgcggtcaaccagcggacgaccaaggctgggaccttccttctcgagcaccaaaaggtctgcataaatctgcttcagcgtagcttcatcctgctcatcaagccaaggttcaatgtaatcaagcacgatacggtaccgatgcagctgatttgacatacctttctccttctatagtagaagttttacggtatattgcaaggacaaacttgcgcaaatgtctattaattcagcttaaatacgctgtttgggctcggtgacgatggctcggacgatgcgggggcgatcggtgaggtcatggacgatacgcacgtccgaaaggcctgcctggcgacagagctcggccgcggcatcgagggcaccctcgtagagctcgcaggcaaacaggccgccggcgcgcagcatgtaaggcgccgcattgagcaggcggcggaaaatatcgaggccgtcggcgccgccctcgagcgccaggtcgggctcaaagtccttgacctcgtgcggcagcgagcgcatgacgtcggtcgggatgtaaggcgggttggagacgagcacatcaaaggtgccccactcttcgcggggaatggaactcaccaggttggtgaggctaaaggcaacctcatctgccgtgaggccgagggcgtcgcggtttttggtggccagatcgatggcgcgcggctcgatatcggtggcggtgcaggtaacgtggccgcggcgctcccaggcaagggagagcgaaatgcagcccgtgccgcagccgacctcgagaacgcgggcagtgcagggctcggttggggcaggcgcagcggcatcctgagctgaagccgtctcctggccggcaccctcgatggcgatgccgtattcgtcgagctcgggctcggcggcttccgcggcgtcggcttctgctgcctgcgcggcagcttcctcggcctcgcggtcggccagctcctcggcataggcacggctgcccagcacgtcgctgcctagcgccgcctcatcggcggccgtcaggttagcggcacggcgctcgacagtcgcgcgctcgtcggccagcgccgcctcggatttgcgggcctcttcgacctcatcgttccaaggcagctcaacacgctgacgggcagcagcctcggggctcagcacctcggcatccagataattgaggacttcctcgacgagcatctcggtctcggggcgcggaatgagcacaccgggggcgcacgcgacgtcgatcatgcgaaactgcgtgctgccggtgatgtattgcagcggctcgcccttagcacggcggacaacggccgcatgcatggtctcgagctgggccgcgttaagcgtctcgtccatacgcatatataggtcaatgcgcgccaggcccgtggcggcgcacagcagccactcggcagaaagacgggggtgctcctcgccgcgctcggccaggtactccttggtccactcgagacaacgcttgatggtccaaatctcgtttgccatggggccctcccctcttaagcgccggacggcgcgcgaatgtcggagcagattgtacgcgaggccagcgcttggcaagggacgattgaaggcgattatcgagaatcagcccagaattttgcaccgggcttgctcaaagtgctcattcgtcgacgtctaaatctgcattcgtcaagcttttggcaaggttgacccaaaactggccaatatctaaccaagaacttgccacatcgcttgacgcacgacccatcaaaaatcgccccgcgacttctcggacgctttttcgagcaatattttcgatagcagatatatgccgtcaattaccttaagcaggtaagcagctcaaatgacatcacagccgactgaataaaatatcaaggcaatgtcaccaatgactgccctacggatcatttgacaaccaaggaaacgccgatgttttggcaatgccagcgagcgacgtccagagcgaacaagttggcatcagaaccacccttaaaaagggtggtttgctcttagggtataacccacgggcccagtcccttgcggcgtagttcttatttaagccgtccaggttttggggtgcagttcaagacagggggcgtaaagacgaaagtgaccgtcgggcgaaacgccgccgttccccgattgggtgtactttttgagatcgtcgacttgtgccaggatcacgcgtgcacgacgcgcaaattctctgcccgccggagacaaaacagcctcccccgccgatcggtcgagcaaaacaatctgatactcagattccaactttttgattgccgacgaaacggcctgtgggctcacgtgaacggcgcgagccgctttgcgcacgccgccgtagttcgctaccgcttgaaggtattcgagttgagaaagctgcataggttactccaaaggcagccaaggcgacaggctgtgcgtcctcagatgaggttctcgcccaggttcttgccgccgaggacgtgcatgtggaagtgcatgacggtctggccggcgttgacgcccttgttggagatgacgcggaaaccgtcctccaagcccttggccttagcgacctcctggatggcgtgagccatggcgcccatggtctcggccggtacgttgtcggcgatgtcactgtagtgtttcttgggaatcacgagcgtatggaccggcgcctggggattgaggtcgtcgaaggcgatgacctggtcgtcctcatagacaacggtcgaggggatctcgtggttggcaattttgcagaagatgcaatcgcacatggttggttcctttctcacagaccaaggcaattatatttggtcgggatggttagaacgagaggttgtcgtcggtgttggcggcctcgccgtcggcgagcacgtcgttgccgtcgacatccttaaggagcaccgagaccttctgctcggcatcggacaggcgggtgcgcaggctttttagaagctcaacgccgcgggtatagctctcgagcgactcctcgagctccatatcgcccgactccaagctgcggatgatgagctccagttcctgcgaggcctgcttgtacgtaagctgctcgaccggggtcttctctgccatatctgtttcctttcctaaaggttttcgctatgaaacgcggactactcgactgtatcgaccgttgccgccacgttgccgtctgccatgcgcacgcgaatggcgtcgccgggcttaaaggtcttggcactcgtagccaccccatcatcgctgtacgcgatggaatagccacgggcaagcaccttgagcggcgacagggcatcgagcgacgcggcagctcggcccaggtcggacgcgggcttgccgagcatcgtacgtccctgatgctccagacgggaactcgcaagcgtgagcgcatggcgtttgccatcgagccccgaggtgcttgcaaccagacgctcgggcaagcgttcaaagctggatcggaaagctccgaccgagcgtactatggcacccgacaggcgatcggcggtcagcgcaagctccgattcgcgacgctcgaccataaatgtggggtcgttgaggcacgggcggcatgcagccgcatcgagcgcatcgcccaagcgggccgtataggtatcccaggcacggcgaccgcgctgatcgagcatctccaggtcgacctgggccgacccaatcatcgatgccatcgcggcacccagacgctgatggcgtgcctcgagcacatcggccaactccgtcatagccggcgccaccgattctgccgccgccgtgggcgtggaggcgcggcggtcgctcaccatgtcgcaaatcgaggtatcgggctcatggccgataccggtcaccacgggcacgggacaggcagccaccgcacgggcaagctcctcgtcgttgaaggtcatgaggtcctcaaaggagccgccgccgcgcaccagcaagatgcagtcgggcgccggcgtgattgcggcggcacggcgcaggccctcaataagctcggccggcgcaccctcgccttgaaccttagcgcccacgcagacgagctcgacgagcgggttgcgacgacgcaatgtgcgcttgacgtcgtcgattacggcacccgaaagcgaggtaacgaccgccacgcgggagcagaacaccgggatgcggcgcttgcgcgcttcgtccatcaggccctcgcggcgtagcttttcggccagttgcgccacttgttgacgcagcagaccctcgcccgccagcgaaaatgagcgagcgacaaagctcatgcggcccgtggccttatagagattgaagctgcccttaaagctcacctgcatgccatcgcgcaagtcgaaggtgcgcttaaggtaggcgcccttccagataatgcagtcgacggcggccaagtcgtccttgatctggaagtagcagtgaccgcttcgggcgttaggaccacgaaaacctgtgacctcgcccagaacgctcagctgcggaatggcatcgagcgcaccggcggcgatctccactgcctggctcacgctgagctccttgcgctcctgatcgtccgaaccgtcgaactcggcggaaacggcattgccggttagattccagcctgccacgcagcctcctttcgctatcgagcacaagggcttcgaccctgcgcagattcaagtccaacacatagtacagcgccgcggggacaagaatctccgcggcgcctgtcaagccaatttgttatcggttggagtttctgttgtagcgggccatcaggtagagcagctgaataatcgaggtgagcgccgccgccacgtaggtgagcgcggctgccgtcagcaccttcttggcaccgttgacctgcttggaactcatgcccgactgctcgatatacgccacggcgcggcgactggcatcgatctcgacaggcaacgtaacgagttggaacagcacactaaacgagaagaagatcaatgcgagggtcgtgagcccggcgatgttcataaacaggcccaagagcaacacgatggtccaggtgttctgggtaaagttgacgaccgggaccagggcggtgcgaaccttcatcatggcgtaaccgctctgacgctgggcggcatgacccgcctcgtggcaggccactgcaacgcttgcgaccgatccgcccgaacggttagcgtccgagagatacaggttgttatcctgcgggttgtagtggtcggtgagctcaccggcaacgcccttgatacccacggcgttgcaaccgttggcgtcgagcatgcggcgagcgaccgtggcacccgtgtcgccgtccgagcgaaccttggaccaggtcttgtacgtcgagttgatatagctctgcgccgcaagaccaagcaccgtacaaacaaggacaaccagcaggtacagcgggtcgatgccaaagccgtaaccatagtaatagggcatgcgaattcctccgaatcgaattacacgttggaggcattctacccactcaagcggctaggcttccctacaggagctcaatctttccgtccttcacggtgagtcccatattgccggaaagcagatcgtccagacgcgaacccacgagctcaaagcgccagccttcgcgcagggggctttgctcgggatgctcaatgtagtcggccaggtcatcgcgcgaggcaatgaccgaggtcgccacgcccgagcgctcggcaaccaggcggatgagcgcgtacatgagatccgtcacgctctcaagctccggcgaaatctggcgatgcccgcgcaccatgagcggcaggcgatcgtgcggacagcttgcgccgcgcttgatggccatcaacgcgccatccacgtcgcgctcccccagctggtcggtaccgcggatgctacggaactcctcgacacgcacgggattgcgcttaaccagggccagcagcgtatcgtcggacatgacccacttgcgcgggatgttgcgacgctcggcgcggtcctcgcgccaagcggcaagctcgcgcgcaatgcccagctgatggcggctacacgagttgatgcgtttgaccttgcggaatgcctcatggcggtcggcgcggtagtgcgactcgtcggccaaaggacgcaactcgtcgagcacccagtccacgcggcccagctcacgcaggcggctcatcatctcggtataggcgacgattaagtacttgacgtcatcgatcgcgtactcgatctgcttatcgctcagcgggcggcgcgaccaatcggtcagcgactcggtcttgggcagtgatacgccgcagaacgtctgaacgagcgcaccatacgaaatctgctggcgctcgcccaaaaaggcggcggcaacctgcgtgtcaaaaatcggtcgcggcagtgcgcccacggtatggagcataacttccatgtcctgtgagcaagcatggaataccttgaccacgccctcgtcggccataagctcggcaagcggcgacaggtcgtcgatcaccagcggatcgaccgctacactctcggcaggggtggcaatctgaaccaaacacagacgcggatggaacgtgcgctcgcgcaaaaactcggtatcgacggcaatcgcgtcgaactcacgggcgcgctggcaaaagtcgagtagagcctgatgtgtggaaatgtacatatcaacccatcgaataaggttaggcccgaaaaacacgggtaggatatcggcattgccttacaactatactcggttagtcacagaacgggaacgtaagtatgcgctgccttatcatccacaacccggcatcgggccccagctcagatgaaatctacgcattcacgcacgcccttgcacagggcggcgacgaagtcgtgatgcgctttatcggcgatggcatggagcccgaggacgccgtggcagacgttcgcgagttcgaccgcgtggtcgtctcgggcggcgacggcaccgtctccaacgtgctcgaccagatgcgcggctgcggcgtccccacgctcgttttcccctccggcacggcctgcctgttctttaacaacatcggcaatgcccccgaggcagcggcgcttgccaaggcatgtcgcgccggccgcacggtcaaagtagacatgggcgagctcttttggctcgacgagaacggcaacgaaaagcgccatggctttatcatcatcgccggttcgggctttgacgccgagatcatgatgaaggccgcccccaccaaaaacgacatcggcgagatcgcctacttcctctccgctctcgccacgcccaaccccacggtggcgcactttaccattgagcatgatggcattgttgaggagctcgacggcatctgctgcatggcgggcaacacgtctgtcatccaaaacgacatcaacctgttccccaactgccgtatgaacgacggcatggtcgacatcgtcgttattgagcccgtgcgcacggtgcagttgctccccacggtaatcaccgccgcgctcgaccccgccggcaaggtactcgggcgcccgcagttcaagatcatccagaccaaggaagccaagatcacctgcaccccgtcgctgggcatgcagttcgatggcgagattatctccagcaattcgggcgtctttggagcccgcgcgcttccgcaatgcctcgacctcatcgtcgacgaattctccccgctcggaaaataggaggaccctatgaacgacaatcccctgctcggctttatcatcatcgttttggccatgctcgtcggctatgcgatcaacgtgatccaccgccggaagaagtaattccacattggtatgatattcatccaattatcgtctcccctgctgtttatgcatttgccaaacagcaggggattttcatttcaggcattcccagctactttattcggctacagtaattacagggcgtctttattaaagtaaagctacaaactgagtacaattaaccgctcgtcgcatatttcatcacgcttatcgagtaagtgtctttcatagatgaatattgtttccagttcgttacgctaatggggtgtctttattggctgaagccctctggcgacagagggctttcgcacgctgggagggaaaatgaggaaaactcaccccgtcaacgcgctcaagaagctaggcataggcctcgcctttggagctgcaaccatcatgtccatgccgacatccgcgctcgcctgcacgcagatatacatgggcaaaaactatacggccgacggcaatacgtactacggccgcgccgaggactttggcaagcgctatcttaagcactacggcatcgaacctgcccacgaacctggctttaagtacagctcgattgaatctgcttttgaatacacttcgaacaagcctacctatcgttacagctatgtacgcgaccacccctccaactggatgggtcgcaccgacgcctattccgaggccggaatcaacgagaagggcgtctcctgctctgccacgctaagcacttcctataacgaggaggccgatgcagcagaccgcatcgatgagaaagtgggtctgggcgagtacagttacggcagcatcatcctgggcgagagcgccacggcccgcgagggcgtcgagcttctcggcagactgatcgatgatcaaggcgtctgcaccaacgaccagatcatcatcgccgacaacaacgagacctggctgttcgccacactttccgcccatcagtggatcgccatgaagctcgctgacgacgtcgcgtcgctcaaccctaatatcgggagcctcaactacgatgtcgaccttgatgaccccgagaactgcctacactccgagggcatcgagtccatgcccgtggagaagggcttcgccaaatactccgctgacggcaaattcgatgtcgcccaaacgtatggcgaaagcctcgccgattccggcgtaaaccagtggtcccgctatgtgcaaggccgcgattattttggtagtcagctgaccgaaggcacagattacgacattatcacagtaaagaaggatggaaaacctgaccaaaagggagccatggtcagcgaaatccagcccctgttcttcaggcctggcaagtctggctggagcacctttgagctgattcgtgcctttggcaaccgcggcgagaacgtccctggcctcaacgcgaacactgatggtgtttattgcatcggcagcgagcgcaacaccgagatcaacctcttccagattcgtcgcgggtatgaccccgaagtcgctaccatccagtgggaaatgctctcccgcgccgcgtactccgtcgccatcccgttgtactccgctctgataactgaggtcagcccgtacttcagcgatcagaccgtctccttcgatcactgcaaccagactgacgtcgtgtacaacgaggagcccgagaactcaatcaactacgtcctcatggacatcagctcgctctgcttcgagaaccctgacacccttggtgtcagcgtccgtgcctacctcgatgcgctccagaacgagcttatcgagcagaacaaggaagttgacgccgccatgctggccgagacgaccaccgagggccgcaccgccctggccaacaaggccggcaaggctgctaccgagaacacctacaagaagtgcaaggcactgctccaggagatgcgcgcctatcagaaggccgaaaacttcgaccagccctttaccccaagcgacctgaacaccgagaccaacggcctcaaggtgtccatcacctacgccaaggatgctcttgccaccgatccggtcaccccggatcagcccggcactcctgagcagcctggcactcccgagcagcccgctaagcccgagcagcccgctaagcccgagcagccggccgccaagcctgagaagcctggcaagtccgacaccacgaccacggtaaccactaacaagacgaacaccaagggcggcctgcccaccactggcgatcgttttgatggccgcatggtggccgcattcgccatcgctggcgttgccgtcatctccgcgggcggttacttcctctaccgtcgcaataaggagtaacgtcctagctgtgcgggcgaggcagcaatggcagcctcgcccgctcagcccgctcttttgaccggcgggaaacccgcctgaaatcttttcaaaaaagatttccccgcacacactttgctgtgttatagtgcagcgcaacagcaactaggtgcgaccgcgccatggcatcacgaaaggagccaccgacatgaagaacacgatgaagtctcttaacaactggtggtggcgtgatgcgaatacgatcggtcgacagtgagtccctcacgcctgtttttgcgctctaggtgattggaaggcctccggtttcgaccgggggcctttttctatctcgagcccgatcgcattcgcatcacgcgcctccgcttttctcttgcactcccattccaaaaggattttcaccatgtctcagaacaccaccgccacccagccccgcaccgtccagaccgccgaccgtggcaaactcgatgtccgcgccctcgtcctgcttgccatcctgctcgccgccggcttcatcctcaacttcaccgtcggcaaggccatctcgggcatctcgggcggcatgatcagccccgagttcatcatctcggccttctgcctcaccatcctggttgttcgccccaacatcggccaggcgctcgtcatcggcctcatctcggctgccgtgatccagatcaccaccacttcgccgttcgtcgattttgccgccgagggcatcgccaccatgctcatggccggcatcgtcaacgccgccggcaagaacggtcaaatcaagcccgccatcgccattgtcgcaaccttcctgaccacatttgcctccggcgtcatcttcatggtcatcaagatggccatgctcggcgtggtaggcgagctcgccgccgccatgctgcccgtcgttgccatgaccgccgtctttaacgccattctggtcggcgccctctacctgcccatccagaaggcccttaggctcaactaacccgctcggctttacgagccaccccatcttggcgttaattcgtcgctcgcgtactcaagtacgcttcgctcctctttcgcgccaacctggggcccctcgtaaagccgtctccgtgcttcaccaccaaagactgtcccaaacaacgagcttttggggacgttcttaaaagactggtcatttaagaacgtccccaatgactatgaaaggtatccatggaaacgatcatcaacgtcgacgatgtctcgttctcctatggcacgcagaccgagcagacgctcagccacatttcgctcagcgtgaacaagggagatttcatcggcatcatcgggccctcgggcgccggcaagtccacgcttgccgcctgcctgtcaggtgccgtgccccaccactacaccggcacgttctttgggtccgtcatggttgacggccacgacacctgcgaggtctcgctgaccgacgtgtcgcaaatcgtcggcagcgtgctgcaggatatcgacacgcagatggtcgcttcgatcgtcgaggacgagatgctctttggcctcgagaactttggcgttccccacgacaagatcgagcagcgcttgagcgaaacgctcgagaccgtcggcatcagcgacctgcgtgaccgcgagatcgccaccctctcgggcggacagaagcaaaaggtggccatcgccgccatcctcgccatgcgtccgcgcgtcttggttctcgacgagcccaccgcggcactcgaccccgccagctccacgctggtcttcgagacgctgcgtgaggcaaaccgcacacttggaatcaccatcgtcgtcgttgagcaaaaggtcgccctgctctcggagtactgcaaccgcgtgctcgtgctcaaccatggcgaaatcgcgctacagggcgagccgcacgaggtctttgcgcacaccgacgagctccgcgccatcggcgtcgactgcccccgcgtcacacgcatctttaacagccttgaggccgatggtctggcaagcggcaccccttgcttagatgtcgatgaggccgagcgcctgatttcgggcatcgtcgaccccgcacatgctgccagcgacgcccaagcgcccgcaggctccccgcatgccccatcgttgcgtccgcacgccaaggacgccgagcccgtgctcaccttcgatcacgttgagtttgcctatcccaatggcggcgccgccgtacacgaccttaacctgacgctctaccccggcgagctcgtgggcatcgtcggccaaaacggcgccggcaagactacgctcaccaagttgctcacgggcctgcttaagcctgcctcgggcagcgtgcgcgttacgggcctggacaccgctgcggtccccacgagccgcatcgcccgcgaggtcgcaacgctcttccaaaaccccgaccgccagatctgcaaggataccgtgctcgacgaggtcgcttttggcctggagcttgccggcatcgaccgcgccgaggccctgcgtcgtgcccagctcgtcatcgaccgctttggcctgcccgccgacgaggcgcctttctcgctttcgcgcggccagcgacaaatggtggcgctcgcctccgtcgtagtggttgagcccaagatcgtagtgctcgacgagcccacgagcggccttgactaccgcgagtgcatgaccgtcatggaaacggtgcgcaccatggcagagcgcggctgcgccgtgatcatggtctgccacgatatggaagtcgtttccgactttgccgagcgcatcgttgtgatggccgacggccgtatcctcgaccgcggacgcacacacgagctgttctcgaatattaagctcatgcagcgtgcctacgtggagccgccccaggtcattgaactctcgcgccgcttggcatcctccgtctcccccgcttttgcgcaggtgagcgaggttaccgatatcgttcgcattaccaaggagatggtccgtcgtggttaacgtcatcgactatatgccgggcgacacgctgttgcatcgcctgaaccccgtcgtcaagctgggcctcgccgccgccatcatcatcggcatctttttgtccgacacctatgtggcgctgttaggctttttggcactcacccttgcgctgggcgcctacgccggcgtcgtcaatcgcctgttctcgctgctcaagctgctgattccgctcgcgctcatcatgctggtgctgcagttggcatttatgcgcgacggcaatgtggtgtggggctttatcaccgacacgggccttatcactggatcgaaggcctgcctccgcctgctgggcgtagcgttgccactcatcctcatgctcatggtgaccaagctcaacgaccttgccaacgcctgcgtcgaggtactgcacgtaccgtatcgctacgccttcacctttaccacggcactgcgttttgtgccggtgtttggccaagagatgaatgccatcatggaggcgcagaccgcgcgcggcgtcgagtacgacaccaagaaccccatcaagaagctcaaactcatgctgccgttgtgcgtgccgctgcttatctcgagcgtgggcaagaccgacgccaccgcgcttgccgccgagcagcgcggcttttatctgcgcacgcgcgccagctcgtacaagcgctatcccatcaagggtctggatgtcgccgtgatcgccatcagcgccgccctcattgtcctcggtttcctgttctagctcatcgtcagcaccaaccgcctaatgcaaaaggcctcggctcgaccaaacgagccgaggcctttactgtttccccagataaaacctaccaaaataaacctgtccctttttggtaggcatggggctagaggcggtagggagcgccgctgcgaatgatggattcacgcaccaagacgtccatggcgtcgagggtaatctcgggcatctcgcggtacttctgcaacactgagagctccgtgcaagccaaaatgacgcgatcgcagccgctgcgggcgaactcccacatcacgcggtcgaacttgtccatatcgggctcgcgtccggccttcacgtcatcatagatcagcgacatcacatcggcctgacgcttctcgctggggtagacaacctcgacgcccacagcctcgcattcgcgcccatagacgcccgcacccacggttccgtcggtgcccatgatgccgatcttgcgcaccggctctaccggcatgctcaggttgggatcgaactcgcactcccccatcaccgcaccggccagagcatagcgcaccgactcgcgcggcatgtggataatcggcaccgtcgtaaacgactggatctggtcgtagaagtagtgtgacgtgttgcagggaatggcgatgtgcgtacagcccagcgactcaagtgcctgggcgcactccttcatggtcgccagcagctcggcatgctcaccggtcttgatggccagcgtgcggtcgggcatggtcgacttggaaagcaccaccatgtcgatatgttcctggtcgcacgtagcggccgtatggcgcaccacctggtcgtagtaatacgacgtggcctcggcgcccatgccgccgataactcccagcttttccatcgccgcctccttggtgacgcttgcgcaattgcgcgtatcatacccgcgcccgcccgatgtaaaccggacgggcgccgcactcgtctacttgtaatacgtcttgaacagcttaaagtgacgcagcttggtgtgccacatgcgcagccagcggttaaagacaaagtcgcccttcataaacgaagggtcggcccccttgccctccctatccaggcgatgcaccttagcgcgcagctcgggatccttgacgtacttgtcgacgacacccatggggacgaccatccacagcgcctcgtcctgcgccgtcacaaactccggctcaaacgggcggttgaacacatactcgtctaccacgtacttggcaacgttaaagccgctgttggtgacatagtagttgctgcggccctgacgggtattgaagtcgaagaacttaaacgagccatcgcgctcgtcatacttcacgtcaaagttggaatagcccacaaagtgaaggtcctcgagcagcttgcgcacgccacccataagctcgtcattgggctcggtgatgatacaggcatggttgccaacgccatggggctgatgctcctcgagcagcacgtggcccaggcacatcatgcgtaccttaccgttgcgatcggaatagctggtgagcacgcgcatgtactcgtcgttgccgggcacgcggtcctgcaagatcaggtcgtcggtgtagccgctggcataggagtcacggataacctgctccagctcggcgcgatcggcaatctcataagccttcttctggccctcgaactcatgctgccaccacatgatgccgtcggacggcttcaggatcatcgggaacgggaagtcgatctggtcgagcacttcggccggcgcctcgccttgcgcattgagcatctgcgcagtaaaggtaaaggtgtgcggatacggcacgccatgcttctcgcacagctcgtagaagatctccttcttctggcactgctcgagcatgctgtagggtgcatagggcgcaacgatgttatccgccagctcatcggcatcctttgcctgggccaccagggcaacatagttatcgccgcagcccatcaggacgatcgtcttatcggcatgcgcctgggcaatgccgttgacggtctcgagcatcacgggcatggtatcgatgtcgacattgggcgtgtagtcgataatctggcttcgatacgcagggcccgtctgatacttgccaaagaccagactcttgacctgatactcttcgtagaaggcgcgcgccaccgaataggcgttgatgtcgccaccgagcagcacgggaatgaactcgcgctctgtaaactgcaatgccatggaaacttcctatcatgaactgcccgcacaacgggcggtcttagtgcaaccgattcattctagcgtgccaaaccgccagcacccaaagttccaccgtatctatggcaatcggagaatcagactcgagcaaagacggcgctcaccgctgtacgacaacgggcaatgaacctaccgttgttgtaggattcaacatattgtcaatctcataagcgaaaggcgcacacgtgccccaagaacatctgaccgacaaccccatccttgacgccgcaaaacgcgagctggcggaacgttctcagacgatcgctcccctacgcaccgccagcaacgcctacgaagcacccgcccgcatcgtttcgattaacacgtcggcgcacaaaggcacacgcaagtcacccgtctccgatgggcacgacaccgtcattgagcagtttggcctcgcttccgatgcacacgccgggcactggcaccgccaagtctcgtttttggccgcagaatcaatccagactgcccagcatcgcgggctcgatgtgcacgaaggcgactttggggagaacttcaccacacaaggtatcaacctgctttcgctccccctgggcacacagctcaagatcggcaacgacgttctggtcgagatcagccagatcggcaaagtctgccacacccgctgcgctatctaccatctcgccggcgactgcatctttccccacgagggcattttcggtgtggtgcttcgaggcggagaggtgcatgtcggagacgatatccagacagtcaagctcggcaacggcgcatgttctttcaccccagccgaggcgctcgaagaaattgagcaggctcgccgcgaggaaaccctataggtgcaaaaccccatgttggagtagcccttaaggcgtgaatctgcgatcagaccgagttccgtaacgttaaagttgaactctatggtttctcaacaattcactataactgcaggtcaaagccaaagcctcaagtttaacttgaccctttggaacctttaaggttcaagttgaggtcgaaagcagtagtagaataccgttcgaaccataacctacgattgattgcagagggattggatgcagcattcgaatcatcgcgtcgcagcgctcatcgcgtcgaagccagctcgtatcatcacgagcgccgcactcgctgtcgcactgactgccacgccgatgctctcccccgttgcggcatatgccgcctcgcaggcaacgcaggatcagctttccgccgcgcagcaaaaaatcgaagccgccacgagcgcctacaacgatgcccgcaccaaactcgacgacctgcaaaagcagatcgactccgatgaggcgagcatcgaggaaatcgaggccaagcttcccgagcagcaggccaaggcaagctccgccatgcgcgatctgtacaagtaccagaagggcaccaatcccatcgtgagcttcctggtcaacgcgcagagcctgggtgagttcatcaccacctgcaaatacaccaaccagatcacgagctcgagcgtcgatgagatcgaagagctcaacaacatgcaaaccgaactcgagcagaacaaggccgagctccagcaggccaagtcccagcttgaggcagaacagaaaaacgccgaggattcgctggcgcaggcccagcagctccgcagcgaggcgcaggcaaaagccgagcaggaaaatgccgccgagctcgccaagcttgaggccgataaggccgctgccgccgagaagctctcgggcgagggcgtaagcggcagcaattccagcagtcaggccaccaacaccaacaccaccatcgacaccacggtgaacaacgccaataccggtaattccgattacgattcgttcattaatgagtggacgagccgcatcgataattatcttgccgggtcccccatggcaggccagggctataactttgccgtcgccgcttggaataccggtgtcgacccccgttggtcccccgccatcgcctgcatcgagagcaccaagggcacttattgcgctaattcctacaacgcctggggctggagcgctcgtggcggcggttggcgcagctttggcagctggagcgagggcatctccgctcatgttgcctatctgggcgccaactacggctccacccttacccctgcagcggccaaaaagtactgcccgcccacatggcaggactggtacaacaaggtcgccgctcagatgaaccgcatctaagcgcaactgtaaagggccccgacgggcccttttcttttaggcagtggaggtgtcaacgacaccggtcgcattggcaaccgcaactatgacgatcatgcataggagcagcacgcccaatgccttgagccagagcttcgcgagcttcttgccgcgatagctgtcgagcagcgcgaatcgccgacgaaggcgacgcttgtcgagcagcgcaaaatgcataagcaccataaggccatcgacaaagaaaaagtactcgattataagaagccaggtcggatagctttggtttgctccggtggggtgaaagacggcaaagtggcttccggcaaagaatacaagcagcgagaggcagacaagcgtattccaaatgcgccccagaggctccggaatgcgagaaagcaggccgggcatagcaggggtggcaagcttaggaaggtctgtggaaccccggggctcttgagacgttaataccgtctctgacgccggggcacagtcaggcacaggcacaggcgcaggcgcaggaggccgcacagggcaactcaggtcgtatgccgcgcgcgtcgcccgtcccaatgcccccgcgctcgcaaaacgcttggccgggtcgagagccatcgccatgcaaatgacatcggtcagggaagcgggaatgccgcgcatctcgcattgttcgcgcatgtcgatccccggttttggatcgactcctgtcaagcagaagaacagcagggcgcccagcgcatacacatcacttcgcacactcgtctgcccaaacccatactgctcgggcggcgcgtagggccgtgtgccaaacttggcggtatcggcatcggcgccttcgcgccaagcgcgcgcgattcccaggtcaataatcaccagcgacgagaaggtcatgccggcatcggcggcatatctcacgcccgacacgatgatgttcgaaggtttaaggtcgcgatggataatcggagccggcgctttccccacctcgccaaatccagcatggagctctgccaccgcatcacacagggccggaaacaacccgcgcgcataatcgggggtcgcacccaaacgtcccaccaaggcctcgagcgtctcgccttcaatgtattccatcaccacgtcaagctcgtcgcccgcacggcggcaatcgacaatccggggcaggtgctcaaaacgccgtccggcacgctgggccgcaaacaggcgctcatatgccccgccaatctgggccgaagcatcgatgcgtttgcggacaaaggggccgagcgaccctccaccagaaccctcaaagcacacgagttcggttgtctcaacgtccgagcgctttagcacgcgttccacgcgatagctgtcatcgcggtcaaacgacgccaggtgctcggcgagcgcggcagtcagctcatcatcggaatatgttgggttctgagtatccatagcgtccatcatagcgcagggcacagacgccctgtagcacccgtgccctgcacgtttgaaatatagcggacggccctgccaccaacagtcagccgttaactcaccgtctcctcgccaaagcgatacagctcctcattgaccttttgcaggctgcagccacgatcgatgcagaagatgataatcgcatcacgacggtccttgcagttgaggacgtttgccccggcagccgtaagtgcgcggttggtctccttcatcgataacgccatcgcgaatgcaatctgcagcactttatttcgactcgggtggcgcgcgcccgtaaaaatctgatagccaaacgtttcgttgaggtcggccatacgcaccacgcgcgaacgctccaagcccttttcctgcagcagttgcttaaggtagtccgaaagcgacggggcggcaaagtcgtgctccctgatatagccgtcgatactcggcgcatcgagcaactcattgagcagttcctccgtcaacttcttatcgggcatacggcttcaccccctatgcgacgcaacggcagcgacatactaggccaacacccagcttgcggtggcagacttatcaaacatgttggcaaagtacaaagcctttttgatgtcgccgtcaaaatagatattgcccgcaacagtaccgccggctgcaagggtgcccgactgcagctcttcagagccttcgctgtagtagccctgattctgctgagcaccgttggcgtcctcgcccttccagtcgtagacattgtaatccgcgccctcatcgccgttgttgacgtacgtgacgtgaatgcccgtcatagtcgagccgtcataattggtaagacctgtctggacggaatcgacgacaacggaaaggccggcggccgtggtcacggttgtgccaacagccaggtcagtcgtgggctgctcttcttttaatatgagaaagccattgtcaataggcatgttcgtttgagcccggtttaaatcccatgcgaacctccagtccggaccgcttcacggtccaactttctgtccgcacccccaaacggccccttttcgttctcggggacaaaaatcgcgcgtctactcactcgggataaatccttactcccattcctccgaataccgccccgtgccttgccgtctcgaaacacggggagtaaatcgcgaaattgcaggtgaaagggagtaaatagccaaagaaaaagcctccgttccgacgcgggaacagaggctcgataatcggatttactcaccaatgtcgctggcggctttgccgtgactctcgtacaaaacgaaactcagcagcacagtgcggcactcaaaaatacaggtcagaaccctgtcagactactcccactcgatcgtcgcgggcggcttggacgtgatgtcgtagcacacgcggttggcgccgggaacctcggcaacgatgcggccggagatgcgggcaagcacgtcgtagggcagtttggcccagtcggctgtcatagcgtcgctggactcgacggcgcgcaggatgatcgggcgctggtaggtacgctcgtcacccataacaccgacggacttgatgtcgggcaggaccgcgaaatactgccagcagctgtgctcggagttgcgctcgccagtctgctcaaacagacgctggttgtaggcgtcgagctcctcgcgcacgatagcgtcagcgttcttgaggatctcgagcttctccttgtcgaccgcgccgatgatgcggatggcaagacccgggcccgggaaaggctggcggaacacgatgtgacccggcagtccgagcgccagaccaagcgcgcggacctcgtccttaaagaagtggtcgagcggctcaataaggtcgaagtgcacgccctcggggaacgggattaggttgtgatggctcttgatggtggccgtcttgccgcccgtcttgcgagcgccggactcgatgatgtcggggtagatggtgccctgagccagatacttgaccggcttgccatcggtctcgagctgctgcgccacggcgaagaactctttccagaactgcgtaccgatgatgcggcgcttctcctcgggctcggtcacgccggccagaagctcggcataacggtcctcggcgtggacgtgaataaagtcgacgtcaaactgcttggtgaagacctcctccacctgctcgggctcgcccttgcgaagcagaccgtggttgatgaacacgcaggtcatctgcttgcccacggcgcgggcgcccagcgcagccacgacggaggagtcaacgccgccggacagagccagaatcacgcggtcgtcaccgaccttctcgcggaactcggccgtcatggtctcgaccaggtcgtccatgctccagttgggctccaggccgcagatctcaaacaggaaattgctcagcagctgctgaccgtactcggagtgcttgacctcggggtggaactgcgtggtgaaaatcttgcgctcgacgcactccatggcggcaaccgggcacacgtcggtgctggcggtaacggtaaagccctcgggcacctcggaaacggcgtcgcggtggctcatccacacggtctgctccataggcgtggagttaaagagcttggcgccggccgtgcgcgtgatggtggcgcggccgtactcgcccacctcggagtggccgaccttgccgccgagcgccacggccgtgatctgatggccgtagcaaaagcccaggacgggaaggcccaggtcaaagatggcgggatcgatagacggagcgtcctcagcatacacggaagccgggccgccggaaaggatgagcgcagaggcattcatctcgcgaatctcgtcggccgagatgtcgcaggggacgatctcggaatacacgttgaggtcgcggacgcgacgggcaatgagctgaccgtactgcgcaccaaagtcgagtacgaggacctttgcggaagccttttgatccatggttccccctcttgttggcggggagccggtgcccacccgcgcgaataaacgagaataactttcatagtgtacacgttatatggggtttctcgtccctcgcagccatcagcgcacggcaaacgcacgacctgggcccctatttgacggcaattgaagtattaccaacgttacagatgatgtaatacgtttgaacattggacgccctgtgccacaatactgccgaacgactccgcctctgcggcggcaaatacgataggaataccagcatgaagcgcatccttctcatcgccacgggcggcaccatcgcatcgaccgaggacggcaacggcctctcccccgccctgaccggtgaggagctcgcccagagcgtccccgagatctcggggctctgcgagctcgacgtcgtgcagcccatgaacatcgacagcaccaacatgcgcccgagcgactggatgcgtatccgcgacgtcattgtcgagggttatgccgatcacgacggcttcgtgattctgcacggcactgacaccatgagctacaccgcagcagcgctttcctacctgattcaggacagccccaagcccatcgtgctcaccggctcgcaaaagcccatgggcaatccctttaccgacgccaagctcaacctgtaccagagcctgctctatgcactcgacgagcattcgcacgatgtgtcgattgtgtttggcggcgtcgccattgccggtacgcgcgcccgcaagcagcgcaccatgagcttcaacgcattcattagcgtcaactatccgcccattgcctacatccgcaatgaccgtatcgtgcgcaacgggcttcacggcacgcatcaggacgaaaacccggtgcatttctacgacagcatcgacccgcgcgtatttgtactcaagcttacgcccggcgtaaacccgggcatcctcgacgccctagccgatagctacgatgctgtaatccttgagacctttggcattggcggtattcccgagtttggcgagtccggcgagtcattccaggaggcgattttccgctgggtcgattcgggtcgcaccgtcgttatgaccacgcaggtcccagaagagggcctcgacctgggtgtttatgaggtcggccgcgcttacgccgatcatccgggtattttgcgcggcgatgacatgaccaccgagacgctcgtggccaagaccatgtgggcactcggccagtcacgcgatgcggcagagattcagcgtctgttctacagccaagtcaaccacgaccgcatcccgatggcttaatccctaaggcagttccgattatcgcagccttaaacgacaggtggtccccctcgggccgtgcaaaaatcggagtattctgcaatttctcctccggagacatagaatcggccgattattagacgaacttttaggacgaagggtccgtctagtaaatatttattcctcatttttatttagcgtgtggattatctactgtcaaaaaggcaaagccagccgctcgagctaccatctacggccgaactggtgctgaatactcgcgattttgcacatcgcaaccagggggacccgcccaaagagcgtcaaatacagcgggggaacgccctattcgataccctcgagaagctctgacaccgtcatgccgagtgcgggcgcgatcttaaatagaaccttgagcgtgaaatttgccgtcccatcttcgattcggtcgaggtagggtcggctgattcctgtcgccacacaaaaatcaaccttggagataccaaggtccctgcgtgtctcttcgacccgcctgccaagaatctgtttcgcacgttcgtccatgcagccgagtttgaaatggagtcgaacataaacgtaaactatagtttacgttttgccgaatacacaggagttttctatgtcggattcttcggtccgcatgtaccgagccacgcttcgcacaaacagcgcgccgcccaagctcgtcgtcgttgaagctgcatgcctttcgcccgatgagcgcacagcatttgcattgctatcaagtcgcgtcgtcgccgttctggtcccttgcccggcgaaaggtgaacttgccatccaatgccaaacgcacggctgctcgctcaatcaggctgccgtaatcgcaaccagccaacgcggcctgccgctccttttagaagccggcatagcactcgcccttcgcggcgccggatacgaaaacgaggccgccgccgatgtagtctttcaaccacgatcgagcggcggcctcgcatcagccattgaatatgcgtgcaggctcgttgcctaaaaggacaagctagaaaccaaagccaaagcccgttccggtaatcgccgagtacataaagtaaacgttgatcacgttgaggaacacacccgtgatgcaaccgttgcgcaggtagcgctcgcacacgatgcgcgccatggcggcggagtcatcattattatttgcctggcgtcccgccgtaaagtacgtcgccacgctcagcagcagattgagtaccggcagcgccaacagctcgtagctcttgccccagcgcgtcgcctcgccggcggcattaaacttcgttgccacctcgggaccaatgttggggataacgcacgctgcgaccaccagcggaatcaccgcaagtacgagcagcgcaatacccatgtagccagcttttttgccgtatttaaacatatgcgtcgcccttacacgttaaagcggaagtgcacgacgtcgccatcggccatgacatagtccttgccctcaatacgcagcttgccggcagccttggcgccctgctcgccgccgagctcgatgtagtcgtcgtaaccaatgacctcggccttaataaagccgcgctcaaagtcggtgtggatgacgccggcagcctgcggggcggttgcgccctgacgaaccgtccaggccttgacctccatctcgccggccgtaaagaacgactgcagaccgagcagcttataggccgcctgcgcgagcacgtccagaccgggctgttccaggcccaggctctccaggtagtcggcggcgtcctcgggatcgagctcggaaagctcggcctcaatcttggcgcagatgggcaacggcttgacgccatcgatgggcgccaggtcgtcgttgagcatatcctcgtccacgttggccacatacaggatgggcttcatggtgagcaggaacagccccttggcggcggcacgctcctcgtcggtcatctccatggatgcggcgcgcttgccctcgttgagccaggcaagcaggcgcttggcgacctcgaacttgggcatgagctccttgtcgcgcttggcctccttctcgagcttaggcagctgcttctcgagcgtgcccatgtcggccaggatgagctcggtcatgatggtgtcggcatcgccggcgggatcgacgaactcgcccgtgcggcccacctcacgcatgacgttggggtccttaaagtagcgcacgacctcgcagatggcgtcggtctcacgaatgttggccaggaactggttgcccaggccctcgccctcgttagcgcccttcaccagacctgcgatgtcgacgaactcgaccgtcgccggcacaatacgacccgggttaacgatgtcggcaagcttttgcaagcggctatcgggcacgtcgacgatacccacgttggggtcgatcgtggcaaacgggtagttggcggcaaggccggtctttttggtaagcgcggtgaacagcgtcgacttgcccacgttgggcaggcccacgataccgatggaaagggacacgacagctccttttgatacaggtacttcaaactgcataagtatagcgccgccgcagcatccgggcgaatccggacaccgcggcggcgcaaatgaagcagagatagagctcgctgactagtccgcgagcttctccacttggtcgagcatcttatcgagcttggcctttgcctcggccttgaccttctcggcctcctcgtgggccttggccttctgagcggccttttcctcggcctcggggtcgacaacgaccagattggacgcatcgtgctcgaccagcttgagcgcatgctcggggcacaccttgacgcaggccccgcaacctaggcaataggtagactccagtgcaaagcggccgcttcccaccaaatcgcaggcgaacgtggggcatacattgacgcactcgccgcacgacgtgcacttgtcaaaatcgcactccggcgtgctcacctgcatgttctgggcaagctcggggtggttttgcagcgtcgagagcaccagctggcgcccgtgcgtgagcgaacggcggcgcttggtcgtcgtggtaccgcacatggtgttgagcgtgcgctcaagctgcgtgatctggtgacggtgggccttcaacttctgcgtcaccgaggccggtgccgcagtcgccgggttgagcttggtcaccgtcaggcccgtggtgcgggcaatcttttccatgtactccttgcgctcgtactcgcggcgcttatggcacttgaggctcctggggtcgacctctaggcccatacctgtgccagaccactcttcggccttcgcaatcgcctcgcccagaatgtcctcaccgccggtgttgcggcacttatcgcacacgcccaacggcaggtagacgctcacgttgggatagtcggccagtaccgagaaccaggtctcggccgtaatatcgcccacgcaggcgacgacgacctcgttttcgcgcggcatgcgcttaagggcgcgcgtgcaggtaacgtaggcggtctcgtggctcgtagcagcagagacgatatcgtcatacaggtttttgggcgccagacgcggcgagatgattgcctcggtcggacaggcagcggcgcacaggccgcacttgcgacaggagtcgaggatctcgatggcgtcttcctcgacctcgatagcgttgaccgggcacacgtccatgcacgcggtgcagccgctcttttcgtttttgcaggtcaggcacggaatggtgttgccgcgcggacgctccttgtagtcggcaggattccactgcggcgccgacggatcgagcgcatcggtcacgccgccaagcgggtttttaagaaagtcgaaacccttgctgatctcgataatgtcatcaaacagatcgtgttcctgcgccatgcgcggcccctccctgagcagtgcaaacaagcaagagataatgatacgctatcggcccacacctcgggcaaattacacgcggtgcaccttgagggaaataacccatggcctatcgccgccccgattgcacaaggtcaatcaagcgccaagctatgcctcgcacatgagctgcacgagtttttgtttggtcaccttggcctgttcgttagccatattgcgttcgtttctaaagaccgcatccgcaacgctcatcaggtcggtatcggaaatctcgccaagtcccagctccgcgagcgtcgtcggtagaccaacgcgctggcaaaactcgagcacctgatcaagctcgggcgcacgctccaggcgcagctgcaccaccaggccaaatgccacggcctcaccatgcatggccttgcactcgggcagaatcgtcaggccgttggctatggcatgggcaagcgctaagccaccactctcaaagccaacacccgagagcagaatattgcactcgatcaggcgctcaaccgctggcgatgtacggccctttttgagatcgcgcttggcagcgacgccgcactccatgagtgtgtcatagcaggcacgagccgcaaccaaggccaagtgtcccggcgcgccaccgtgctcgttggcgccgtgcgccgcggcgcacgaacgcgcctcgaaatacgttgccagcgcatcgcccataccagcgaccgtcatacgcagcggggccgccgcgaccacgttggtatcgaccacgaccaggtctggattcttctcgagcatcaggtagcggtcgaacgacccatcctcgtgatacagcaccgaaatcgcgctgcacggaccgtccatcgacgccgccgtgggacatacgcacaacggcaactcggcataaaacgcaacggccttggcgatatcgagcatcttgccgccgccaatgcccaccaccatgtcgcaatactcggcccgggcttccttggccatttcgacaacggcatcttccgtacacggaccgttgtaaatcttaaagaacggctcgcttagatcttcatccagaaatccatcgacgatctgcctgcacagccgatcctcggtgccctggtcaaacaagacataggcagcgcagcccaaccatgacaaatacctgccctggcgcgaaagctcccccggtccctgaacataccgaccggggccgccataaaccataggaagcgccatacgagaatccacccttcatcaaacaacgatggtgcaaagtaccctgacccctttgcaccatagcaaaaaggggcaaagccatctgttggctttgccccttccttagcttgatttactcatccatgagatagtagtggcccagtgcgtcggcacccaggatggcgtttgcgaccatctcgggcgtcacctcaaacggcatgttgcacatggtgtcctcgggcgcgcacgcagcctcggcaacaatcatggccttctcgcgcgtaagctcggcaacgccaagttccttcatcgtgaccggcagacccagctcaatgcagaagcccaagacttcctcgagcttctcggtcggggcatcctcgagtaccagctggacgatggtgccgaaggcgaccttctcgccgtgatacatgctgtggcactcgggcagcatcgtcagaccattgtggatggcatgagcagcagcaaggcccgagctctcaaagccaatgccggagagcagcgtattggcctcgatgatgtgctccacggcaggcgtcagcgcgcccttctccagcgcgaccttggccttgacgccatcggccataagcgtctcgtagcagagcttggcgagcgccaggccggccatgccgcccttgccgccagcgcaggtgccgccgtcggcatcgtgcgtcgcctgggcctcgaaataggttgcgagcgcatcgcccataccggaaaccgtcaggcgcaccgggctcgccgcgataaccgtcgtatccataaggacgatattggggttcgccttaaggaagaggtacttgtcgaactggccgtcatcggtatagagcaccgaaagtgccgagcacggtgcatcggtcgaagcaatggtggggcaaatgataaccgcggactccaggtagtaggcgacggccttcgcggtgtcgaggatcttgccgccaccgacgccgacgacgatatcgcaaccgttgtcgcgagcgagcgcaaccaggcgatcgacctcgcccttggagcactcgccgttaaaatcctcaaacagcagctcggccttagcctcggcaaagccgccctcgatcttggcaccgacgcgcttcttgcccgaaggcgtcacgatgacgagggccttagcgccgagcggctcgacataggagccgagcttggccagctcgtccggaccctggatgtacttgctggggctattgaaaattgcagccataactatcccattctctaaaagaaaaaagaaaggggctccgtacagatacgtgcggaacccctcgttacgataacaagagtcgattagaaatcgatgtcggtgtcgtagtagcaggccttgagaatcttctcgaagtcggcagccttggtctcacgcgggttctcgggcgtgcaggcgtcctgctcggcgttcgcggcgatctcggggagcttggcgaggaactcctcctcggaaaccatctgcgggttctcggcgtcgaccttcacgccaccattcgcgtaatccttgatggactgcggaatgttgagctggtcgttgaggtcgcggatcttctggacgagcgcagcgataagctcctcgttggtctcgccgggaaggtgcaggatctccttggccacgtaagcgtaacgctcggcagcacggggatccttggagttccactggatgaccttgcccaggtacatggcgttagcggcaccgtggatgatgtggccgttctcgaaggcagcaccggtcttgtgagccatggagtgaacgatgccgagcaggcccgaggagaaggcgataccggcgatgcactgagcctcgtgcatgtgctgacgggcctcatggtcgccagcataggacttgggcagccactcgacgatctcgcggatgccgtgcagagcattggcgtcggtgaacatagaggcgcaggtggaaacgtaggcctccatgcagtgggtcagagcatccatgccggtgtgagcgcacagcttggcgggcatggtgtaggtgagctcggggtcgacgatggcgacatcaggggtgatgttgaagtcggccagcgggtacttgatgcccttggcgtagtcggtaatgacggagaacgcggtgacctcggtagcggtgccggaggtagaggagatggcgcagaaatgagccttctgacgcagctcggggaaactgaacggctggatgatgttatcgaaggactcctcgggatactcgtagaagacccacatggccttagcggcatcgatgggcgagccgccgccgatggcgataatccagtcgggctcgaactcgcgcatggcctcggcgcccttcatgaccgtctcgatggacgggtcggactcgacgccctcgaacagcttgacctcgaaaccgccttccttaaggtcgttctcgacgtcctgcaggaatccgccgcggcgcatagagctgccgccagaaacgatgatggccttcttgcccttgaggttcttcacctcgtggcgagcgccctcaccaaagtacagatcgcgaggattggtaaaacgtcccatactgtgcctcctaaacaagcccctcttagacttgcgtatataacggagcacccgattggctccgttaggaccgttttgcgcgttgccggcgatggcaatgcgcgatgtcttaacgcctcaacgctcagacaaacactattttaccgttctggttggtcagttattcacctaaagccgccaatgatgaaacgttttttctatccctgaagacccttgtgcggcattcatactcccaagctgggcaaacgttttatcaaggttgactacatatcccgggcaggacggtgcccctccaaaatatgcaccgttcgccgccaaaaatcgaccgtttgcggcaccgtgataccactcggtcgtccaaggtgccgacatttgtgcgacatccgtcttcgtggtgcaaaggtgcaagtccaagtgcggcacccccggtgtgccacatgcgggtaaactagaaccttatatagaaacatttgaaccctaaccgcagcaaaggaggctccatggcattcgatcccattcaagaggattgccatcgcctcgttcttgaggccttgcgccgcgacaatatcccgctcaccgacggtgctgccgtagagcgtctgatggaacaattcacccgcaaccccgcaccgctcatcgtgcacgaccgcgaccgcgccgggcacctcattgccaaggtggtcgaggctgtcgactaccgcattccctttatccctgacgatacccaggcagagcaagaagaggtagctgccgagaacatgctccgcgaggcagccgcgctcgatccggccaactgggatgcccagcgcatgctgaccgccctcaccgccagctccaacgaggaatacgtacagtacttggcatccaagcgcgatgaagtcgagcatgacctggcgctcaaaatcgcctcggcgcaggacccctacgagcgtgaggccgctggcgaccttatgcgccgcccctacctgcgctggcttgccgccttggcatcgcgcgcgctcattagcggacgctaccacatgtcgctcgaagccgcgaatcgcagcttggactttgcgcccaacgaccccgctggtgtccgccacaccgcgatgctcgctatggcaaagctcgaataccccgccgaggagctcaagcgatttcgctctgcccactccgtcccctatctcgccaacacgccgctgcgccgtcgtcccaaagatgcggagcgcgacttggacccgtggacgctcatcgcactgatgagcgcagcctggcgcgagctggactacgagggcgccgagcactacctgcgtatccttgcgcgctcgtgtccgcacgcggccgaggcgctctacttccaaaccgagtttcccgatggcgtctatgcccgcgtcaacgtgggtgtgggctccaccgacgagctcgtcctcgcgctgtccgaggcaacgccggtgctgcaggagggcctgggcgctcccgacaacgccagctttgccgcctgggtcgccaccaacgatatcgtgcgttcccagatcgacgagcgcatcctgcgggcggccgagcagggcctgccgtttaagggaggagacctctaatggatccgagcgtctacatccccgcctacctggagcgcgcctaccttgcgtcgcaccccgaactcaccgatgcagcacgcgagcttgtccataacgacgcgagcgtcaaccctcataagtatgcgcagaccgagcatgcccaggcactgctgtcctacgccggtgttcatcgccacctgctcgacgagctccatcgcatcgaggacatgggcagcgacgaggagtttgagcagacgcgcaaccgtctgttcgacgacatgcgcgatgagctgctcaagatcgtccgcatcgatgcgcatgtcctcgacgcgcagctgctcgccatcatcctggccgacacgcccgtcgacgcctgcctgggcgacctgatgaagctcgaagcgaccacggccgattacctgcagcaaagcgtgcccgggttcgacatggaagccccgcactactgggccaataatgttttgaccgacggtgtcaccgcagcagaccttaccgtgagcgagccggctcttatcgggtggctccacacgctcgaggccatctcgcagctgtgcatggcgagcgcccgctaccacgctgctgccaactacgcccgccgcgtccttaaggcggaaggctaccccacccgagctgcaggcaccgtgttgctcgccctcgctcgcctggaagaccaggacggcttttttgccctggctcaccagctcgaggaacaggtgggggctgatgcactcgagaactccccctggtacctgctcgcccgcaccatcctcttgttcaaaacaaacaagatgcgcccggcgacacgcgcgctgcgtgagtttgccaaccgttgcgagggcggcgcgttcttcttgctgaaccccatgtaccagacgccgtaccttccctgccggcccgagccgcgcgatccctgggatctttcgcaccaggccgtttgggaagcggacggtattatctcggacactcccgactttgccccctgggccaatgcctgtgaagacgtgtcacagcttgcccaggaatttgcgcgccgctacggtttttagtgacgcactcgacccgaccatgtcgtttacgttaggaacggtttcatgaacctccgctcatctctcgcctgcacctcgagcgatatcgcccgctggggactgcgctccgtccttaagcgccagggcggcgtactccccggccgcatcgccatgaagatcgatcccgagttgctgagcgacctcgctggccttgtcgaccgcagcgtggtgattacgggcactaatggcaagaccaccacctccaacctcatcgccgacgccgttgccgccagcggcgccaccgtggtatgcaaccgcgccggcaacaacatggagccgggcgtggtgggcgcactgctcgaagcgcgcagcggcctcaagcgagccggtggcggcaagcgcgtgggcgtttttgagtgcgatgagctttacaccgtacgcgtcctgcccaagctcaagccgacctactttgtgctgctcaacctgttccgcgaccagctggaccgctacggcgagatcgaccacacccaggacgtcatcgcccacgcgctggagctttcgccggcaacgacactcatctataacgccgacgacccgctgtgcgcctcgattgccgcgcgcgttcccaacgcgagtattgcctttggcatcgacggcgccaccaacaccgagtccgaccgtattagcgactcacgtttttgctcacagtgcaacgcgccgctggagtatgactacgtgcaatacggccagctcggcgcctaccattgcccctcgtgcggctgggcccgccctgcgcttgtccgtcgcgtgacgggcgtggagctcggctgcgacggctacggctttgacctggtctttggatctgcgtccgacgcagctgccgtacacatcgccacgcgctacaacggcctgtacatggtctacaacgttgccgctgcattctttgccgcacatgagttaggcgtggatacggcgcacctgcagcccacgctcgatgcctacgtccccgccggcggacgcatgggccgctgggatatcgccggccgcaccgtcgaggccaacctggctaagaatcccgtaggcttcgatcgacaaatccagtccatcaagacggcaggcggcagactctgcgctttcttcctcaacgataacgatgccgacggccacgatgtatcgtggatctacgacgtcgactttgagcgcatcgccgacacgccgggtcttgtcgcctttgccggcggcacgcgcgcacacgacatgcaggtgcgcctgaagtacgccggcatcgacgccgccatcatctcgaatatcgagcaggcgattggcgccgtggcagacgaggaggctggcgacactttctacgccgtcgccaactacacggccttcccgccgctggtcaaggagctcgacgggcttaaagacgacgatgcaagctcggttgcctcctgcgccgtaacacgcgccgatgggagcgctgtccccaccgatattgcgccggtcgagctttcgcgcccgctgcgcatcgtctacctttatcccgatgccctcaacctctatggcgacggcggcaacgtcatcgccctcgagcgccgctgcgcctggcgtggcattcccgtgcgcgtggacgaggtccgtatgggcgagtcgctcgatctcaccgacgccgatatcgtcatgatgggcggcggctccgatcgcgaccagctggccgtggcgcacgagctgctcgctcaaaaagacaaggtcgcggcctatgttgaagatggtggctcattgcttgccatctgtggtagctaccagctgctcggccgttcatactacatgggtgaagatcgcattgaaggcttgggcatcatcgccgccgaaaccgtgcgcggttctgaccgcctgatcggcaacgtcgccgtcaagaccgacctggcgcccgagccctttgtgggattcgagaaccacggcggccgcactctgctcgacgcagatgccacgccgcttggaacgtccgtcgtcacgggcaccggcaacaacggagacgacggcttcgagggcctcatctacaagggcgtcatcggcacgtacctgcacggaccggcactgcccaagaaccccgaactcgccgactggctcattacccacgccctcgagcgccgtggcgacgcgcaggccacagccctgctgccgctcaagcccctcgacgacacctacgagcgcgccgcccacgacgccgccatgaagctcctcccctagcacctcacaaccacaaaggggacaggcacctttgtggttgttttgacccatcccagcggtttgtctcaatctgtaacatctagaccgttaaaagtcgtcttactgttacagaatgagatgttcgtcccgacgcctgccttttgtctcgatctgtaacagatagagccaatttgcccgcccagatgttacaggttgagatgttcgaagatcgggatagagagccagctcctatgtggtggttttccagtttgccaacgatatacgcgccggcaaaaaagtctgctatactctttcccgctgtccccatcgtctagcggccaaggacgccaccctttcaaggtggatatcgcgggttcgaatcccgctgggggcaccatttgaattgaagagcccgttaccctcgcggtagcgggctttttgctacccatgcgccgggattcgaacccgacagggtgcggagctgaggaaacgcgcaagcgttttccagcgcagcacgcaaggagcgaagcgacgcagcgaaagcgggcggcgccagccgcacgcggacatcccgctgggggcaccatttaaatcgagaagcccgttgccctcgcggtgaaccgcgccccaaatcttggacgccctaaatagcgactaggccgcaagggcccacgagcgggggctcctatctttttagtgccctcggattgggtcatagtgtctgtcgttgccaaaacaacgtcgttcccttggttggcttaaagtggcacttttacctgcgacgttgccatcgctgaagtagtcattgggaaggcggcagctggggacgttccttttctgccggcagttggggacactccttgtgccagcgttgcaccgagtgcttgggaaaccgcgacccggtttttggccgaatagtgggtcgcattttccggatggggtgggttgcggaaactgcgacccggaatattgctctgaagtgggatgcggtttccctgatgcgcctcaaacggaaagcccatcccattccggagcttcaaaacgggatgcgctttccgcgcggaagaattgtcgcagctgcgttaagcagtgtcgctcgttactcgcccaggatcagcgctgcgagctctgcctgggtgtccaccacgtagtcggcgccggtggcttccagctctgcgcggccgcggaaaccccagctgacgcccgcactcttaaggccggcgttgtggccggtcaggatatcgacattggaatcgcctacgtagagcgtggtcgccgggtcggcgcctagctcttccatcacatgcagcgtgacgggtgcttcgggcttgggcggaaacgcatcgacacggccctgcaccagcgcaaagcgctcggaaccaaaatacttttcgataagcggagccgccgagacgtggtccttgttagtgagcacggcaagctgaacgcctgcggcgcgcaagcggtcgagcatctcgatcgtgccggcatagggagcggtgtggtcttccttgtgctcgccgtagtaagccctaaactcggcaagcgtctgctcaaacatgcggccgtcgcctgcgtactcggcgggcataaagcgctcaaccagcttgagcatgccgtttcccaccttgtagcggtactcgtcaacggcaaacgtgggccagccgtgcgcctcgcaggtatggttgctggcggccgccaggtcctcgagcgtgttgagaatggtgccgtccaggtcaaagatcacatgggaaaaagctgctgccatgggtgctcctgccgcttgagttgtaaaacgcaccccatgatactgggcatgcgtgccgggcatgtttggaatctgaatatctttaatagccctgagcctttgtcgttagcaaatcctcggcagctgttctcccacgagcatgtcgaggatgcgggtcgagccccagccggtgcgcacgcgcacggcgggatgggcgccctcggcaagtggcagcacgcgaccgatgatggcggcattctcgccgtagcgggcggcgcgcatggcgctcagcgcggcatcggcttgctcggccggcacgacggcaaccatcttgccctcatttgccacctgcagcacgtcatagccgagcatctcgcaagccgcctgcacatcgggacgcacgggcacggcattctcgtcgatctccatggcaatgacgctggcctgggcaaactcgttgagtgtggacgccaagccaccgcgcgtggggtcgcgaaagcagcgcgtgtcgggtgctgcggcaagcacatcggcaatcaggtggttgagcggcgcggcgtcgctttcgatcgtgctcgaaaacgccaggccctcgcgttggctcatgatggcgataccgtggtcgcccagtgtgcccgacaccagaatgacgtcgccggggcggcagtttgcgccactgagcgccacgcccgcgggtacctcgcccacgccggcggtattgatgtagacgccgtcggcaccgccacgctcgaccaccttggtgtcgccggtgattatggacacgcccgcctcgcgcgccgtctcggccatggtctgcacgatctgacgcagcttgtccatgggatagccctcttcgaggatgaagccgcacgacaggtagcgcacattggcacccgaggtcgcgacatcgttgacggttccgcacacggcgagtcggccgatattgccgccggggaagaactgcggcgtcaccacaaagctgtcggtcgacatggcgatgcgctcgctcgcgggcagtgcggcgacgccggcatcgttgccctcgagcagctcgggcgacccaaaggcatccaaaaagaccccgtcgatgatgcgtttcatcatctggccgccggagccgtgacccagcaggacggtgctgtcggtaacgctatgggacatatcgaaaactccaatcgtgggtggtgccggtgtgcgggtgcgtccgggctaggcgcggtatcggtagtacgccgcgcagctgccctcggagctcaccatgcaggggccgacgggatgctcgggcgtacaagcgtggccgaacagggggcagtcgctcggcgtaatggccccgcgcagcacgtcgccgcagcggcacccgcgcggctcgactgtcgcctcaacgggcacatcaaagcgagcacgggcgtcaaagcgcgagaactcggggcggatggaaaggcccgagttggcaatcgaccccaatccgcgccatgtggtatcgcacggctcaaatacctgctcgaccagctggcgcgccacgggattgccgtcggcattgacgccgcgacggtaggcgttgtcaatcgccggcctgtcctcgacaaccatctggaccagcatgcagataccctgcaagatgtcgaccggctcaaatcccgtgaccacgcctggagtcttaaactcgtcgaccaaaaagccaaagggggccaagcccgtgatggtggcgacgtggcccggcaggataaagccgtcgatggcggtctcggggtcgttggcgatggcgcgcaacgccggcggcgtggtcttgtgggcgcaatagaccgagaaattcaaaagcccgcgcgcttcggcctccaagatggcggcggcgatggtgggcgttgtggtctcaaagcccacgcccataaaaataaccgggcgatcggggttttgctcggcaatgtcgagtgcatcgagcggggagtacacaatgcgaatgtcacgccctgccgccttttgtgcagcgagcgaggtggacgatccgggcacgcgcatcatgtcgccaaaggtggtgatgatggcgccgtctatgttggcgagcgcgattgcgtggtcgatgtcgcggttggcggtgacgcagacggggcagcccggtccgctcagcagcttgagcccggccggcataatggagcgaaagccatagcggccgatgctcacggtgtgcgtgccgcagacttccataaggttgatggcgcggtcgccgacaagctcatgaatgcgctcgatgagctcgcgagccagcttggaatcgcgaaatgccgaaaagtcgataccggagcgcgccggctgtccggccgccactagtatgcctcggccgggttgctggccagttggtcttcttcggccagttcggtcatggcattaacgagctcgagcgtttcttgcgcttcctgctcgtcgacgatctggatgccaaagccggcgtgtacgagaatatagtcgcctacctgcgccgtcggcacgagtctgagcgacacggggcgctcgatgcccatcatgtcgacggtggccttgaggtcgtcgtcgcgtttgactactttgccgggaacggcaaggcacatattgttccccttttatacgctttgcgctggatgggcgcttaataatccatcagttgatggtagcgctcgcggggttcgcgggcaaacgcgttacgcctgtgagacggctgggcgcggcggcgtgcgagggcgagctactgtgatgcaatctgcgcgaggcgagcgcgtgcgactgccgcctgaccgtaggcgatgcagccgtcattgacgggtacggtgtgggggacaaggacagtagggcctgcgcttttgagctcgcgggtgaggagctgaagcagaagtcggttcatgaacacgccgcctgagagcgcgacggtgtcgatgccctcgtgcacgcagatatcgctggcgatacgcgccgaggagcgcgcgacggcgacatggaagtcgagtgcgagcctgtcggcgggcgctccggcttcaattcctcccaaaagtgcctcaaagagtgctttctggtccagaacataggggccgtccggccacgatgggccagatgcgaaatagccggcgttgtcgtcgggaaaatgggcgatttcgttgtcgagcgcgcgccaggcggcggcctcaagctcgatggcgggttcgccctcgtaggttgccttgtcgcagatgcccagaatcgctgccgcggcatcaaagagacgccccatgctgctggtacgcgggctgttgatgccgcgctcgatcatggtggttgtcacgctgcgcgtttgctcgtcgaggctgtccaaaagccgcgcggcacctgggtgctcgagcaggccgagctcactgagcagggcaaaggcgttgcggcgggcgtcgcgcacggaggccgccccgccggggagcgcccaggtgcgcaaatgcgcggcgcgctcaaagccgccaaggctggcaacaagaaactcgccgccccaaatggtcccatcggtgccggcgccggtgccgtcaaaggcgatgccaaggacacgcgcgtcggttgtaagctggcccgcggcgatggcctcggccattacgctcgcgatatgcgcatgatggtgctgcacctcgacgagcggcagattgcattttcgcgcctgctcgcgcgcccactggcccgatagatagctggggtgtaaatcgcaggccaaggcggcgggcgccaaatcaaagagatcttccaagcgcgtgcgcgcggcgttccaggcatcgaaggtcccgccgttttcaacatcgccgatatgctgcgacacaaaacaggttgcctcgccgttcgtcccttcacgcgtaagcgcaatcgtggccttttgttgtggcccgcaggcgagcacgcaggacggagcgccgtcgagcgccggcaacggcagcggctggggtgcatatccgcgagcgcggcgcacgggcataacggcgccgtcgaccacgcgtactacagagtcgtcgtagcgcgagaggatcgcgcggtcgttaccgagcaacgcgtcggcgatgccggcggcaacgaggtgttcccaggcaagatcgtcatcggtctcgatgggcccttcgctcaggtttccgctggtcatgacgagcgcgtgcataccgtgcgacgcggcagctgcaagcagaagatgctgaagcggggtgtaggggagcataacgccaagctcgggcaggtcgtgcgcgacggacggtgcgagtacgagggcgtcgggagaatcgccgtcgttcccgcaaacagcacgccggcgcagcaacacgatggggcgaatgctgccggccagcaagccgcgctcaacatcgctgacatggcataggcgttcaacgtcagcaaggtcgcgcaccatgacggcaagtggtttgttgctgcggcgtttgcgacggcgtaactcggtcaccgtctgctcgttggcagcgtcacaggatagatggaatccgcccaggcccttgatggcgacgatgccaccgctggccagcagctcaacgcagcgctcgataatggcgtcgctggcctcgcatgtggtgccgacggctggtgtcgcggacgaattcccgcacgcatcgccgttcacagcctcgcgccacgtaatatgcggcccgcaatcaaagcaggcatcgggctgcgcgtgaaaacgccggtcgagcgggtcggcatactccgcggcgcacttgggacacatgggaaaacaatccatcgacgtggccgctcggtcataaggcagcgagcggatgatggtaaagcgtgggccgcagttggtgcagttgataaaggggtagtgatagcgtcggtcggcgggatcgaacaactcgcgcaggcaatcgtcacaggtggcgatatcgggcgagacgagcgtggtgtgcgcggtctggtcctgcgatgctacgatgtgaaaaccctgttcattggcggtatcccaaccgttggctgccaggtccacaacctcgacatactctacgcgggctgccgcaggcgcatgctcagaaagcgcggcaacaaaagcattgagcgcatcggccggagcgtgcgcctcgatatgcacgccgtcgcccgcgttgagcacccagccgcaaatgccatgcaccatggcctcgcgatacacaaacggtcgcatgccaacgccctgtacaatgcccgtcacatgaatatgcacatgccgcatgcgacacccctcatcaaaacctaccaaaaaagacaggtttgttttggtaggtaaaacttctaaacctgccaaaataaacctgtcttttttggtaggtgcgctgcaggaaatcccgctacagccccaggctctgcttggtggcggcgcacgtgagctcgccgtgcttaacgccgcgcaggcccagcaggcggtcggctagttcgtagacgcgctcgccgcgacccttgagcgccagaatctccaagcagttgtggtgatccagatgcacgtgcatggtcgatacgatctcgttggtgtagtcgtgctgcacctcgtccaggcggcgcgtcagatcgccggtgtgatggtcgtagatcatagtgagcgacccgataacctgctcatcgggcgtgcgcatctgctccttggcgatcgaggcgcgaatcaggtcgcgcacggcctcggagcggttggccacgtcgccgcggcgtgcgatctgctcgtcaaaacggcgcagcaggtcgtcgggtgcggtaaccgaaaaacggaccagctcggagccggagccactacaatggcagcccgcgtcaccgtccgccccgtgcggatgctcgtgctcgtacccgcagccgtgctcgtgttcggccacgttacaccagcttcacggagccgacggagttgtggtcggcctcgatggcctcttcgtagccctcgagtgcggcatgggcctcgtgcagcgcggccatggctgcttcgagcttggcgccgatgcgctccatgtcaaaattctcggtcgcatgcagcagctgatggctccactcatgagcgagctcgatggtgtcgtcgacctgtttgacgctcatggcaagctggctcatgttcattccaacatcatgcatgggaaatctccttttgtatggggcagttcagtggttcagattttactacgcccgctctgcgcgcagttacataagaaaacgggtacgagtctgtgcgacccgcacccgttcactgggggctgtttgtgactaccatactatccgcggttgcactcggtgcattcagaagtccggcgagcggcgtaaaagcgctcatggacggcaggcagacggcaacatgtaacaagcatattacagatgcttttccagcagcgcctgcagcctcgccttgggcagagcgccgaccgagcggtcaatttcctcgccgttcttaaagacaatcagcgtggggatgctcatgacgccatatttcatggccaggtcctggttgtcgtcgacgttgcacttggcaacggcaagtttgccagccagctcgtctgccacctcgtcaacgatgggcgagagcgatcggcagggcccgcaccagggcgcccaaaaatcgactagcacgggcaggccgtcgttaacgatggaatcgaagttctcgggggtaatctgcttaatgtcagccatggtgacctccataatgcgacgcggctcagccgcgtaaaactcagtacgaccgtgcttatacccagtggcccgcaaagcaaccactcgcgggcagctcttttatataatggtgggcacgcaaacgattggagagcgcatgcccacgtcacaaagccagaaaaaagaagccatcgcccaggcgaccgagcaggagctcgcatcgctcgcgggtcgtggcgtgcgtatcgcgggcaacgcgtgctcgccgatcgtgctggtcaaaggcgatttggacgaggccgagcgttcgggtggcgagcttgccgccggcccggatggcgcggcgttgcgcaaggcgcttggggccatcggctacgcgcccgaggatttttgcgtgctggcaagcgtcgccggcgtgggtgacggagcggtcgcggtgggcgagactctgccgtgcgagctgttccgtgaggcgcttgaggctttggaccccgaggcggtgctactgctcgacaacaacgcggctgacgccatgcgcgagacctacgccgatatgctcgtggcaatcgatgacttcgacaccgccatgctcaagcccggcttggtcgcccatgtgcagggtcgccgcgtgctcgcgctcgacggttttgaggcggcgctcactgacaaagccgccaagcagcgcatgtgggcatacatcaagcagctgaccccggcggccgctccgctgtagcggattggcgccggtgagcgattgcctggcgggcaagacacgccgcgagatcggcgccgcacttctacatcacagcgcgcagctcaaaccgatcgccgttaatgcggaactggcagttgccgttcatgcgttcgacggcaagcttaatgctcttggttccaaagccgtgtccggtgtgcccggctacgggcatgccgtcgaccatgcgcggcgcgcggtcaaacgtgttggaaactaacagcagcagctggccgtcctctaatcgcaggtcaaagtcgacgaatcgctttccctggggcgcggcgcttgcggcggtgatagcgttttccaaggcatttgagagcacgctaaacaggtcggcgtcacctacgtggatggtttcgggtacggcggcgcgcaagttggcggtaatgccgtttctattgatatccgagttaaatgacgaaagcgcgatgtttacggtctcgttggcgcagaagcggcgtacggcggtgcggtcgccggcttcgcagagttcgtcgatgcgatcgagcgcctcgtcggtgtggccctcttcaattaaagcggccaggccgcgtagaaagtggcgcatgtcgtggcgaagaatcgacagctcgcgcccagattgacgccaagcctcgagctctttgatggcgacgctgtcgcgggtttcgagcatccagcgctctctctcggcggtttccttttcttcgtattcacgcaggtagacggcgaggaacataaggtagaacgcgcagagcgcaaaggccaaaaactcaaccgtcaccaccgagcccgagtggaacagcgtggtgtagacgttggtggcatagtcaaagacgtaatagacgagcggcaggattaaaaggatgcccagctcggtggtgcttttaatcgccaagcgcggaccgatgtcgccggcccaatgcagcaggacggcaaagacggcgagtgtggtcgcgatgcgcgccagatagtacgcgatctgagaatcggttgcggcaaatgcggcgatgcccatccaattgctgaactggcagctcagataggcactcgtaatgccgagcacggcaagcagcgggctcaggcggtagcgcgcgcacaaatagatgacgagcggcagatgcacgacgagcggatatacctggcgggcgaaaagctcgccgccgacggcattggcgatcgaaaaggcagcgccggtcacgacgccgaccagcaccagttcaagcgcatgacgccggttgatctcgataccgcacagcgccgccgaggcaaagacgccaaagagcagcgtcgtggcgtggtggattgcccaaaggatcatttcgaccgaggagaccatcagtgtctcccaccctcaaagcgcgccgcaaagtaggcgtcttggaatccctgcttgcagctgcgcgaaagcgggatgcacgcgcccgagcgcatgatgatgtccgtgcggtcaaagtgatcgatattgcgcaggttgacctggtagctgcggtggcatttaaagaagaccgcgttttgctccaagcggtcctcgacgctgcggaacgactcgagtgcctcgatatcgcgtccgtcgcgcaggtggaagaccacgtgcttgttgcgcgcctcggcatattcgatgtcggacaggcgcagggcgtggtagccaaaggaagttttgatcacgagctcgtcggttgccgccgggcgcatgctcgaaagctcgtcgagcaactgcgccaggcgttcgtaagtcacgggcttgagcagatagtcgaaggcacggacctcgtaggattccagcgcgaactcgggcgacgaggtgaggaacaccaggcgcacggcggtgtcggcctggcgcagttcgcgtgcggtgtccatgccgttgacgagcggcatgatcatatcgagcaagatgatgtcggcgcgcgatgcggcatggcgggccagcaggtcctcgccgcgcgtgacgagcgcaacatcgaccgccgtgcccgtctcggtcgaccaacggtcgatcatccggtgcagtctatctagaaaagcgacatcatcgtcgcaggcaataatcttgagcattcggcccccttaagtagttcgattttgccacatcgggcacgcgccgcttgcgggggtgcggaccgtttgcgcctcacggcgtgcagctcgcgccaagcggtgttgcggtggcgaaagatgcctcctgcgctatcgaaagcccggctatcctcagcttgccagttcgaaaatggacctgccacatgattgaatctttatttcaactttacacctaggtttacagctgtcttgtcagctgtaaacctaggtgtcatactaaagccccaagattcgccaaaagagaggggccttgatggcacagagcgcgaacatggatgcgtcggagcttgcacgcgatatcgcggccggcctggcatcggcaacgacggcaacggagcgtgcggcactggtgcccgcagagctcgtcgaggccattcagcaactaaaaacccaacgtgacgcggtgatcctggcgcactattacgtggcgcccgaggtgcaggctgtggccgattacgtcggcgacagcttctacctggcaaagcttgccaagagtctgccgcagcagactatcgtgctgtgcggcgtggagtttatgggcgagagcgccaagctgctcaaccccaccaagaccgtgctgctgcccgagccgggcgcggactgccccatggcgcacatggtcaagcgcgagacggtcgacgcggcgcgcgccgagtacggcgacgacctggccgtggtgtgctacgtcaactccacggtcgagatcaagagctggagcgacgtgtgcgtcaccagctccaacgccgttaagatcgtgtccgagctgccgcagcagcatattctgttcattcccgaccaaaacctgggacgcttcgtagccgagcaggtgccgcaaaagcacgtcatcctcaacaacggctactgcccgcgccatcacatcatcaccgtcgagcagatcgtcgacgcgacggaggcccaccccgacgcgctcgtgctggcgcatcctgagtgcaaggccgacgttctggccgaggccgactacatcggctccaccgccggcatcatcaagtatgccgaggagtccgacgcgagcgagttcattatcgtgacggtccgcggcgtgctctacgagctcgagcgccgctgccagggcactggcaagaagttctacttccccgcggtgcagcccacctgcgtcaacatggatctcatcacgctcgagaagctcgtgcgctgcctggagacgggcgagggcgaggtgcagatcggcgtctcggacgaggcggcagaccaggccaagctcacgctcgaccgtatgctcgagtacgcagcgcgctagaacaatgttgcatgagggacggtcccttatgtcacattacaagggagaggattcctgtggaaaccaagcaataccccgatatggagtgcgacgtcgttattgccggctgcggcgtggcgggtctgtacgcggccctcaatctgccgacgagcacgcgcgtgatcatgctctccaagggcgcggtcgacgagtgcgattcgatgctcgcgcagggcggcatctgcgtgctgcccgaaggctcggactacgatgccttctttgaggacaccatgcacgccggccattacgagaaccgccgcgagagcgtcgacatcatgatccgctcgagccgctcggtcatcaacgacctgctagcgatgggcgtggattttgagcgcaaggccgacggcagcctcgactttacccgcgagggtgcacacagccgtccgcgcattgccttccatgccgatatcaccggcaaggagatcacgactaagctgcttcaggctgtccgcaagctggacaacgtgcagattttggagcacgtggccatgaccgacatcctgacgggcgagcgtgacggcgacacggtgtgcaccggtatcgtcgccgttcccgtggacgaggacaactcggttcgtcccgccgacgagctggtaaatgccgctgagggcgcgcatgccggcgagccgtttaagatccatgcccgccacacgctgtgggcgacgggtggcattggcggcgtgtacgaccactcgaccaactacccgcagctcacgggcgacgcctgctacatcgctcaggagcatggcattaagatggagcacctggactacgtgcagatccatcccacgggtctgttctcgccgcagccgggtcgcaccttcctgatcagcgagagctgccgcggcgagggcgcgattttgctcaacgccgccggcgagcgttttaccgacgagttgcagccgcgcgacgttgtcgccgccgccatccgcgagcagatgaagcaggatgacaccgagcacgagtggctgagctttgcccccgtcgagcgcgacgtggtgaccgggcactttgccaatatccgcgcgcgctgcctggaggacggccgcgacatcttggacgagcccattcccgttacgcccacgcagcactactttatgggcggcgtgtgggtcgacaaggacggccacacctcgatgcccgagctctacgccgcgggcgagacggcctgcaacggcgttcacggcaagaatcgccttgcatcaaacagcctgctcgaggcgctggtctggggtcgtcgcgccgcgtggtacatgcgtaccggcgagtcgctggccgtggagcaggcgggcgagcccgcgctcgacgggcgtcaccgcgccttgagcgccgacacccttgcaatcgatgatttggcccgtgccgccggcacgcaggccgtggaggagtagaccatgaatcccattaccatgaagctcgtcgtcgatgatctgattctgcaggctctgcgcgaggacattacgtttgaggacgtgagcacggcgagcgtgtgccccacggcgcgccccgccacggtggagcttatcgccaaagccgatggtatcatcgccggcctagacgtgttctcccgcacctttgagctgctggatccgcagagctccgtgttgttcgatgtctcggatggcgacgaggtgcacgccggcgaccatgtgggtcaggtgcgcggcgacgcgcgcgtgttgctttcgggcgagcgcgtggcgctcaactacctgcagcgcatgagcggcatcgctacttacacgcatcggatggcggctgcgctcgagggcaccaagaccgtgcttgtcgacacgcgcaagaccacaccgggcatgcgtgtgtttgaaaaggcggcagtcgagatcggcggtggcagcaaccaccgctataacctgtcgacggctgtcatgctcaaggacaaccacatcgacgccgccggtggcgtgacgcgtgcgatcgagatggcgcgcgcccatgcatcgtttaccacgacggtcgagatcgagtgtgagaacctggacatggtgcgcgaggctgtggaggccggcgccgatatcatcatgttcgacaacatgacccacgacgacatggctgccgcgattgagcttatcgccggccgcgccaagaccgagtgctcgggcaatgtggatgccagcaatatccgcgccctggctgatctgggcgtcgactacattagctcgggggcgttgacgcactctgcgccgattctcgacctctcgcttaagcacctgcgtctgctggacggtaaataatgaacgcccgcgagcgtcgccgtgccatcatggccgtgctcgagggggccaaggggcccgtatcgggcagcgcacttgctcgtgaggtgggtgtgagccgccagattgtcgtgcaagacatcgccctgctgcgcgccgatgggcacgatatcgtggcgaccaaccgtggttatgtgctgcaggaggcccccagcagccccgctgtgcccacgcgcttggtcaaggttcgccacagcgtagagcaggcaggcaatgagctcacgagtatcgtcgacgccggaggcgccgtgctcaacgtgatcgtcaatcaccgcgtgtacggtaagattacggccgacctggacatccgcaatcgtcgcgatgttgagcgctacctgcacgatatcgagagcggcaagagttttccgctactaacggtgacgagcggctatcacttccatcgcatcgcggcggaggacgagcaaaccctcgacgagatcgaggctatgctcaaggagaaaggctaccttgcagacttaatgccctacgaggatgatttgtcctagcccgacaccgtctttataagttgcggtgaaatagttcctacaatcggcacctaagcaatgagccaggaactattccaccgcaactgcccaggcttataggacaaaatgtgtgtcccgatagaacatccgtttctatccattaatcaagccagaacgggtacgggtccctgtggtggaggtcctcccacacggccctgtcgcatgcgaacctccagtccggaccgcttcacggtccaactttctgtccgcaccccctttttgctggtcaaaccgcaaaacagtccctatttcaccgcaacttattggtggccttttgggtggcacttagcgccaggggtcggcttcgaacatcggctcgcgctcggggcggcgatcgctgtagggatcgtagccgtcatcgtcctcgttctcggcacggatgtaggggtcgcgcggcttgggcgccggtttgggagaagccttcggtgcgaccggcgcggtgggcgctgcctcagcaaccggtgcgtgcgtcttgttctcgtctttcatctgcatatctccttgccatgtactcatgctcaacatcatcgattgtcgcacgaaaaagggcggcggacccgattggatccgccgcccttggcgttttgcgatgaggtgcggttaaagccggccccataatttactctgcgtcggggacctcgtaggtggccgccggcgtgttgtcgcacacgacggtaaagccaccgtccttgtcgacatcgaccgtcacctgatcgccctcgcgcaccgtgccgtcgatgatagcggcggcgatggcatccacgacctcgcgctgaaccagacgcttgagcggacgggcgccaaagaccgggtccaggccgcccacggcgagcatctgcttggccgccggggtgatggcaagcgtcatgcgctccttggccagacgcgcgcggacgtcggcgagctggatgtcgacgatcttctcgatctgcgccataccgagcggatggaacaccacgatatcgtcgatacggttgaggaactcggggcggaaggtctgagccatggccgcgtcgacctgatggcgcatctcctcctcgtccttgccggaaagctcggcgatagccttggagcccacgttagacgtcatgatgatgatcgtgttcttgaaggacacctgacgaccctggccatcggtcagacggccgtcgtcgagcacctgcaacagcacgttgaagacatcaggatgagccttctccatctcgtcgagcaagattacggagtacgggcgacggcgcacggcctcggtgagctggccgccctcgtcgtagcccacgtatcccgggggcgcaccgatcagacgctggacgctgaacttctccatgtattcggacatgtcgatacgcacgagcgcgcgctcgtcatcgaacaggcactcggccagcgccttggcgagctcggtcttgcccacgccggtgggacccaggaagaagaagcttccgatgggcttgtccggatcggagaggcccgcacggctgcggcgcacagctgcggcgacggcggagacggcctcgtcctggccgatgacgcgcttatgcagctcgccctccaagcccttgagcttgtcgagttcgccctgcatcatcttggacacgggcacgccggtccaggcgctcacgacctcggcgatctcatcggaggtcacctgttcgttgaggccctcgccgtcctgctgcttttgcgcctcgagcgcggcctcggaatcctgaatctgctgctgcaggcccggaatcacggagtagcgcagctcggacgcacgacccaaatcgccattgcgcgtcgcgcgctcctcttcgctcttggcctcgtcgagctgccccttgagctcttgcacgtggtcgatggcgttcttctggttgagccagccggccttttgcacgttaagcttttcctggacctcggcaatctcctggcgcagggcctccagacgctccttggaggcgtcatcggtctctttcatgagcgcctgttcctcgatctgcagctgggtgagctgacgcgtggtggcgtcgatctcgaccggcatgctgtcgagttccatgcgcaggcggctcgcggcctcatcgaccaggtcgatggccttgtcgggcaggaagcggtcggcgatgtagcgatcggagaggtcggcggcggccacgagcgcgctatcggtgatgtgcacgccgtggaagatctcgtacttctccttgagaccacgcaggatcgagatggtgtcctcgacggtaggctcgctcaccataacggtctggaaacgacgcgcgagcgccgcatccttctcgatgtacttgcggtattcgtcgagcgtggtcgcgccgatcgcgtgcaggtcgccacgggcgagcgccggcttgaggatgttgccggcgtccatagaaccctcggtggcacccgcgcccacgatagtgtggagctcatcgatgaacaggatgaccttgccctcggacttctgcacctccttgagcacggcctttaagcggtcctcgaactcgccgcggtacttggcgccggcgaccagcgcgctcatgtcgagctcgataaggtcgcggtcgcgcagggtgctcggcacgtcgccggccacgatacgctgggcgatgccctcgacgatggccgtcttgccgacgcccggctcgccgatgagcacagggttattcttggtgcggcgggacaggacctgaatggtacggcggatctcgtcggtacggccgatgaccgggtcgagcttgccggcgcgggcgagatcacagatgttgcgaccgtactgctccagcgcctcaaactgggttttgtcctcggcagatgtcacgcggtcatcgccacgcagctcctcgtagacttgctcgatgcgctccttggtcacgccggcgtcgcgcagcacgcggcccgcctcgcccttgtcctcggcaagtgccatgagcagatgctcggtcaccacaaagctgtcgcccatcttggtggccttcttctcggccttttcgatgacgcggacgagctcgttggaaagacccatctgctggccctcgccggaaaccttgggcgcatggtcgatggcatcctgcgtggagcgtgcgagctgggcagggtcggcaccgatgcgctcgatgatcacggagatgttgcgctcgccggcaccgagcagggcagacagcagatgaatcggctccaccgcgccagcctgcgcgtcggcagccgtgctcatggcggtctgcaacgcctcgcgcgacgtcattgctagcttatcgattctcatggaatcacctctcttggggcggccgccctacggggcggcttcacgttgttcgagaagtattgttgccagctttgcgcgttcttatacacaaatctaagtctctatatataagattttctgagtgattgaaggatagggtactgagacgccgacccactgcatccccgacgaccaaccgtctcgatctgtaacatctagcagccgtttttgggtccagatgttacagatcgagatgaaatgatcggcagcgcccgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagccgtttttgggtccagatgttacagatcgagatgaaatgatcggcagcgcccgtttgtctaaatctgtaacaactactcggcaaataagggtccatctgttacagatcgagataaacagaagacacccgaatcgataatctaaatctgtaacaccaagcccacttttaacggcccagatgttacagatcgagacagactgaaaaccaccgcaaaggggcacctttgtggtggtcgcgttctctactcttttgacgagcccgtgcttcccgattcggcgttccagggcatctcatcctcgaatagccatgtacgagcagacccactatcgcgtgcagcctgcaggtcgggcaagcaggtctgttcataggcatcctgaatgcactgacccataaactcgttgagctcggtctggtcgccctccatgacataggccacatcgccgtccatgatgtagatgcccggaccctcattgccctcgtaacccggatcgtacgagacatcacatagctttgcgccgttcgcggtatccagctcgatggaagagtggcatccgccaaccatgtcgttcgcttttgcccgataggacgcatatccgtaccaacgcttaaaggttttgcctttgagcagctcggttgctttgctgattaggctcgcgtccatggtgtagcgcatggccccaagctgaatgcgcggataattgctaatgcccagcgctgccggtttctcatcaaaatcaacagtaatggtctcgggtttttcgtcgccggtcagaagttcgactgattgagtcacaggcttaaccaccggctccgtcaccgcagcaggcagaaatgccataccgacaacgcccacaccaaccacggcgatcgcaagcgccagagcaatcaatccaatacgggcagagcgactcacagcaaaacacctcgcaatgcagatctgcgtcatttgccctaatgataccgtcagctaacactatcaccaaaagaagccgctcgctccccaccaccacaaaggagacaggcacctttgtggtgggtttcgacgctaacggtcgaccatctcacgccatgagattaaacttaatttgttatctgaatttatctatttctatctatcctcaacagctttttgtttcggggagatcatatgaagccgtctcattccaccggtcgcaacgtcatcgccattctcgccgtacccatcgtgatgctcttccttatcgtcatcacgcccttttctctcggtatcgcctcgcccttcgatttgtgcgggatggtcgacgccggctcgcgtgccacctcgctctcctttatctgccgcggcgtgttttacgaagatagaattcccaccggattttggcagtcaaagttgccactgctcagtcagatcgacggatgctccccccatttctgccttgaacctcaggcgctaaactatctgatcgacgaccagccactcgactccatcaccctcgcctacgactacgcaccaaacaccgatgagcgccacatgaaccaagtcctcgacaagatgcttggacagtgcgggctcaccgaggaggacggtcgaaccatctatagcaaccagaaattaaagcgaacagaactccgccgtgtcggaaaaatcgaagggcgaagtggggccgcctactggcaggcctgggcaacacgcgacaagagcgaattcggacacagcacctatatggtcaccgtctacaccaaagacggaattaaggacaatgttgacgatttcgcgtcgtccaaactcggcatccccaaaacaaccaaacccgccaccccagatgaaatcctgtagagacattcattaaaatgctgcccagcgatcacaataacatcgagcccgcccaccaccaccacaaaggggacaggcacctttgtggtgattttcgactccggcgctcatctgtctcgatctgtaacatctagcggccgtttttgggtccagatgttacagatcgagatgaaatgatcggcagcgcccgtttgtctaaatctgtaacaactactcggcaaataagggtccatctgttacagatcgagataaacagaagacacccgaatcgataatctaaatctgcaacaccaagcccacttttaacggcccagatgttacagatcgagacagactgaaaaccaccgcaaaggggcacctttgtggtggtcgcgttctctactcttttgacgagcccgtgcttcccgattcggcgttccagggcatctcatcctcgaatagccatgtacgagcagacccactatcgcgtgcagcctgcaggtcgggcaggcaggtctggtcgtacgcgtccatcacgcaacgatccaaaaaatcgatcacctgctgctggtcgccttcaagaatgtaggtcacgccgccatcttggatatagacgccgtccccacctccggcttttgcgtattccggattgtagttaacggtgcgcatcagtttgccatcagatgaatacaacttcagcgttgtatagtagccaccgttcacagaaccacgtcggcgctcataggcatcccaaccgtcccagcgtttgaacgaacgcccgtttagcaagtccagcgcctgtcgggacaacttctcgtccttggtatagcgagacgagccaagttcaatcatggggtagttgcttatgcttagaatgcccggcgtttcctcgatatcgagcgttatctcatcgggctttgtaacgtccgaaatcatttgcccgggcatcgatgcaacaagggacgccatctcaaccgtctgctcaaccccactcggcccatagaagataagcgagccaaataggaccacgcccgcagcagcgacgacgcaagccaccaacagcaacaaaacagaagtgcaacgcttcatcttcaactccacaaacgagagtgttttgagctcactttaaagcgccaacttcatactgtcaattctagatagcatatgaacaaaggcgcactcccccatagaggagagttgcaacctcgattttagcgccctcaagacccaacgagcagcacttaacaagtagccccggttatacctttctctgacgcgaccctcgcgaagcgcgtgagcggcagggaaaggtataaccggggcggacaagtatgtgcgttactcggcagcggccttgaacttgttgtagttgatcaggcagccggccttgacgatggcacgctcctctgccgtcatatcggcaatgtagagctcaatctgctcgaccgcaccatcggcgcgaaccacgtaagcggcgatgtccttcaggtcgccgtcgagcgcggcgcggatacccggcacaaagacgtagtcgcccacctcaaagctgggctcggcctccatctggaagggcaccatgccccagttcatcacgttggagcgatagcgcttggtggcgtactcgtggacgatgttggccaggccgccaattacgcgctggcagctcgcggcctgctcgcgggcagaaccgtcaccgggcttcttggcatagagcatggagccgtactcagtcgccttggcatcggccgcgacacccgcgccggtcagcgcctcaaacacgctggcaagctcggcatcgagtgccaccaggtcgcccgctgcctcgccggcaatgcggcgcttttccaccgcgtcgacctccttggagcggcccacgtaggcagggtcgcgacggctgagcgtaaactcggccagacccagcgggttggagcggaaggagctcgtctcgcccgagggaatgagctcgtcggtcgtagtgaccgggtccatgatcttggagcacaccttgagcaggatgtcgtcgccgagaggctccatcgcgggccacggcttgatgttggggccctcgaccagctcgtcggccggctcagccttgccaaagccccagtacacgcgcttcttgtacggcgcgtcgtcaaaggtgtactcgcaggcctcgtcccaagtctcctcgggcaggtcggtcgccggcgtcaggacgccgccgttggcagccgtcgccgcaatggagcgggcgtccatcagggccacggcgctcagctgaccgttgcccggcttggaaccctcgcgattggggaagttgcgcgtggtgtggcggatcgaaaggccgttgttggcaggcgtgtcgccggcgccgaagcacgggccgcagaatgccgtgcgcacaatcgcgccggcctccataaggtcgtagatgtagccgcggcgtgtaagctcgagtgccacgggctggctcgtgggatagaccgacagcgaaaactcgccgcagccggtgttagcgcccttgagcacgcgagcagcctggaccacggagtcgtagttgccgcccgagcagccggcgataacgccctgctgcacgtgcagcttgccgtcgacgatcttgtcgagcaggctaaagtgcgtcttgccctcgccgatcttggcggcctcgagctccacctcatgcaggatgtcctcgaggttctcgttgagctcgtcgatctcaaagccgttagaaggatggaacggcaacgcgatcatgggcttgatactcgacagatcgacttcgacgcagccgtcgtagtaggcaacatcggcgggcttgagctcgcggtagtcctcgccgcgaccgtgcatggtcaaaaacgcgtgcgtgtcctcgtcggtagcccaaatggaggagaggcaggtggtctcggtggtcatgacatcgacgccgttgcggtagtcggtcgtcatgctcgcgatgccggggcctacgaactccatgaccctgttcttaacgtaacccttggcaaagacggcgcggatgatggcgagcgccacatcgtgtgggccaacgccggggcgcggggcgcccgtgaggtagatggcaacgacgccgggataggcaacgtcgtaggtgtcgcgcagcagctgctttgccagctcgccaccgccctcgcccacggccatggtgcccagagcgccgtagcgggtgtgcgagtcggagcccaggatcatcttgccacagccggcgaagttctcacgcataaaggagtggatgacggcgatgtgcggcgggacgaagatgccgccgtacttcttggccgcggaaaggccaaagacgtggtcgtcctcattgatggtgcctcccacggcgcacagcgagttatggcagttggtgagcacgtagggcagcgggaactgctccatgcccgaggcgcgcgccgtctggatgatgccaacgaaggtgatgtcgtggctcgccatggcgtcaaagcgaatcttgagtgcctcggggtcacccgacgtgttatgtgcctggaggatcgaatacgcgatggtgccgcgcttggcatcctcgggcgtctgcgtaataccgcgctcggcagcctcggccgcaggcacaacctcgctgccgccgcgcaggtagatgccgtcctcgtacagcttgaccatactgtctcccactctgcccaaaagatttgggcgcatagcatacattcgttcaatatcgtgccatagaacagttgcgagtgggttacgaatctacacgttcactttatctcagtaaagcaaaggacgagcccagtgtgggccggcagatctggtgcaagagcgtccctttcgactagtcatttaagaacgtccccaatgactaccccagcaacgccgatgttttggcaacgccagcgaaagcccgccagagcgagcaaggtgccttgaaacaaggcggcattgatcttttgatcatgccgccgaagttgaaaggcagattgccgctctggcgggcttgcagcgtcgaccggtccgccgttcgttagaacggcggaaccaaaggcgcagcgtcgagccgttacgccgttcggcagaacggcgtaacctacagatccccgccggcacccagcagcttgcgcatgacctgttcggggttaaccgagccgtcgcgcggggccagggcggtgatcttcttctgcatcttgtactcgtgcagctcgtcctcgagctggcgcacgcgggcgcggagcttttcgttctcgcgctcgcgctcctcggcacgctccttcatatcgaggatgcgcaccacgccggcaaggttgatgccctcgtcggtcagctggttgatgagctccaggcgctcgatatcggcacgcgaatacagacgcgtgttgccgcccgagcgctgggggttcaccaggcccttggactcgtagacgcgcagagtctgcggatgcatgccggtcaactcggccgccacgctgatcatgtacagcggtttattcctattgtcctcggccatgctacctgacccctttccgtctcgttatcgtccatcataagcccgcgggcgcgggtgtgcgccacgaccgccctagtacgtcgccttgtaacggttgaccttctcgcgataatcgcgcgtgtcggcctcgcgcagcttggtcatagcatcgcgctcgtcatcggacaggttcgtggggacctgtaccttgatttcgacgagcagcgcgcctgtgcggccacggtgcttaacgtcgggcgcacccatctccttaaagcggaacttcttgcccgtctgggtgccagcgggcaccttcagacgaaccgtcgcgccgccgggcgtgggcacatcaaccgtgcagccgagcgccgcctcgtagaccgagatcggcacctccatggtcacatcggcacccttgcgcttaaacagcgggtgctcctccacatgcgtggtcacgaccaggtcgccgcgctcgccgccggcaacgccatactcgccgcgacgcttgtagcgtagcttgccgccgtcgaccgcgcccgcgggcaccgagaccgtaatggtctgctgctcgcctgtcgagggaatgcgataggtgaccttgtgcgtcacgccgcgaaacgcgtcctcggccgtcacatcgacggtcagcgacaggtcgccgcccttgcgagcacggctgcgacccgcgccggcaccggcagcgcccgcagccccggcaaagcccgagccccaatcgctgccccaggcgccgttgccgctaaagatgctgtcgaagatgtcgccccagccgctggcacccgcgccggcaccgtagccgctgccatacgcgccgcccgcgcccggcatgccgccaaacatgagcatctggtcgtactctttgcgcttcttctcgtccgaaagcgtctcgtaggcctcgctgatctccttgaacttggcctcgtcgccgccggcatcggggtgatatttttgcgcgagcttgcgaaacgcgctcttgatctctttgtcggaggcgctcttggatacgcccaggatgtcatagaaggttttgcctgcagccatcgtagctcctctcctgtttcatccgccgcccagcgggcggcggctcatgctttcatatggcactaggccagaaagggccccgggtgttgccccggggcccttctcaattactcctcggtgctctcggccgtatcggccgcagcatcctcgggcgccgcgtcgggctccggtgcggggcgcttctcgccaccgtaggtcaccgtcaccatcgcggaacgcaggatgcggtccgccatgcggtagcccttctggtacacgtcgttgacggtctcgtcgtactgcgacgcgtcctcgacgcgacccacggcctggtgctcgagcggatcgaacgcctcgcccttggggtcgatgggctcaacgccctcgtgcgcaaacacatcgagcagcttggcatgcaccgcgtcgacgccgtcgacgaactgcttaaagtcgtcggcaagctcctggctgcgggcatggtcgatcgcacgctcgatatcgtcgaccaccggcagcagcgcggtgacgagcttctcggtcgcgcgctcgcgctcggcgatacgctcattggcggtgcggcgacggaagttctcccagtcggcctgaagacgggcggtacgctcagtggcgtcctttgccttgtcctcggcggccttctgagcctctgccgcagcatcgagctcattgcgcacgtcggcgagctccttttgggcctgctcgaacttgagcttaaagtcgttgtcggcggcttcctcaccggcgcggatagcggcttccaccatctcgtcctcggtcatcgtcgcctccttgttggaatcctctacctggttctcggcagcctcggcggccggggcctcgttggcctcggtatcgtcgacggcctctacgggaatcttcacgtccttctcctcagagtcaacgggggcggcgccagcggcggccgcctccgtgcgagctttacgggcggacatgattacttgtcctcgtcgtccacaacctcgtagtcggcgtcgacgacgtcatcgtcggcaggctgggcgccggcggcaccgtcggtctgctgctgagcgtcggcgtagacaacctgggccagctcgtaggccacggactgcagggactcgccggcggccttgatggcctcgacgtcagagccctcgagcgccttcttggcgtcggcgatagcggcctcggccttggacttcacgtcggcggaaaccttgtcaccgagctcgttgagggtctgctcggtggagtagcacaggctgtcggtctggttgcggacctcgacctcttccttctgcttcttgtcctcctcggcatgagcctcggcgtccttgaccatacgatcgacttcgtcgtcggacagagcggtggagccggaaatggtgatctgctgctccttgccggtgcccttgtccttagcggagaccttgacgatgccgttggcgtcgatgtcgaaagtgacctcgatctgcggcacgccgcggcgggcagccgggatgccggtcagctggaacttaccgagcgacttgttgtcgcgggcaagctcgcgctcgccctggagcacgttgatctcgacgctggtctggttgtcggcagcggtggagtagacctcggtcttggaggtcgggatcgtggtgttgcggtcgatcatcttggtcatgatgccgcccatggtctcgacgcccagcgacagcggggtaacgtcgagcagcaggatgccctcgacgtcgccggtgagcacgccgccctggacggcagcaccgtcggcaacgacctcgtcggggttcacggacatgttgggctgcttgccggtcatggtcttgacgagctcctggacagcgggcatacgggtggagccgccgacgaggatgacctcggtcagatcggagagcttaagcttggcgtcgcgcagggcgttggtgacaggctgcttgcagcgctcgagcaggtcgcgggtgatcttctcgaactcggcgcgggtcagcgtgtagttgaggtgcagcgggccggactggttcatggtaatgaacggcaggttgatggtggtctgctgggcggcggagagctccttcttggcgttctcggcggcctccttcagacgctgcagggccatggggtcctgacgcaggtcgacaccgttctcctgctggaacttatcggccatccagtcgatgacgcgctgatcccagtcgtcgccgcccaggtggttatcgcccgaggtggacagaacctcaaacacgccgtcggcgaggtcgaggatggagacgtcgaaggtaccgccgcccaggtcgaagaccaggatgcgctggtcggtgccctgcttgtccaggccataggcaagagcagcagcggtcggctcgttgacgatacgcttgacgttgaggccggcgatcttaccggcgtccttggtggcctgacgctgggcgtcgttgaagtaggccgggacggtgatgacggcgtcggtgacagtctcgcccagatacttctcggcgtcggccttcatcttggcgagcgtcatggcgctcacctgctcggcggtgtaatccttgccctcgatgtcgacgacggcacggccgccctggccctccttgacctcgtacggcacggtcttgatctcagaggtgcactcggagtacttgcggcccatgaagcgcttgatggagaacacggtgttcttggggttggtgacagcctggttcttagcggccttacccacgacgcggtcgccgtcggcacggaagcccacgacggacggggtggtgcggtcgccctcggcgttcacgataatggtcggagaaccgccctcgagaacggccattgcggagttagtagtaccaaggtcgataccaagaatcttgcccattagaaattccctctctcttgtgcgtttgcaccgactcggcggtctgtcgagcggtgtttcggcttgtctttcaggatgtagtgtatccccttatgggccggaatatacaaaatctaagtcaattcatataagatttcttattgctgagagtttaggttcgcaaatgcgcaggtagacgcactgtttgagttctaggcaaatctatcgagatctatgtagagatgactgaggtttgggtccgagggtgcctggggctgccttgcggaaagcttgtcccagttttcggcaaaataacgggatgccctttccgcaggcgcgctcaatagctcaatatttcaagtcacctttagctaacatttgcgcagctcaacggccccacctgcgtgttttttagtaagccgcggcatactcggcgaacggtatgaagatgccggtcagagggtattgcaaacggtcgctcccgtggtatgtttttgcccgaatcaaaccggcgcgcatcgtctgtagcgtcggtcaacagagaggaaactaccatggctcatcccgtaattgatgccgacgagtgcatcgcttgtggcgtttgcgtcgactcctgccccgctggcgttctggagctccaggacgtcgctaccgtcgccgacgaggactcctgcgtcgcctgtggcgcttgccaggacgcttgccccgctggcgcgatcaccgagatcgtcgaggagtaacaactccccacttgcacactcaaaagtacaccgtgcacaaaaaggaggcctccgcatcgccgcggaggcctccttttgcatatgtgggcagtggcttataggacaaaatgtgtgtccacgttgggggcatcggcgcaggtcgatgccgcggtcggcggggccattgtggctcttgacagcggattgggtcatatgagcgaaaacccgccagagcgagcaaggtgccttgaaacaagaaggcgtcgcatgttgagcaaacgccagcgagcgcccgccagagcgaacaaattggcatgaaaagaggacggcatagaccttctggtcatgccgtcctctttgaatgacaagttgtcgctctggtgggcgcgcagcgtcaaccggttacgcggtttggtaaaaccgcgtaacccctagaaacggttgccgcggaagccgccgccgttgcggccgccacgatcgccaccgcgaccgccgcggtcgttaccacggttaccgccaaagccgccacggttgccaccgcggtcgccatagccaccacggttgccgccgaagccgccgcgaccaccacggtcgccaccacggtcaccaaagccgccacggccaccgcggtcgccaccgcgaccgccacggtcgccgccgcggccaccgcgatcgccaaagccgccgcgaccgccacggtcgccgccgcggccaccgcgatcgtcacgaccgccgcgaggaccgcggtcctcgtccaggcccatggcgacgagcggagcgataaccttatcgagggcagccatcagctcggtggcctcctcgtaagaaagctcgggcaggagcttctccttcttgttggcaagctcggtcaggccctcggcagcatcctcagcagcgaagacgacgatcttgcgcatgtcgccctcggcgtcgtcgatgcgaccgaccaggtcggcagcctcggcctcggccatcaggccatcgagctcacgaaggcgcatgcccagcaggtcggacatctccttctgctccatcttgggcttgaggtcaaggagcttgatggcgcgctcgatgttcgccatgcgctcggccttggcctcctcctccttggaaatagcaaagcgacggctgcgcagcaggcgggcggccttctgcatcttgtccatcagctcttcgtcatcgtaatcagcggcggcctcgacaacctcggcctcctcctcggcggaaacctcgtcagcagcctcaacctcggcagcttcggtctccacggtctcgactgcctcaacctcggcagccatggtctcgttctcggtctcgttcatgatctcttcgttctcagacatgagactccttcttggccctctcgggcatcatcgccccattcgcggggcccgtcgcgcactctttgcgcttataaatcatgcctctcggcaaaacgtccattagtttatggtgtcgtccgtcaatctagctgcagaatctatgtgcacacattaatgcgacatgtcgcggtatcatgatttgaatcaaacgcccaccataaggagcccgccatgatcaaacccatcatgaaatccgagttctttttgcgcctgccttccgaagacgcgggccccgatgacgccgtgaccgggcaggacctcctggatacgctccatgagcatgagcacgagtgcgtgggcctcgccgccaatatgattggcgtgcgcaaacgcatcatctgcgtaaaggacggcaacagggcgctcctgatgtacaaccctcaaattcttgagcaggtcaatgcctatcagacgagcgaaggatgcctttcgctggttggagagcgcccctgtacccgttatcgccgcattaaggtggagtatctggacgagaacttcgtccaccgcatcaaaaacttctcgggctacaccgccgagatcatccaacacgaaatcgaccattgcaacgggattgttatttagttcaagaacgccacgtgggacaaaataatcagtagtttttgtcccagggtcgcctacggcaacaagttcgatacttctttcgaacctgggacaagaactactgattattttgtcccacgccccacgggtccacaaaaaagctccctgcagccaagcaactgcagggagctttttatcgtacggagcttctgtcccctacgactgacgataatggtcgaagaagtcggccaggtcttcgagggactctttgagcacttccatgcgcggcaggtagacgatgcggaagtggtcgggctcagcccagttgaagccgccgccacgcgtgatcaggatcttcttctcgtgcagcaggtcgagggcaaactgctcgtcatcggtgatgttgaacttcttaacatccatcttggggaagatatagaacgccgcacgcggcttaaccaccgagatgccgtcaatcttgttgagcgcctcatacacaaagttgcgctgctcgtaaacacgaccgccgggacggatatagtcgttgacggactgatggccaccgagtgccgtctgaacgatcgactgagccggcacgttggagcacaggcgcatgttggagagcatgttgatgcccatgatgaagtcgctcatgcagcgctggttgcccgaaagcaccatccagccaatgcgatagcccgcaatcatgtgcgacttggacaggccgctaaaggtaacgcagggcagatcgggggcgagcgaggcaatcgagacgtgctcgtagccgtccatgcacaggcggtcgtagatctcatcggcaaagatcatcagctgatgcctgcgcgcaacctcgacgatgccctcgagcacctcgcgcggatagacagagcccgtggggttgttggggttgatgatgacgagggccttggtcgcgctcgtgatcttggactccatatcctccaggtcgggataccaatccgcctgctcatcgcatagatagtgcacgggatgaccgccagcaagggttgcgcacgccgtccagagcggatagtcggggctggggatcagaatctcgtcgccattgtcgagcagcgcgttcatcgaaagctgaatgagctcggacacgccgttgcccgtgtagatatgctccatctgaacattgggcaggcccttgatctgcgaatactgcatgatcgccttgcgcgcggagaacaggccgcgcgaattggaatagccttcgcagtcgggcagctgctggcgcatgtccttgatgacctcatcgggcgtgcggaaaccgaagggcgccgggttaccgatattgagcttgaggatgcgctcgccctcgtcctccatacgggcggcctcgtcgacgacgggaccgcgcacgtcatacaggacgttatcgagcttggtggatttagaaaaagtacgcatggtggtgctccttgcaatttgagctgagggatggggttcgggcttggaatcgttgcggggtgatgatgcctcgccttgatcggcgtcgccggcaagcagccaggtaacatcgacctccaaaatacgggcgagcagctcagccacatcgcgccgcgggatcgtcttgccgctcacatattggctcatctgactcttgccgagttttttgccgagcatctccgatgcgcggattacgtccgactggcgaacgtcgcgatcggacatagtctgtcgcaggcgatcgctaaacgtctcttgggccactagaacctccttgctggcaaagttcaatttatagaatacgaattgaaccaaggttcaatttaggcagcagtataacgcggcacctcattcgaaagttcaatttcaaaaataaaatgagccaaacctcgagatttatcccaaagcgacaacggtgtgcgctcatttagaggtattcaaggaatcgagcggcggcaagcgaaacatcggccgttcgatatatggcgttgatctgccgatggggatgcccttcgagcggacgcacggcaacatcgaactggcagcgacgcaagatgagcgccggaagaatgctcacgcccaggccgtcctcgaccatagccataatcgcatagtcatcccaggtcgacagcttggagcgcgccgtcagccccgcctgacggaacagcggcgtaatctcgtcatcggtacctcgttccagcagaataaactgctcgtttgccaaatcgacaagagagacgacctccgccgcggcaagcaacgaatctgctggcaccaccgccatcagctcatcacgcaccaaagaccgcgatgccatgccgttttctcgtggctcacgcgggataaagcccaggtcgcagcgcccttccgccacccattgctcaatctccgagtaatcgcccatcagtagctcgtaatcgacatccgggtaatcggcacgaaagcgcgcaatcaccggcggcagcacgtgggtcgccacactcgaaaacgtaccgatgcagattttgccgcgcatgagcccacgcatctcatccacccgtcgctgcaaacgaacaaattcctcgcataacgcctcgaccgccggcataatttgccgcccatcggcagaaagcactacgccctcgcggcttctatcgagcactttaaagccccagtcggcctcgagatcggccaccatacggctcacgcccgactgcgaatagctcaggcgctcggcggcgcgcgtaaaactgccggcacgcacggtctcgagcagcacctgcatcttttgaatattcgtttccacggcacccctccacctttgcatgagtctttgtcatgttatccatgcattatattcgcttttcttctaaagccagttcacccatagtgaacatgctcggatatagaggggatgtcagcgcatgaacaacggactgtttacgtacttagcagcattgctattgtttggctccaacggcatcatcgccgctgccatcgcgctgccgagctccgatatcgtgctcttgcgcacgtttttgggcgcgctctcactcgttgtcatactcgtcactacgcaacgccataagttgcaggcgccatctcgcccccgcgaagccgcagccctcctcctctcgggagccgcactgggcgccagctggatttttctgttccgcgcctaccagacgatcggcgtcggcatatcctcgctgctgtactactgcggccctatcattgtcatggcgctctccccgctcatctttggcgaaaagctgaccggtggcaaaatcgccgggtttatcgccgtcgcctgcggcgcttttctcattgcagcgcaaggtttaggcggcaacatgcccattgcgggcatcgtctgcggcatcgcctcggcattttgctatgcactgatggtcatcgccagcaagggtgcgccgcacatcgagggtctcgagaactccgcgctccaggtgagcgccgcctttgtaaccgcgttgatccttacgctcttcacgcagggtgccccctcgttcctctcccccagcattgccgccggcatcgattggcgcgccgttgccatgctcggcattgtcaacaccggcattggctgcctgctctactttagtgctgtcgccaaactgcccgtgcagaccgtcgccgtcgtcggctacctcgagccgctttcggccgtcgtgttctcggccgtccttttgggcgaaaccataacaccggtccgcctgatgggtgccgcacttatcatcggcggcgcgctcttttgcgaactcgccggcaaacgcgcagacaccaaagcaagcatcgcccaagcggcacgcgcttaaaagcccctgctttgaaatgctacctgcgcacataaataatccccagctggggattattgtctaaaataacctgatgtgccaaactgctcttgtatgtataaagacggcataaagattatctgtcctagacagacaaccggatgtctaagggagtccacgtggcacacaacaaactggaggcaaacccccaagaccagcgtggtcaaggcgggcacggagccatccccctctccgctggcatgctgctcgtaacgctcggcgtcgtctatggcgacatcggcacgagccccatgtacaccatgaaatcaatcgtcgccaacaacggcggcatcggtaccgtcagcgaggacatgatcctgggcgcgctttcgctcgtcatctggaccatgacgctcgtgaccacggtcaagtacgtggtaatcgccatgaaggccgacaaccacaacgaaggcggcatcttcgccctgtttagcctggtacgcaaggtggcaccgtggctgattctccccgccatgatcggcggtgcggcactgctcgccgacggcatcctcacccccgccgtcacggttaccacggccatcgagggtctgcgcaccatcgagtggggccacgcgctgttgggtgacgggcaaactaacgtcatcattattaccatcatcattatctgtggcctgtttgccatgcagcgcgctggcacctcgtcaatcggcaagctgttcggtccgctcatgacgctgtggttcctgttcctggcaggcgccggtctattcaacatgctcggcaacctgtccatcttgcgcgcgcttaaccccatccgcggcgtcatgttcctgttctcgcccatcaaccactcgggtatcatggtgctcggctttgtcttcctgtcgacgaccggcgccgaggcgctctattcagacatgggccacgtgggcaaggccaacatctacgcatcctggccgtttgttaaagcggcgcttatccttaactacctgggtcagggcgcttggctgctcgccaacaattccaatccccagttgctcgcgatggatatcgtcaacccgttctatatgatgctccccgagcccctgcgcccctttgccatcgtgctttcggccgtggcggccatcattgcctcgcaggcgctcatcaccggctcgttctcgctggtatccgaggcaacgcgtctcaaccttatgccgcatctgcgcatccactaccccagcgacaccaagggccagctctatattccgctcgtcaataacatcatgtgggtcggctgcatcttcatcgtgctgctgttccaaaactccgagcgcatggagagcgcctacggcctcgccattaccgtgaccatgctcatgaccacgacgcttttgacgagctacatcgccggcatcctcaagcacaggctgggtgcctgcgtcttcgccctgctctttggtgccattgagctgtgcttcttcgcctcgtgcctcaccatgttctttgacggcggctacgtcatgatcttcctggccgcactgctgtttggccttatgtacgtgtggcgccgcggcaccgccatcgagcgcacgcagacgattttgctgcccgtctccaagtacatcgaccagctcaaccgcctgcgcaacgacgagacctatcccgtgctcgccgacaatctggtatttctcaccaacagccccgacccgctcacactcgaccgcgacgtgctctattccatcctggataagcatcccaagcgcgccaaggcatattggttcattaacgtgcacgttaccgacgaaccctatacgcacgagtattccgtcgagacctttggcacagacttcctgttccgcgtacgcttggacctgggctttaaggtcaatcagcgcatcaacgcctacctgcgccagatcgttggcgacctgatggcatcgggtgagttgccgccgcaacatcacacctactccatctacgagacacgcggcaacgtgggcgacttccgtttttgcatgctgcgcaagatgcttgcccccgaaacggacatcaaccgcaatgaccaccgcgtgatggccatcaagtacgccgtccgccgcgcttgcggaagcccggcgcgctggtacggtctcgagaactctgccatcatcatcgagtacgtgccgttgtttgcccgcatgcgcccggccgttaagctcgtgcgcacccaggtgccgctcgaggttcagattgaagaggccgaggaaatggaagtcgacatcttctcggacgacctggtcaacggcaacgaggccggcaagagcatgaacgtcgatcccaccgagctgctcgagagcgtcgccgatacgcccgagcaacagcaactcgacggactcgagagcacccagctcaacgacgccaacttctagcgacgtcataaatcaacgacagcggccctgcacctcacgagagacgcagggccgctttgcattgcagtaaagctaacggctacgaacgacgcggctcgggaaccacgagcctatcggggcttgcgccctcggcatccatcaggctcacgtagcgaatcgacggatccccatacatcgcgtagtaataattgcccgtgcgcgcgctaaagcatccggtgtagatagtcttctcgaacttgccatcgcccatcctggacgccccctcgatcatcaccacgccctcgagcgagcggaacatgcggacgacgttttcggtctcgctctccttttgcgggtaattggcattgaggtacgccgcctttacaaaacggctcggcgaatagcaatcacccggaataccgcgcatgccggcacccgcgccatagggcttgagctcggcgccacgccatgtcgccgtctgcggaaaatcgcttgtggctgtgatataggtgcgcaggttttccatgtgccacgggaaggtcggctggttggcaagggtgtcgaccggatcgtcgtatacatgcaggccgtcagccatcatctcgaccacgatgctgcgctggctgtcgccgataatccaatggagcagcgacacgcccagcccctctccggcagatttggcgacaatcaccgtgtcgcgcagcgcggtctcgacctcatcgaccgtcgagaacgtcgctgccacccacaggggaaactcataggccgcgatattggtcttgccgtcgacagggtcctcggcatactcggcataacccgggaaattgagacccgccacggcgaggcccgcatcgttgccgcagtcgaagaacatagggtagttcttgtaatcgatgcacatgccgattaccgcgtgtgccgccgacgcatcgtcgataaacgaatacggaatgtggaacccgcgcggcatcacacgaacctgttggccgtagtcaaagctccagtcgaggttgcggcccagatacatgtggccagaattatcggtaaatcgaatgctcgtgcacatagcgcctcctagctttacgttcctgctaaggttattgtcaccaaacaaaaaggcgctaaacacaaaagcccggacatgacaacaatgtcacgcccggaccaaaagagacgaagtgcggtgctttggtcccctagaccaactttccaagacagtggtcgatcatatgctggaccatctgcgcctcgaagcccacaaagtcctgcttgcgctcgcgcatcttgccgtcgacgatcacgtcataagcgaccttgcacttgatatagcgcgtggacttggtgacctcctcgtgcgtcaggcagctctcctccatcttgctggcacccaggccaaacaccagacgggggttgtagagcacatggggctcgccggcgtcgtccagatagacgcagaccttcttggtgacgccgatctggttggcggcaaggcagccggcatcgtcgagcgacttgatggtatcgatcaggtcctgtgccaccgactcgtcctcgacggtcgcaacctcgcaacgctgggacagaatagcctcgtcgtggcagagctctttaatcatacgttcctccataggggtcgttgtaactgcttaagtatacggtacccacacattttcatgcgaaaaataccgtctgtctgctacaaagcgccgaacatcaacatgcgaggaacatcagcctttcaaaggcgatatagtagttgagttcgtgtcaatcggcctaaactcggggccgaacaaggaaagggtatgcatggacgaactttttcacgtcagtgagcgcaagtccacaatcgggaccgaacttcgcgctggactgacaacattcctggcgatggcctacatcatcgccgtcaaccctgcggtgctctcgggcgccggcatcgatgcgggagcgctcgcctgcgccacctgcctgggcgccggcatcatgaccatctgcatgggcatcttcgccaaccgcccgctcgcctgcgcgtcgggcttaggcgtcaacgcgatgatcgccggaatcaccaccaccgtctgcggcggtgactggcacgtggccatgagcgtcatcttccttgagggcgtcgtcatcttgctgctcgtgctttgtggcctgcgcgaggccattatggacgccatcccggttgtcctgcgtcacgccatctcggtgggcctgggcctgttcatcgccatgattggcctgtgcgatgccggcattatcaccgctggcgccggcacactcgtcggtctgggcgacatcacctcccccaccttcatcgtcggcatcatctccatcctggtgacagtcgccctcgcctgccgcaacgtccccggctcgctgctcatcggcatcgtcgtcgccgtcatcgccggtatccccctaggtgtgacccaggctccgaccggtatcatcgccccgctcgacttctcgagcatcggtggccccatcgccgacgccggcggcgtgcccgccatcgtcaaggtccttaccgaccccgcgctcctcgtcatctcgttctctctgctcatgagtgacttcttcgacaccatgggcaccgcgatggccgtggccaagcagggcgagttcctcaccgacgacggcaacgtcgagaatatcaaggagatcctgatcgtcgactccgccgccgctgctgtgggcggtttcatgggcgtctcctccatcaccaccttcgtcgagtccacctctggcgctgccgacggtggccgcacgggcctcacctccgtcaccaccggcgtgctgttcattctcgccgcgttcttctcccccatcgtcaccatcgtttccagcgccgccacctgcggtgctctggtctacgtcggctacctcatgatgagcgaggcctccgagatcgactggtccgacgtgtcgcagggtttcccggcgttcatgattgtcgccggcgtgcccttcacctactccatctctgccggcattggcctgggctttatcgcctacgtgatcgtcgcgctctttaagggcgaggcctccaagatcaagccgctcatgtggatcgcagcccttgccttcctcgtctacttctttgtagcgtagcggcatagtctgctaaagcaaaacaacaaggcgcggaatcgcatcgagcggctccgcgcctttcttttaaagccaggcaacgcacagacgcgcgatgttttgcttcccaagttttggacattttgccctccaaacggcactaccgccggctacatcctgcagatatgctgggcttaatcgcataggccctatgaggatgggagtgaccatggccgccttgttcacgacccccaatcgcaatgacaaaacctctggagcccattttgtcgagcccgacgtgtgccgtcgcacgctgctcgcacacggcagctggcgccgcgtgacgcgccgcatcgtctgcggcctggcctgcgcgctcacggtgagctcgctgctcatgccgagcgtctcgctcgcggccgagtgggtggacgtcggcggcgtccgccacgaagcggccgcggggcccgcgggagacgccgccggcacctggagctgggacggcgccgatgacatgaagctcaacggctataacggcggcgcgatcgaggcagcgggcaagctcaacgtgagctacgagggcgacaacatcgtcactaacggcgacggccgcggcatcaaggttaaggatggcgcgaacgagaacgccgagcttaatattcagggcgacgcgtccagcacgctcaacgtgacatcttctcgtgacgccatcacttccgtcggcagcatcaacatcgacggcgctggcactgtcaacgccacgagcaccgagcacgatgccatcgatgccgggggcgatgtcaccatcaagggctcgggaaacgttaacgccacgggcgattcggatggcatcagggccgacggcaacatcacgatcgacaacagcggaaccgtcaccgccaaggccaccgaggatcagggtatcgatgctaacgagaacctcatcataaagggcggcggcaaggtagaggcaagctctatcaaagacaatgcgatttgggccgacggcaacatcgagatctcgggtggcagccaggtcaaggcaagctccgaggaagacgccaccatcgacggtaaaaacagcctcacggtcacgaacgcttccctcaacgcaagtggcgttgggtatggcatctatgtctacaagggcatcacgttcgatggcgcaaccgtaacggtccgtgcaagtgcagggaacgatgaagccagcgccctcttcaccgacgaggacgacatcgtcatcaagaacggctcgatcgtggatgcgttcgcagaaggccagttctcgaccgcaatcttcaccagaaactactaccccaacgaagcgggtggtcacatctacattagtgactccgttgtcaaggctatagcccgctatgtcgagtccggtagcgacggccccgatcactacagcaacgaccaaagtggcgcggtcattcccgagcataggggcatgaacatcggcatctttgcccggaccaaggagggcatcacgcccgcgaccatctcgattgtccgcagtaaggtcacagctgagggagacacggcggcaatcttcgcccttgccgtgagcgcggacggcgagacaatcggcaccatcgagatcgaaggcgctcccatacagacgcccacaggcggcaagatcattggctatcgcaacaaggaagaactcgatgacggcatcttctacgtggtgggtcaaaccatcggcacgggcgacgctgtgatcgactccccctataacgaagctgtcgccaagagcacggtcatcgcgcctcccgaggagatcaaacccgaggagaagccaggcgagaccaagcccgagggttccaagtccgagggcacgaagacgaccaagaccgttgcagttgcagccacgggagcaaagatcgccggcaaactcgcagcaaccggcgacgcctcgagcgcagccatcgtggcagccgcccttgcgggaacagccgccatcgccgcgggcgccgtggtgagccgcaagcgctcgtaaacactttttcgcacgggacgggtggatcgcggcccttgccttcctcgtctacttcttcgtagcgtaagggcaaggctgcaaaagctgaacaataaagcgcggagtcgccatgcggccccgcgcttttcttttagcgccggtccctgcgccggcgtgcggcctatttctcccccatttgggggtgcggacagaaagttggaccgtgaagcggtccggactggaggttcgcatgtccaggccctggaggacggcaccgcctacacctacctggtggacgcccactggtccctcgaattgaagaagacctacaccttcgtgaacctagccgaccccgagctcgccatcgagtggccgatcccgctggaggaggccaccgtctccgaggccgacctcaaccacccgatgctcgccgacgtcgtccccatggcgcccaggaggacgctcgtcaccggctgcaacggccagctgggccatgcggtccgcgcgctcgccgaggagcgcggcgtcgccaaggacttcgacttctgcgacatcgacaccttcgacatgtccgacccggcggcctatacgcagtacgactggtcgctctacggcaccgtgatcaactgcggcgcctacacggccgtggataaagccgagacccccgagggccgcgccatcgcctggaaggccaacgcgaccgggccggcgctgctcgcccgcacctgcgccgagcacgggatcaccctggtccacgtgtcctccgactacgtcttcgacggcaccgccgaggtccataccgaggacgagcccctcagcccgctgtccgtctacggccagaccaaggccgccggcgacatcgccgtggccggctgcccgcgccactacatcatgcgctcgagctgggtcatcggcgaggggcacaacttcgtcaagaccatgaaggcgctgtccgaccgcgtcgccgaccccgaggacgggcttgggcagatcaccgtggtcgacgaccagctgggccgcttgaccttcacgtgcgacatggcccaggccatcttccacgtgctggggacgcacgccccctacggcacctataactgcacgggctccggcgccgtcaagtcctgggccgacatcgcccgcgccgtcttcgaggccgccaacggcaacggggagaaggtcgtgccggtcagcactgccgactactacgccggcgccgtcggccccatcgccccgcgcccggtccactccgcgctcgacctttccaggctcgagtcggtcgggttccacatgcccgactgggaggaagagctgggggagtacctcactaagcttttttaatcatttttgtaaagtgatttgagctaagagtaataaatactcgtcttcggcacccgctcggaggctatcaagatgtacctgcacgtcaacaaaccgaagacgcgctcggatgagcccgagtccgcggtgaccatgaccggtcggcatcgcgaggtgctcgaccaggtgctgcgcgtcttcggtgttgcatctgaccacgaccttttctccgttcaggctgagttcgcggctatgagccacatctcgaacccctatggtgatgggtacgcgagcgtgcgaatagttgacatgctcgcacagtagctatctatgaactgatttatgaagctgctcttttggaacttaaataagaaagacaatgccaaccttgccctcgcatgtatgcgagagaatgaggtcggcattgctgcttttggtgagttttctggaactgaattctcagatgagctcttaaagggctctggatatcgcccaatgggttacggtgggtgtgacaaagttaaaatcattgcccaggagtccattgaagttcttgattgctttgaggaatctcggtttgccgttctgccgatgaaaataggcaagatttgtttcattattgccgctgcgcatcttgttgaccgtatgtcttcagccgatccggaaccaaggctggtggatatccgcaagatgatggatgtgattcacgggtatgaaaacgcgctatcaattaacaagacgatcgttatgggcgacttaaatgcaaatccatatgataaggagctacttctccccaacgcatttaacgcgatgctttttaaagggttagttagaaataaaaccggaagaacatggtgcggtgacgaatatccctttctgtataatccaacaattcattggttgtcggaggagctggagaactacggatccttttactattccggggattgcgccaaccctatttggaactgttatgaccaagccctggtaagcccagaattgatggactccattaattcctatagctatctaaagaggatagggaataggggcttgattgcaaaagttcgtcccaacagcaatataagcgaccatttgccgctgttagttgatatcgatttgagttaggtgagccagtcatgacttctagtgaaaatccgtgggcagaggtgttcactcaacctcaacaaaaaagaacagacggaatcatcccattttttactgaacaggcgaaaatgttgtctggggcttctaacggtagggtaaagggggtgttttccccgacttttgacgtaaacagaacgttatctccagcattagaaaccatcagctccatgtcaaagataattcagcatgcagcctccgcaagcgtggcggatctcactccaaaagtcgaccttttgaatgcaaatgacctttacaagaaaaatgactattgtttcgagattcgttcgaatagataccgattcaggctattcgccatcgaattcgatccatcgtatcctgccatcatgactgtcgatcgaggcgtatgcaacgatctagcaaagatatatgatcgttataagttcgaagaggccgagcggtgcaatatcacaatacaagacgatgaagatctcgaccgtgttttcaatcaacttttaaagagcgaaaagctgatctacatctgcaaccggctgatgaacgagaccgatgagatggcttaacgcttttacctttctttgagttgcatattcgaatgcattatttgacaaacatccgtaatatgaaccgtatgtcatagcgcggaccttaggcctatatgaactaaaatattgcgcgggaaacaatggttcctgcgcaatatttgttatttaagggatgcagatggacgaagtgaaaaaactaagtatcgctaatttcaacattacatatggtccagaaaatgagcccatgttgacttacttccaagacattttgtatccagcgttctgcaatgagcagaaagttcgtacctccaaaaatgtcagctatttctccgatgttgagttgaagctaataagttcggaatatgttctcacgggaatctgatccgtgaaactcattatagggtgcgaactatcgttgtcgataatgagctcgttccatctccaagctccgttccaactgctccatactctcgcttcatcatctatctcaagagtcatagaatgatcctcgtcaagaatgagggccaaagccccaatctcaagagttttcaagccgttttgaggaaagtcgtcgatcgttacactcgcgaggccaaccgagaaagagataaagcagacttgcctctatttcctaatgctgtaatcaatatcgttaacatgcccctacctgatagtattgatgaaactatcaaggaatttgcgaaaattaagtcaattaatcttcgctttttccctttaaacaatgatattgatccggcgccgctgctggcatacgtacgttcaacaatggattcggttgactcaaaaacgggaaacttaacattcaattcccctaaatcagctaacggaatctccaatctttttcaagatagcattgcttctggcaatgcatcagcaactgtaacaggtgaaaaacaagatggcacaaaagtaaaaatcactgacaatcaacttggttctgaacttcagattccaagtgctggaaatttaagtgctgacgatgacgaaagaattgcaaattactgcaagagtcgcaattatttacctgaagcaagtgaggataataaagccctatatggaaaagcactcaatatcctcgaattgcttgttagtaaaatttagaagggtttcttaatgcctgacggtctttcccaaattgccgtagttagaagctctggcgaactaatcagtgacgcacttcgcgagttaaagcccgtaaaaggaaacctaccaatctccattggagtttcagctatctccctggttctttcgttaaatatacttaatgctccgaataccattgagttaattgtgaacttatccacgacattaaaggatgtgttcttgggtttattcggagtagcgctctcaatttttgcgatctttttcagcctgcttgatggtaagcatgttcgtgggttagcttcacaaggaggcaaccaactattgaattaccttcgctactacgagaatgcacttgttttatttgcagtcgcttttacgttgagtcttttaatctctctactcgaccaggttacgatttataaaatgacggctatgatttgctgtgattattatgttgaagtagccatctgttttatgtatctagccctatcgtttcgaatagtgtgtgaaacaaaatcgctcctgtataacacttttgtatttactagagcatttatttgtctaaagggatgcgacggaatgcccaaaactgaaaccgacgccgaaccgaaactataatgtgactgtgaggttatcgtccgcgtataaatcgagccgctttctatcggatcatggtaggcgtagcatcaattgatctggcgggactacttcctttcaccgaccggcaaaacgatttacacctaattatcgacactgctcagaggcattttctatatttaaggtctgatctcgctaaactaataactgctgctaccagggcattttctggtgcatattctattggctcctgcgaagatcggagcgggtatgtttgctgcaaagtcctacaccagccgtcattacattgcgattgttgccatggcctgcctatgcgttttgctgggcgggccttcttatgccgcgggcgcggagagcctcatcatcgcgggcgcgacgtactacgagccaggcgcgtcgggccccggctgggcctggaccgatgccgaccacctggagcttaatggctacgcgggcgaggccatcggcgccgagggcgacctggtgctgacgcttgccgggcagaactccgtgacggagtcgcatgcgcccgatgcggacatcacgctgtgcggcatggaggtgtggggcaacctgacgcttcgcggcaccgggaccctgacggcgacgggctcgcagtgcgggatccacgtgtcgcaggcgctcgtggttgacggctgcaccgtcgatgcgcgggcagacggggccgatattacaaacgaggcggtcgccggcgtgattgccggcgacatggccgtgcgcggcggcgggcgcgtcgttgccgcgggcgccgggtccggagcgggcgtgcgcgcctacggcgtgtatctgcaggatgcgagccttggcgatggtttggccggctgccggctttccgtcgacgcctcgtggctcgatgcagccggtgccgacggcggagttgcttgcctgggcgggtcgcttgtgtccgcgcgatttgtgacgcctgccggcggagcctttggtgtaggtggcgtggtggatgcctccggtgcggtggcaccgcatgtggtggttgagcccgatgtcgccatgcctccggcgggggagaccggtggagaaggcgtgccaggcggcgggacgggtgagactgtcggtgatcctgctgcggggcagcccggtgcggaacctgcgacggaccccacagtgaaacccgcagctgcgatgcccaagacaaacataacgaccaagacgacggtgagcaagaccacagtgcctacgtcctccaagcctaaagccgccaccgcggccactgcgttgctccccaagaccaccgacaacaactggatcgccgcgtccgtggcgcttttcctgctgggaacagtgcttctgggcatcgcatgtcgttgttgaggtagctgccatttggaagaaagggacatccacaagaatagctatttgcttgtttgtttataggcgcccaaatttcgaaggcagaggccatacggacgcgaccatgggctgaatcgtgacaacaaactcggaataatatacgctagaacagattatcaataaagtggggcagaccacaagcaccaataagggcaccgggacctatgtaggctccggtgcccaagcacaatatcggcagtacacggagctccgcaatacggcgatcatggtcgggcacaaggcgaatttagattcgctgagttcatttttggtgcgatcagtatggtctaacccctcttttgcgtatatccggctgatgcagtcgaggtctacgtcccatgcgtagaattgcttggtatatagaattgcaacaccattaagtattgtaggagtttcttgtgaagtggaacgaattggctgaattaatatgcgcgtttatctctttatttgtaacagtcatcattggcaagaaacagtcttgccagagtaagcgcatggaagaactcgagcgtcgccaggacgaaagagacgaacgcagacacgccgaagggaataaggcgcaggcgattgagttcatctcgaagcattacgcagacagaggcctgattccgctttgcgccgttgccgccatgcacaatgatcttttccattattcacgcaagatgtattgggaattctgttgtctcgtgccggaggttcagaatctgattcttgaattctgcaatcttgacttgcgggtcaggggagaggatgacctgttcgtccgttgcatcaccgcagtcgaagccgccctccgtgaccgcttcccagaagatgaatctgttctttatgatgatgggaaatacgtgcttcgcagcctggaaaggtatgcgggggagagactgccagcacttcgggttgaccttcttcctgagtgcttggactcttcgttcctgccccctgatagctgtaccctggagtacgatcatcttatccgtaaagtcctttccgaggccttcgagtcgagggacgcttccttcacccctatttcccatctaaaaaatgagtatcaattcgaatcgagctctgagatagaggcctgccgattcgcgtcgaccgttgcattctacgcggcaacctacggctctggtgacgaggccaacaataggtactacggatgcccaggcggtttcgatggcgagagaatcgagaccatggaagacctatttctccttactgtcttccagatatataccaagcttctgcttccgaacgaagggtaagaaataacacgaggcattcgttatttgactctgcctaattctgccacgttcatttttcgaaacctcactcatttcctttataacttgggtatacttaaatcagaaattggtcgtagggcgcgaccaacggaatcaaaagaaagcccaccgagaagattttggtcgtagggcgcgaccaacggaatcaaaagaaagcccactgagaagatgccttcaatctctttgggttggaggcattttctttttcggagggtctgcatgaattctaaaatcgtctttttgacaaactcgttctacaaagatcatccaaacccgccgttcaaagagatggaacaaaagcaaaatcgtccttacatcgtctttttggtcgaaatcgagggacatacgtgggccctaccatttcgctcgcatattcgccatgggcacgcattctttaccgatgccgaaaacaaatgcgggattgattattcgaaagccgtcgatgtagacaagccagaatatatagatcaacaggtgcgtccacacttgcgccagaacgaatatgaagctcttcgcggaaatgaattcgcagttcaaaagggatttgaaaaatatatcaagctttacaagcgggctgttcgatcgggacatccgcgctatcaatcgcttatcaagtattctacgttgcagaattatgatttgtagccaagttggagcatagtggattcaggctccgccgtatgcttaaatcatattcacacgataatttgaggaagggacgctatgtgaaggccacaaagcgtcccttctttccccgcttggcagccggggccaggctctcagtgcgtcgagcctcggctgggtctggaccgaagccgaccacctggagcttaacggctacgtcgcccaagacaaacataacgatcaagactacgctgcccgcgtcctccaagcaaagagccgccactgcgaccgtagcgacgatccctaagcccgcagacaacaactggatagccgcttccttaatgcttttccttcttggaacagcgctcctggctgccgtataacgctgctaattccccgtttagtgagaccaggggagaagtgaatgcagccattgcagaagtctttagccttctactaaatcaaattcttagagattggtgccgtatcagctatcgctgcgacggcactattatgttcagctcgactgcctctcgatctattaccgatgttgagccttataccccatctgccagagcgataagataattgcaattcaaatactgccgtttataaagctccatttggattcaattgcctatatcactggagtcatactatgaggaactactatcaaatcaaaaccgtcgcatcggcccctccaaggaggctcatcccgatcggaaaagtcatcagcgctactggtcttgtattggtaattgtcagtctcttttccgctctgtcatcgagtgccaacatatatggttcgctttcttttcttgctctttggcttgttcttttttgtggacgggctccttcttgttattacagcatcgaagcaacaagaaaaactactgaggctacgccaatcgctcctagaagatgatcctcaaatagaagatgatcctcaaatcgttgcaagcgccgaagagttcatggctcagcgaaagtccctgacacagcaaggcgaaattactggcatcttcattgtccataatgcaaccaaagatctgtactacgtaggccaaagcgcaaaagcgattgaccgggcggccatacagtttctcggtaggggcaattgcgatgtgtatgccgactacaagtacggcgactcattcagcgtgcgcattatcccgctgtcagaaagcggctacgaaagtctcaatgagcccaaacgcacagcgatacaagcgctcgaggctgctggcgaggagctatattgaggacgaatgttaggataaatgaaatggcaagttcaaataacacaagcaacaacgagaaattaacgccgtccgtcgaagaaacgcttcttaacgaatccggctcgattgccagggtcaaatcgttctcatggatttgatttatcaataaggaacgaatccacgacatagatcccgtccaatgcggcaaatggatgttcttcttctctccattcaaaacagccctcatggacgacattgtcggaaccgcagtatttgatggcgtcgtcgtagaagccaaatactcgaatcccgaaacgctcatcgcggcaggatcgaaacaaggtgtctgttgcttttacctaaacggcaacgatagagaaagccataagagggtactgagctacatgctggaaaacgggctgatcaggaagacaaagaccggaaagctttataacatttcgttcaagttcgactctgagacctatgcaggaaagtacaagggcagcggcttctgcggaaagataaagctcgcggacttcgttgacctggagacgggagaatttatctaggacagcgaacgaagtgatgaactctgcttatgctaggcttttattgctaaccccatgatcaacgcaccgcgacggttatcatgtcaaaaagacactgaagtgtgaaatagcttaaatctcagtaatacaaataatcagcagttcaggtcttatgggaataattcaattcgcatcacgttgcatctaagcggctgtttatacttggatataaacactaaggaggcagcaatgctttggagctatgttcagctagatgacggcactcagtttgcctactcagaaacacgagacgacgggaccgttcgcgtagccgtcgagcgcccggttgattttggttttgaccatgcagaatgctttctacctgcggtcaaatggtttaacgtcgaaggattttctactgacgaactggattttttgaccgagttcgttagatcaaacgctccgtttatcttcgagcttgcagaacggcaaaaagctggaccggcggtggcataatgcctcgaattcttgtttttggacagtatgttctgttcttttggatcgcggaaaacggagaacccgttcacatccatgtaggggtaaagagggcggctgctaactcgactaagttttggctcactaaaaatggcggatgcacacttgcgaacaacgagagcaagattccggctaaggatctcagggatctttcaaaactaatcaccatgaaccatcgatacatttgtgacaagtggcgcgaaacctttggtgatgattccctgacattctattgctaaaccgcaattgagccatgattacacttgtcaactcatgattgccgatgtcgacgggcgggtccttcccgttacgccgctggtgctccagtcgtactttccgatagcccggaacccaaagacaaccagcactacgcctggatccaggaccttgtttccggaaaccgcacgcgagcagaactcgccgacgagctgcgccgcggttgcgttgtggacacgggctacccgtcgcacgtataaaatcaaagcatccacacgcctgtcattatcttgattggaagccatatggagatccccagcaccctgtgcagcaatgtgtacgacttcgcgttttgccccgagccctgttacgagcgcttggccgacctcgccgatcccgaggactggggtccctgcaaccgcattctcaagaactacctgtcgttttcgtttagccacgcagtatttttgaccgagcgcgacgtggaccagaccgcgccgtccaacctgccgctggtgttcgacgacgaccgatgcctgtttaacaccggcctgtacacgcgccgctacgagaccatctacggcctgtttgagcccaacaccaagcccgacgcgcgccagcgctggtttttgaagggcttctttaaggagagcgaccccatgctggtctcgtttgagtacctgccgtgccgcgtgcgctttgccgaggacccctccgagcttgtctttgactaccgccttcccatccgctccaacatcgaccacattctgggcgatgaggagaacctgacgcgtattcccgccagtctgatgggggagggtaactcgttgctgctgcgtcgcgcctttgagggcgccgtcgtcgaagccgcccgacgcgccgccgccaattacacgctcgctgtgccacagttttacggaggccgaatccagctgctgctgccgctgtgcctaaccggcgacaagcccgagctggcgctgaccatccagcgcgaggatggcttctatgccgtgcgcacgtgcctcacgctcgacatggcgtacaacaacgcgcgacttatctgccgccccgagacttcgtggataaagcggtaaatggtggtttagctgcggttttgttggctgacagggttgaaacagtgctgcttgcgcccacgaatttaaaatcgggggcaaaaagttcttggtaaaccacgcgcggctatgatagtatctcttttgccgaaaggcgacgggcgattggctcaggggtagagcatatccttcacacggatggggtcacaagttcgaatcttgtatcgcccaccatctaaagtacaggtcagaggtgttaagcctctggcctttttctttttgacaccaaggctgactccaaaacgaatcgtagtcgtataaggcgtcatttttttcgcaccctttttgctgacgccattgcatgttttaagaaaaacgcatgcgtattttcattgaattccccatgtgatccgcgcgcaaatgtggagacagggaccacatgcccaaagctccttccagcggttttctatcacacgacggtttttcggcggaactcggcatgcttttgtcagcatttggtttgcttcccgtacttacccgcatgatgccccggcagataatcggccatgcccgcaatccgcacggcctacggtcgaaaccaggggaggccacatggacgaaatcgtctgcgcaaacaccgcattccgctactggcgctgcccaccgcaggtgcatgacctctacccgcgcctacccagctccgatgacggctggcggaccctatcccaagcccctttcgtaaccgatgtcctcaagaccccgattatcgctgttgcttcgccaggttgttgtaatcaccactcgggattgcgctccactattcgctgggaaggggcttcggataccggcacaacaaccgacactcatttaggctttagcgttgttagcgccgggcgattttagccgctaatagtcaaactattttgaccaatcccgccctcccgtctcctgcgcccctcccggaactgtccacatcagtgtagccaatccaccagttgcccttcctgcggccggtgggcgtcctctcgtcgaagacgagcccgtgcctgagcaggaacttggagagccgctgcttcgagcgcgagaggtcgtccctcgcgtcctcgagcgccctagtcaggtcgcgggcggcctcgcactcgtcgtcggggacccacacctcgaccacgttgccgaccgacagcatgcgggcgaggaactcggcgtcgttgcggtcgttcttcctgcgcctgtccgcgctgggcttgatcatcttcgagacggcgccgaccacgcagtcgaccccaaggccggagagcctcttctgcaggtcgaatcccgtgaccccggactcgtacacgcacctggccttagggtccacggagcggacccaccccgcgacggcgccggcgtcgtagccgaaggtcgcgcagcgcacctccccggtcatgacgtcgagggagacggcctttatcgaacgggcgtggacgtcgaggccgacgaaggtggtagtatcgagcatgggagccccttccatgaatgcggcgtggctgccgcggctgaattagacactcaccattgtcggcctaatccgcggtctttcatgcagcaggggctctcaatgtttttatgtcctgctcatatcgtctgtgccggcaggtggggacactcctttgctagaagatccggcgcaggtctccgcggttgagggcttcgtcgaagaggtgcttgaacaccacgctgccgtgcagaccgtcgtgctcgaactcgttggtcacccaggcatgcgagtcgcccacgcggctgagcgtatcgagctgcaagcccgaatcgacgtacatgtcgtcgaaatacaccgcggcctggagcggcacctcgttgcacgccagtcgctgcgggtcgtagatcttgtcccagctggtgtcttccatcagcaggtccatggcgggtttgaagggcttgagctcgggcatctgctcgaacatccacgggaacattgcctcgccggtaaacatgagcgggcgcgcgagggtgtcgaactcggcgcggtgtgccttctcttcggccgcggcccaaccaatgggcatagtgtcgccgtcggcgtagatgaactcctgcagtgtccagtacagcgggtttgtacgcgtgttggtgcgctcgaaggcgcgcatcaaaaagctgtcagataccgaggcgccgcaggccagcgtgccgtcgccgtcggcaaaagcgtgatcgacaatccaatgcatgcgctcaaagctcggcttcataccaaagtcgctgcccatgagctgtaggcgctcgaccgtcatcggtgagccgtcgggcagcacgggcttctgggcctcgagcgcatcggccagtgccgccacgcgctcgacgtcggcggggtagcggtcgtaatactgctgagtcttggccgccatgcgcgggaaggtgtgcgcgtagacctcgcttgcgctcgctggcacatgtggaatgccgccgcaggtaaagctcgccgccacgccttcggggaagagcgacagatagctcaacgtcaaaaagccgccgtagctctgcccgagtgtgacccagggcttgccgccaaagcccaccaggcgcaggtactcaaaatcgcgcacgatggagctggcgaggtggcgcttgaggaagtcagcctgcgagcgtgcggcatcggagccggccgccgtcgcgcgctcgcccagtgcggcaatcgtgcgcccgtccacgcagcaactgcgtccggtgccgcgctggtcgggaaggaccacgcggaagtgcttgacggcctcctcgatccagccgtcgcttgtgggcgacagcggacgcgggctctcgccgccggggccgccctgcaaaaacaggagcagcggcagatcgtcgttgatgcggtcgggcgcgcaaaccacgcggtagaagagcttgatgctctcgggcgcgccggcgattggtgccggcatggcgccgcggcgcatggtgctgccgacggccaggagcatcggctccaggccgcgccagtcaagggggacgtcgatgctgtggtcctcgacgtaaaggctggggacgtggtacgaagtgatgagggccatgtgagtcttccgttcgttgcggtgtttcgggttgaccaattctaccgccgcgggcgaggccatgcgcaaatcggctaccatggttgcaaacttctaggagaaagggccgcccatgtcggtcgatatagccacgtatgtccacgatcttgccgttgccgccaaggcagcgtcggcctcgcttgccacggcgagcgatgagcagcgtcaggaggccgtgcgcgccatggccgcagcactgcgcaacggtgtcgactccatcgtcgccgctaacgagctcgatatgtccgccgcgtgcgatgcgggcacttcagccggtctgctcgaccgtctgctgctgacgcctgagcgcgtcgagggcatggccgccggtttggagaagctcgccgagctgcccgatcccgtcggccgcgtgctcgaccaccgcgtgcttgcgagcggtgtggacctgacccgcgtgagcgtgccgttgggcctggtcgccatggtctacgaggcgcgccccaacgtgacggccgacgccgcaggcatctgcatccgtaccggcaacgcctgcattctacgcggcggctcgctggcctatcactcgtgtgccatgatcgccgagctgctggccgatgcgctcgaggccaagggcttcccgcgcgaggccgtgtcgatgatcgagtccaccgaccgcgaggccaccggcgagctcatgaagctccgcggtattgtcgacgtactcattccgcgcggaggtgcaggcctgatccagcgctgcgtgcgcgagtcgcttgtgccggtgatcgagacgggcacgggcaactgccacatctacgtgcatgaatccgccgactttgataaggcgctcaacattatcgttaatgccaagacccagcgcgtaggcgtgtgcaatgccgccgagtcgctgctggtcgaccgtgctgtggccgatgcgtttttgcctgcggtcgttgctgtattgcacgaccacggcgtgctcattcacggcgacgaggccacgtgcgccgcatgcgccgacgccgggcttgccgagggcgacaactacgtcgccgcgactgaggaggactggggtcgcgagtacctggcgctcgagatgagcgtgaaggtcgtggcaaacgaggacgaggccatcgcacacatcaaccgctacggcacgatgcactccgaggccatcgttgccgaggatacggatgcttgcgagcgcttcctggatgcggtcgatgcctcggccgtgtactccaacgccagcactcgcttcactgacggcggcgagtttggcctgggcgccgagatcggcatctcgacccaaaagctccacgcccgtggcccctttgccgccgaggccctcaccacctacaaatacaagctccgcggcaccggccaggtccgcccctaaacccctcgtaaacgaaaaccaccacaaaggcgcctgtccccttcgtggtggttttaggtggcgtgggcggttaggcctggaaggtatcgcggtcgggggcgaaggactgcatggccgcgatggtgcggtcaaagagctcggggagctcccagcccaacatctcggcgccctgcgaaatcacgtcgcgcgagcagccggcggcaaagcgcttgtccttgaacttcttcttgagcgacttggtcgtaaagtccataacgctcttgctcgggcgcatgatgactgcagcgccgatcaggccggtgagctcatcgcaggcaaacaggatcttttccatctgcagctcgggtttgggcagcgaggtattaaagtcggacgtgtgcgtctggatggcgcgaatgagctcgggagacgcaccttcgcccttaagaatctcggcagcatagatggtgtggttcatggggtcgtcctcatgctcctcccaatccaggtcgtgcagcaggccgacgatgccccaaaactcctcgttctcggggtcgaactcgcgcgcaaagtagcgcatagtgccctcgactgtctcgccatgggtgatgtggaacgggtccttgttgtgctcgttgagcagttcgaacgcgcggtcgcgggtgattccggcggtaagcggctctgccataggagactccttgtgctcgtgggtatcgataagaatgaatactactagaacaagaaaaccaccacaaaggtgcctgtcccctttgtggtggtttttggcgcggatgggttagttgagggcggcttgggctaggcgggcttcagcgtcctcctcggtgacgccaagggccacggcgaactcctcgatggagcggcgcttggcttccttgagtacgcgcatgtagtaggagctgggctttttatcagctttctcggcctggcgaatgcggtgcatcatggtttttgccacgcggaccgtctcgggcgcgcccagcttgagctgctgtttaaagtgcgtctcctcaagtgagctgttgcgctcggtaaaggtgtcgcactccagctcgtcgtagtggctcagcaggtgctcggcatcttgttgagagatggcggcgtgcaaacggtcggcctgcgctacggggtacatgaggatcgtctgcgcatgtccctgcttggtctcgagcagcagcatgggctgcggcgtgtcgtccctaaaaccgacgacggtgcagactccctggcccggatgaatgacgtgttgaccgattgagaacatgctacctccaacttatacgaatttacgtatgactagaataacacgctgacgtgcgcaaacccttactttatgcaggaaaagcacacaactccgataggtaagagtattcgataacagacgcagctcattcacacctttatgcattttcaacgcttgcataatctgcaggcagaccggcatctttgagtgactccatacaagctgtagtcaattttgtgcatatgcaatatctattagctttaccctgcgacagtgcccgtcgcttgtgatagagtgctacaaactctggcttttgccctacgagtgaccaagagctcgggggctttaacacaaggaggatctatgcccgagaagattgaagagctggtacgcgctgcgcttgctgcggcccaggaggccggcgacctttccgcatttgaacttgacgattgcgctatcgagcgaccggctgacacttctcatggcgagtggacctctaccatggccctgaagtccgccaagctggcccactgcgccccgcgcaagatcgccgaggccatcgttgcccatatgcccgaggaccccgcgatcgagaaggtcgagatcgcaggccccggcttcatcaacttctacctctccgttgccgtcaagaatgccatctttggcgaggctcgcgagaagggcatggacttcgctaagtccaacgtcggtggtggcctgaagacccaggtcgagttcgtttccgccaaccccgtcggccccatgcacatcggccacggccgctgggccgcgctgggcgactcgctctgccgtgtgatggaccacgccggttacgacatccagcgtgagttctacatcaacgaccacggctctcagatgaacaccttcggcaactccatcagcacgcgctatatgcagcttgccgacatcatcgccaagcagggcgtggatatcgacgaggctcacaagctactgatcgccgaccgtgacgcctttgttgccgacgagaacgacgagcaccccgagacccatccgtatcaggacaactttgccgagaccctgggcaaggactcctatggcggcgactacatcatcgacgaggctgccgagttctggcgcaccgacggcgataagtgggtcgacgccgacccgcaggagcgtatggagagcttccgcgagcgcggctatgtgaagatggtcgacaacatgcgcgacctctgccacgccgtcaattgcgacttcgatcgttggtactccgagcgttcgctgtatgtgaaggacaccgagggtgagaccgccggcacctccgccgtcgaccgcgcttttgagaagctcgacaagatgggctacctctacaccaaggacggcgccctgtggttccgctccaccgacctgggcgatgacaaggaccgcgtcctgatcaagtccgacggcgagtacacctacttcgcctccgacgttgcctatcactgggataagttccagcgcgtcgaccacgtcatcgacatctggggtgccgaccaccacggctacatcgagcgcgtccgctgcgtctgcgacgcccttggctatcccggcaagtttgaggttctgctgggccagctcgtcaacctgctgcgtaacggcaagcccgtccgaatgtccaagcgcaagggcaccatggtgaccctgcaggagctcgtcgacgaggtcggctccgatgccgctcgctacacgctcatctccaagagctccaaccagatggtcgacttcgatattgaggccgttaagaagcgcgacaactccaacccggtctattacgtgcagtatgctcacgcccgcgtgtgctccatcctgcgccgtgccgccgacgttacgcccgagcaggctgacgagatgggcatgaaggccgtcgccgagaaggccatcggcgagaacgtcgattactcgctgctgaccgacccgaccgagcttgccctttcgcgtaagctcaacgagctcaccgacctcatcgccagctgcgctcgcgaccgcgccccgttccgtctgacgcactttgccgaggagcttgccggcgacttccacagcttctacgctgcctgccaggtgctgccgagcgagggccgtcccgtcgaccccgagctttcgcgtgcccgtctggccgcttgcgatgccgtccgcgtgacgctcgccctggtgctcacccttgttggtgtctccgctcccgagcagatgtaagctgcgggtcatttaaccgtgtaggttcggctttgctgagccctataagcccgatctccatgcggaggtcgggctttttgcaaacgccgacgtattgacgaatttggaactgctggaaatacgaaactatgccggtttactacgatgaatatgagaaattccaaccacgccggcttttcgcaaaaaagtgcagggcatctacctgcggttttagttcaacaagtttcggagtggtcgcggttgagcgattcatcgtagtaaaccgccatagttttggcggaggcagtcagatttgtgggcggtaaaccaaagagtgccccttttgactagtcgtttaagagcgttcccaatgactaagttgcaggtggttgcggttgtgttacactaacgctgcgtatatgacgcaatcatctcgatacagatcaatgatgtccgtcgttttgaacggaactagactgtttagccgccctgaaggtttatgcagggagcatgtgatcacagggcttgaaaagaaagttgagcaaacactgtgtctgatcaacagcaagaaaacgaaataacgacgacgcaagccgctcccgctgcactggttgcgtcggaccaggtcgcggcgcccgcgcatgcctcggctcctgagacgcctaaggctgcttcgacgcctacgcctgcaacggctgagaaggccgtgcctgcaactggtgaggaggctgctccggcaaagcccaagcgtacgcgccgcacggccaagcctgctgctgacggcgaggaggtcaccaagcccaagcgccgtaccacgcgcacgacgcgcgtcaagcgcaccgttgcagctgactcctcggcgccgatttccgatgaggtcgcgcaggcacgtgcgttggcgcagattagcgaggctcaggtggtgcgcgcccgccgtcgtgctgccgagcgcgaggccgcggctctgaccgagcttgcagctccgtctgtgcccgagacgcctgccgccaccgagacccctgtcgccgaccagccgaccgagaagccggtaccgcgcacacgccgtcgcacggctgctaaggccgagcaggttgccgatcaggtaacccccgagctcactgaggcttcggtccgttccgcggcaggggagggcacatcgcctgttgagcccgctgcgcctgtcgaggccagcgaagttcccgttgtcgatccggctttgcgcccgcaccgtcgcggtcgcaagcccaaggccttcgtcgaggcagagaaggccgcagccgcagctgcagccgctcgtgctgctgcggcgaccgccgagtctgcaaccgccgccgacgcgcccgtccaggatgctacgacttccgaggccgctcccgccgatgtccgtcctggtcgcagccatcgtactgctgctaagcgcacgtccaaggccaaggctgccaagaagggtgcgtccgaggattccggcgagacgaccgccgatgcatcgattgatgccgccgagccccaggacgtcgaacggcctgcgtccgagaagcccaagcgcggtcgtaagaagtccgctaaggccaaggcgtccgagcagcaggctgatgtcgaagcgcaagtcgattccggcgccgagggcaatgacgccgctgcggccaatgccgacgccgccgcaaccgatggcgccgcgcccgccgaggccgaagacggcgctcgccccaaccgtcgccagcacaagcgcaacgacgagcgcaatgagcgcaaggacgagcgcaacaacgaccgtcgcaaccgccagcgcgatcgcaaacagcgcaacaaggagcgcaacgccgcccccaccgagcccacgctttcgcgtgaggagctcgctgccatgaaggtcgccgaactgcgcgagaaggccaaagagttcgagatcgagacgaccggcaagaagaaagccgagctcgtcgaggaaatctacgtcaccgccgcgaaggccgagggcttccgcgacatcaagggcatcctgcagattcgtccggacagctccggtatcatccatgcccacggttacatgaagtccaacgacgacgccttcgtccccgcctacctcatccgctccgcgcgtctgcgcacgggcgacgtcatcgagggctcgcttcgtccttcgcgcggcggcgacaagcgcgccggcctcgccaaaatcacgaccgtcaacggtctagaccccgagcagattcgcaaccgccccaagttcggtgacctcaccccggtctatcccaacgagccgctgcgcatggagcatggcaaggactccattaccggtcgcgccatcgacatcgtgtcgccgatcggcaagggtcagcgtggcctgatcgtgtccccgcccaaggccggcaagaccacaatcctcaagaagatctgccagtctatctcgattaacaaccccgaggtgcacctcatctgcctgctcgtcgacgagcgccccgaagaggttaccgatatgcagcgttccatcaagggcgaggttgtggcgtcgaccttcgatatgcccgccgacaaccacactcgtgtggcagagctcgtcatcgagcgcgccaagcgcatcgtggagctgggcggcgatgtcgtggtggtgctcgactccatcacgcgtcttgcccgcgcctacaacttggcggcgcccgcctcaggccgcatcctttcgggcggcgtcgattcggcggccctgtatccgcccaagcgcttcctgggcgcagcccgtaatatcgagaacggtggctcgctcaccatcctggcctctgccctcatcgacaccggttccaagatggacgaggtcatctttgaggagttcaagggcaccggcaacatggagcttaagctcgaccgcgacctagccgatcgccgcatcttcccggctatcgaccccgttgcctccggtacgcgtaacgaggacctgttggtcgacgagcagatgcgtccgtttgtctttggtctacgtcgcattcttgccggcatgaacaacaccgagcgcgcggccgcatcgtttatcaagggtctcaagggcaccaacaccaaccaggagttcctggtgcgttcggccaaaaagcacagcgactacgagcagacgttctaggttgtaatccacacgcagcgttaatcatcaatgcgataaagggtcggggctttgagcctcggcccttttctatatcgccgcttcgcacttatttttgaccataagacttgcaagcagcaggtttcccgtttcaatccgacatcgtcgcttgcaatcgacagggcggtttcgcataatggcttttaagcttcgcgacggaaaacgcagatgaaacgaaccatataccgttgctttggggcatagccccgcttcatcttctctcgcgcagccaactgaatgatgcgatttgggtgctggaagatggggagagctcatggcttcttctgatgcaacacaacgagcagtccttgccggactttcgtgcgggatcggccttgccgctcccgtggttatgtatgccgcgacgctgccgttttcgtcggtgaacgagacggtcgtggcgggtgcggttcccttcgccgtgggcgcagtggcgggcgtgggtatctatgccgcctcgctgggtatctccgagtatcgtgcgcagcgtgaagagcgtctgttccagcccgatgccatgggcggtgccgccaatctcaatcagcatcaaagcgagttcaagaccgcctcgattccagctcagcagcaggatgcgactccttacgctgcggcttctgcttctcaggctcaggcggagcagtctacctcggcattcctttccggcctgactggtgcgttccagcgccgtcatgccgatgatggtgtccctaccatcgctcgagctgcagatgctatggacgaggacgaggcttggtccatgatcgacagtatgctcgacgacgattcgccggtgagctgcgaccctgcacactcgcgcgacgtctatcaagtcgccatcgacgagctcaccaacggcgggcagaccgactccttcaatcgcgacgacatcgccgccgcggcacgcgccgtgtctggctcccaggccgcccctgcgggcagcacggcggctttcgtggcgctcgtcgccaacgcggcagccaataacgcctacagcgctacctcggcggacgcgagcgcttctgccgacaattcgtacgttgatgaagccatggccgcggacgaggaggccgttgccgcccgccgtgccgccgaaagctcgctttggggcgctcctgcccagcagcaggcggctgaggctgcgccgtacaacgcaaacctcgccagcatgcctatcatctccggtgccgcggacatcgatctcgatgacctcgatgagcctgcagccatcaccgcatcgattgatgcccaagatcgcatcgacaccggcgaccttccggacgcctcgctcgaggttgatgtccccatggccgattactcgggccacgaggacatgtgggccgccgccaccgcgattctggatgagattgacgagcctgctcctgttgcagtccccgctcccgtcgctgcccctcagcctgctgcccccgcctatgtcggccgtcacagcgctgtgttccccgaggatactgcccgcatctcgcgcgagagcatcgagcgggccgaggctattgccgccggcattatggaaaatcgtcgtcacgagcgcgtcaatcagatcctcgaggaagagatcgagcgcctgcagtcctctaccgccaagcgtacgggccgtgcctatttgagcgttatcgagggcggtaccgccagcttcgcgccgctccgcgcggaggcataacttctgcatggttaagatcaatcgaaaatgggcggttgtaacctgcctgatggcgctcttgatctggggcaattcgctggttcccggctcggggtcgggctcgctgagcctgacggtcatggaagctatccgcggtttcctgcacggcgtgggacttccatatgaatgggtgaccaactttgttgttcgcaagtgcgcgcattttaccgagtatatggtgctcggcatcttggcaacgcacgcctttgattttgagggccggcgcacctttgacgtgctgctgcccacggcggtgttcctgctgctgattccctcgatcgacgaaacgattcagctctttgtgccgggacgcgccggcatgatcaccgatgtgatgatcgactgctgtggagctgcaacgggcgttgtgctccgatatctcttacggtcgctgatgtacgccaaaaaagccgcctaggacgtattgtttggtcctaggcggccttttttaggcttataggacaaaatgtgtgtccacgttgggggcatcggcgcaggtcgatgcccgcgattggcgaaaatgcgttggtggaaatggtgaaaattatattgacgctaacaggcgccgctgatctcgttttgctccctgagctcggcgaggcgctcgtcggcgtccttgtacatggatcggaacttccacatgcggaaggtggacaggctgccgtcgcggtgggtctggcccacgcggatctggctgtagaaggggttgccctcgctctccaggcggatggccgcggcgagcaccaggctcggtacggcgatgacggccagcacgcagccgctgaacacgatatcgaaggcgcgcttgacggtgcggtatgccaagcgcgagttgtcccattccatgacggattgcatggccttgtaccggccggcgccctcgcgccggtccatggcctgagcaatgagcgccgcccccgcggacacattgctctctgttacttctttagcagccacagtcaaacttacgtccccgttgtccagggatcccccaatcggcaaattcaaaatgcgaacgaatagctggtgcaacgtctcccttacgttttgctgggaacgtcgagcggtagcagctccctaaaagcggagtcgccttcgcccacgtctaccaggcaccagcgcttatgacggtcgatctttttaacgcgggcctcttgccccaccaaggggccctgctctatgtgcaacacgccgtcttctatgcgcgcaatgctgttgcgcaccacgccgtcgtcgtctagcacactgcggtaccagttctgtgcatcgtccggcatgggcatgtacgcccgctccctactaccggcgatgcgacagccaaagctcaactgggccaaagccctatcaagcgcggcggcatcgtgcgtggcgacgaagaaatattccttgtacataggtttggtttggagcgaccaggcgccgtcccgcttaaaccagaactccttttgcatcacaaaagcgttctgcatcagctcgtgcgggataatgtggcggaccttttcgcaggtctcgcgctcttttccattgggggtgtgaaccaaataccagcggacgcggccgtgctggctgttggtgctggcgccgttaaatgcgcccggcagctgttcttggcgccgtgccgtctgctccatgtcctcgcccccttttcttgctttgcggcacacgcaaatgcaggggcgtttagaacaggcttctcgctcgcagctaggcgcagtcgcaaaagtacaggtttttatagaggggtatggagatgcacctactggcagtacattttgcgtaatctgggtaaacgctgattaattgctcgtataatgtcgtcagtcgaaagatacaaaaacctgtacctttttgtgcaacaaaaaaggccgctcaaccagcggcttttcttatttcggcatgaaaaaaggcgaccgcccttcgtggacggtcgcctttgttaattgttatgaagtttgccttaggcgcgggtcttgatctcctcgagcaccttcgcaacaaactcgtcaacgctcatctgaacggtctcgttggagcgatcgcggacggagatgttgccggcctcgacctccttctcgcccagaatgagcatgtagggcacgcggtcgatgctgcgggcctcgcggatcttgtagccgatcttctcgtcgcgatcgtcgcagaccacgcgaatgccggcctcctccagcttggcgcacacctcgtgggcgtagtcgcggctcttctcagagacgggaagtgccttgacctgcacgggagccagccaagtggggaacttgcctgcaaagtgctcaatcagaataccgatgaagcgctcgatggagccaaagcatacgcggtgcagcatgatggggcgcttcttggtgccgtcggcgtccacgtactccaggtcaaagttgagcggcatctggaagtcgagctggacggtaccgcactgccaggtacgaccgagcgagtcctccaggtggaagtcgatcttggggccgtagaaggcgccgtcgccctcgttgacctcgtagtccatgtgcagctgctccagagcggtgcgcaggccctcctcggcgcgagcccagtcctcgtcggaacccatggagtcctcggggcgggtggaaagctcgacgtgatacttaaagccaaacttctggtacacggagtcgatgaggttaaccacgcccacgatctcgtcggtcaactggtcgggacgcacaaacaggtgggcgtcgtcctggttaaagcagcgcacgcggaacaggccgtgcagggcgccgcgcagctcgtggcggtgcaccaagccaatctcgccggcgcgaatgggcagctcgcggtaggagtgcggcttggaggcgtacaccagcacgccgcccgggcagttcatgggcttaatgcagtactcttcgtcgtcgatgacggtggagtacatgttgtccttgtagtggtcccagtggcccgaggtcttccacagctgcttgttcatgatgagcggcgtggagatctccacgtagccggccttgtggtggatctcgcgccagtagtccagcagcgtgttcttaaggatcatgccgttgggcaggaagaacgggaagccgggggcctcgtcgcgcatcataaagaggtccatctcgcggccgatcttgcggtggtcgcgcttcttggcctcctcgagcatgtgcatgtgctcgtcgagctcttccttggtggcaaaggcgacgccgttgatgcgggtgagcatcttgttgtccttgtcgcccttccagtaagcgcccgagacgccggtgagcttaaaggccttgagggccttggtgtagcagatgtgggggccgacgcacatgtcgatgtagtcgccctgctgatagaaggtgatgcgggcgtcgtcgtccaggtcgccgatgtgctcgaccttgtacttctcgccgcgctcctccataagtgcgatggcctcggcgcggggcttctcgtacacggtgaacttgaggttctccttgacgatctttttcatctcggcctcaatcgcggggaagtcgtcctcgctgatcttgacgccctcgggcaggtcgacgtcgtaatagaagccgttgtcggtcgcggggccgtaggcaaagtcggcctgggggtacaggcgcttgatggcctgcgccatgatgtgcgcggcagagtggcggatgacgtgcgtgacctcgtcctgcgggagctcggccaccgaaccgtcattgtagagtgccttcatgggtatgttttctcctctcggatgcctgatgcaagtgcgtgcgatgcgctcggcgtttttgacttgcatcattataggcaggttgccttggtatacaagcgcccgccgcaccttaatggcacggcgggcgattttctacgcatgcttcatcgtgtagggcggggtgtggggcgcgcatggcttgcgcgggacgcgcggtgcccgtgacttacggccggcccggcgatggatgcgttactggatgcgagttcggcagtaggggcagaccttccagtgcgcgtcgagcgggcgatggcagctggggcacacgttgcgaacctgggtgtcgcacacggggcagaccacaaagtccttctcgatgggggcgccgcactgcgggcaggtgccgtactgggcaagctggcgctcgcgcagggccatgtccagctcctgctcctcgcggtcggccgcgtaggagtgcggacgcagaaccagataggcgatgaggcccacaaacgggatgagggcgatgatgccccatgccacgtaggcgctggcgccgcggcggcgagcgtcgatgaacacatagacgaccgacagcacgtacagggcgatgataaagccaacgaaggcatagatgacgcccataagctgcggcgacatgagctcagagatgtacttggacattgaggtgtacctttcggaataattacagtccggtcaagtttaccacggggtatgtttatatgggaccacggctaggggcggggctagcgcggacacaaacatctcaatctgtaacaggtggaagcggaatccgggtctagatgttacagatcgagacacgggggtccctccccgacttcaatctcgatctgtaacatcttgactccaaaatcagctcttactgttacagatcaagatgaacggtgagccctccgttaaatatctcaatctgtaacaactaggggtcagaaacccttctatctgttacagatcaagacaaaggaaatgtccaatctcagtatctcaatccgtaacaacaactcgtcaaaaacaggtctaaccgttacagatttagacattcgaaaccgactgataggttcatctaaatctgtaacatcttggacctcaaaacggtccggaaatgttacagatcgagacagaaaatctctccctgactttaaatctcaatctgtaacacataggaccaatttccccctcttgctgttacagatcgagacaaacggagaggccggctggcaaacgtctcgatctgtaacatctggaacccagttcttctgtttaccgttacagattgagacaaatctcggacaccaaaggtggcagacgaggttgtcgacgttgccgaatctcccctcccctgccgttggcgggtgttgcggggctgttcgccgcattgccgctgcactgggggtgtgcagaccgtaggatagtcctattgacagcctgtcaactcgtcagggaggcaccgtggcagaaacgtttgatatcgcgattgtgggcgcgggcatcacgggatgcgccatcgcacggcaactcgcgcggtttgacctgtccatttgcgtggtcgaggcggccaacgacatcgcgctgggggcttcgaaggccaacggcggcctggtgcacgccggctacgatccggcaccgggcaccgtaaaggcgcaggtcaacgcccgcggctgcgagttgtatggcacctggtcccaggagctgggctttctgttctgccgcaccgggtcgatggtgttgggctttaacgacgaggaccgcacgcatctggagcagctacggcgcaacggccatgtcaacggtgtgcccgagctgtcgatcgtcggacccgaccgcatccacgaattggagccgcgcgccagtgccgatgcgacgtgcgcgttgtggtgcccctcgactgggcttgtcgacccgtttgaggttgccatcgccgcgctggagaacgccgtggcgaacggggtgacgtttatgcgctccgcaccggtggaggcaattgaagtcgcgggctcgggcgacgacgcgcgcttcacactggcgacccccgttggcaacgtgcgctgccgctatctgataaacgccgcgggcaacggcgccgccgacatctcgcatatggcgggcgccgagaagttccatatggtctggcgtcagggcaacatcgtgctgctggacaaggaaccgcgcacgctcatgccgctctaccccgtgccgacgccggtgtcgaagggtgttatcgtcacgggcaccgtgcacggcaacaccgtgatcaccgccacggctgccgtgcgcgaggcgggcgacacgcagacctatgcgagcgatgtgaacgcgctgctgaccggcgcgcgcaaactggtgcccgatctggacacgcgccgcgtggtgcgcgcatttgccggcgggcgtccagtcattcaaggaacgaacgacttctttattggacagtcggccgtggtgccggggcttttccaggcggcgggcattcagtcgccgggcgtggcgagcgcgccggccattgccgagcgcatggagtacgtgatacgcaaggcgggcgttgctttgcgcgagcgggccgattgggatccgattcgccgtgcgccggacgactttgaccgtacaccgcttgcgcgcaaggaagagctcattgagtccgaccccgcgtgggggcagatcgtctgccgctgcgagacggtgcccgaggccgagatcgtggccgcgatccgacgccgcccgggcgcggtttcggtcgagggcgtcaagcgccgctgccgtgccggcatgggtcggtgccagagcggcttttgccagagccgcgtggcggcgatcctagcccgcgagctggggtgtgaccctagcgaggtgctgctggagcacactggctcgtggctcgttgagggacctttgaagggggtgcgctaggatggcggaattcaaatcgagcgtgattgataccgatgccgttgaggcagtacctacgcaggccttcgacgtggtcgtcatcggaggcggacccgccggcatggcggccgcgcttgccgcgcataaggccgacgcgcgcgtggccatcgtggagcgcgagcaacacttgggcggaatcctccgccagtgcattcaccccggctttgggctgtcgcactttaagcaggagctcaccggtcccgagtacgcgcagcgctttatcgaccaggtgcacgcaaccgacattgcgctgttcctggacagcatggtgattgggattgattcaggcgagtccacggaagatgccgcggtccacagcgtcacgctcatgagccccaccggcatgttgcagctcaccgggcgcgcggtcgtccttgccatgggttgtcgcgagcgcacccgcagcgagatcaagattcccggcagccgacccgccggcgtgtttacggccggcctggcgcagcgatacatcaatatcgagaacctcaagcccggctcacgcgccgtcattttgggctcgggcgacatcgggctcatcatggcgcgccgctgcacgctcgaggggatttcggtcgagggcgtgtacgaactcatgccgtacgccaacggcttgcgtcgcaatgtgaaaaactgcctagatgacttcggcattccgctgcatctgtctaccacggtcacgcgcgtgatcgggcacgaccgcgttgaagccgtcgaagtgagccaggtcgatgagcatctggcgcccattccggggaccgagcgcgttgttccgtgcgacacgctactgctttcggtgggcctgattcccgaaaatgagctttcggttgccgcaggcgtggagctggacccacgtacgcgcggcgccgtagtggaccagagtctgcagacgggcgtgccgggcatatttgcctgcggcaacgtgctccatgtgcacgacctggcagacaatgtgacgaccgagtccgaacgcgccggtgcggctgcggcggcgtacgcgttgggctgtggtgctggggccgatgcggacgctgcgggcccgggctgtgaactcacggtctcccccgccggcatcgcaggctacgcactgccaggccgcattacgaccgtcgggctcactaagctcaacttccgtgtacgccgaccggtcgacaccgcccgcgtgcgcattcttgcaggcgacaaggagctgtttgcaggaaaggtccgcccgtttaaaccgagcgtaatggaaagcttcccgctgccggcaaaagtgattcagcgcgcactcgacctgggtgttagcgagattgtcctatccgtcgatcccgtagaggaggcgtaggaccatgagcacgaatgtgaccgagacgttgcagttcaactgcaccacctgcccatccgagtgcctcctgaccgtaaaggtcgagcgcagcgcagacggcgccgtggtagaggtgcactccgtaaccggcaacagctgcccgcgcggctacaagttcgcacaccaggaactcacctgtcccatgcgcgtgttcaccaccaccgtggccgtatccagcggcgacgaggctctgttgcctgtgcgcacggccgaagccatcccgctggcactccacgcccaagccatggacctcatccgcggcctaaccgtcgacgcccccatccgcatgggcgacgtcgtgctaaagaacctcctagacaccaacatcaacctcatcgccagcatggacatcgacccagcctaagcagctaattgaggacggggctcttttagctaccccgccatccaccccgccctcctccgcagttgcggtgaaatagttcctgatttccgccaagaccccggcatccaggaactattccaccgcaactatccttggaattggtatttagcctatgcctactttagtgccatttcaaaactatgccggattacggggctaaatcgagaacccctatccataccggcaaattctgagttttgacaagccctctacctgcggttttatttttgccatttcgttcatggacagccaagtgcaatccaaccccgtaatccgtcatagttttgaaaacatgctaattcggcacaaggctttttgactacttttgctgctacgtccattcccccacctgagttgcggtgaaatacggactgtttaccggcctggagtcgctcaacagtccgtatttcaccgcaactcatgagagtacgtatgggataccatggtggcaccctagcgaaaggacgatgtatggcacatgtcgatgaccagcgtgtggcgcgcgtgctcgatgcgctcgaggctcagcaccccggcgcacagctgcttgtgaatgacccgtggtcgatttattacctgaccggcttttatgccgatatgttcgagcgattttgcggcgtgctgctcgcacgcgactgcgagcccgtgatcttggtcaacgcgctgcaccagctcaccgagtacgacaatgcccgcgtcgcctatcacaccgataccgacgtcgtggccgacgccatcgctcgcgaggtcgatccgaccaaaccgctcggcatcgacaccgtcatgcgctccggctttttgatgccgcttatggagcgccacgccgccagcgagtttttcctgggcgactttgccgtgacggccgcacgcacgtacaaggacgctgccgagcaggagctcatgcgcgcgtcctcggccgccaacgatgccgtgatggccgacgcaatcaagcttgtccatgagggcgtgacggagcgtgaaattgccgatcagatgctcggcctgtatcgtaagcacggctgcgagggctttagcttcccgcccatcgtgagctttggcgccaatgccggcgacccgcatcacgagcccgatgacaccgtactcaagcgcggtgacgtagtgctgttcgatattggcggacgtcgccgcaactattgctcggacatgacgcgcacgttcttttggggcgagccggacgaggaggcggcacgcatctacgacatcgttcgccgcgccaacgaggccgccgaagcgcttatcgcgccgggcgtacgcatgtgcgacctggaccgtgccgcgcgcgatgtgattgaagacgcaggctatggacagtgctttacgcatcgcctgggtcactctatcggcctgcaggaccacgagccgggcgacgtttcgctcgtcaacgagcaggttatcgagccgggaatgaccttctccatcgagccgggcatctacctccccggccgcaccggcgtccgcatcgaggacctagccctggtgaccgagtccggcgtcgagattctcaacgcctgcccccacgatccggtccgcctagactagcctggtccccaagcccccaaactaagttgcggtggaatagttcctggatgggggtgcggacagaaagttggaccgtgaagcggtccggactggaggttcgcatgcgacacgcataaaaagcctcccatttctcgtgtccaagaaatgggaggcagttcacgctgggcgagaggggggcctttctttgtgctgggggtgtctgaccggtcgtttgtctcgatctgtaacgggtagggccgatttcggacgctaggtgttacagatcgagacggttccgccgagctaaccatttcatctaaatctgtaacaccaaaggcgaatttcagttgctagatgttacagattgagataaacccaaggggaggggccggtatgtctcaatctgtaacagctggggccgtttttaccgagtagctgttacagatcgagattgtttggtagagtcgggtcacagggtaacgtgcgggcacaaaaaacggagccgtgttgccacgactctgtttctcaagaggatgggtaagggaagcgaaattagttcaggtgccagatctcgtcgttgtactgggagatggtgcggtcggacgagaaggcgccggcgttggcgatattgatgagcgccttgcgcatccaggcgtcctggtcctcgtagtcggccaacacgcgctccttggtctggatgtactcctcgatgtcgagcagggccataaaccagtccttgcccttaatgtcgtcgtgcaggcgctgcaggcgctcggcgttgccggtcgccataaaggcggggttggtgatgaagtccaccagcagtttaatgccgggcttgcggtaaagtgcaccggcgctgtaggtgccgtcggcatagagctgctcgacctgcttggacgaggcaccaaaggtatagatattctcgtcgcccacgagctcggcaatctccacgttggcgccgtcgagcgtgcacagggttagggcgccgttgagcatgaacttcatgttggaggtgccgctcgcctccttggaggccaggctgatctgctcggagatatcagcggcggggatcacgcgctcggcggcggtgacgttgtagttctcgatcatgacgacctgcaggtagggagccacgtcggggtcgtttgcaatccactgcgacagcgtcaagatcagatggatgatgtcctgcgcgatagtgtaggcaggcgccgccttgccgccaaagatgatggtgacggggtgcttaggtctgttgccgttcttgatatcgaggtacttccagatgatgtagagcgcgagcatctgctgacgcttgtactcgtggatgcgcttgacctggacgtcgatgatggcgttggagggaatggtcacgccctgctcgagcgccatgaactggcgcatgatggccttggcttcgaccttggtggcggccaggcgctcaagaacgtccttgtcgtcggcgaacttggcgagtttgctcagatcgccggtgctgcgccagtcggtgccgatcacatcgtcgagcaggctggcgagcgcggggttggccccatggatccagcggcggaaggtgatgccgttggtcttgttggagaacttcttgggatagatctcgtagaacggatgaagctcggtgtcctccaggatcttggtgtggagggcggctacgccgttgatggagaagccaaagtggatgtccatgtgggccatgtggacggtatcgtgttcgtcgatgatggcgacgcgcgggtcatcgtgctcggccttcgcgatctcatcgagcttgacgataatgtcggcgatggcaggggagaccttctgcaggctggcgagcggccacttctcgagcgcctcggcaagaatcgtgtggttagtgtaggcgaccatggagcgtacgatggtcacagcctcgtcaaactcgatgccatgttcggtggtgagcaagcgaatgagctcggggatgaccatggtggggtgcgtgtcgttaatttggaccacggcgtagtcggccagatcgtgcaggttgctgccgcgctcgacggcctcgtcgatcaggagctgggcggcgttgctcaccatgaagtactcctgatagatgcgaagtaggcggccctgctcgtcggaatcgtcggggtagaggaacaaggtgaggttcttggcgatctcggtcttgtcgaagtcgatggagctgccggggaccaggccgtcgtcgacgctcgccaggtcgaacaggcgcaggcggttcttggtgggctggccgtaaccgggcacatcgatgttgacgagcttggaagtaacggcaaaatcgccgaactcgacggtgtaggagcggtcatcgtcgactaggatgtcctgctcaccgagccactcgtcggggacggccttctgctggttgtcgacaaagcgctgacggaacagaccgtagtgatagttgaggcccacgccatcgccggtcaagcccagcgtggcgatggaatccaggaagcacgcggccaggcggcccaggccgccgttgccgagcgacggctcgacctcgaactcctcgatcttgttgaggtcgtggcctgcggcggtgagctggtccttaacctcgtcgtagatgccaaggtcgatcatgttgttgatgagcagcttgccgatcaaaaattcggcggaaatgtaatagagctttttcttgccgttgttgagcgggcaggcggcggagcgctcctgcacgagtttgaccagcagcttgtaaatgcgacggtcgtcgagctgctcgagcgaggtgccaaaagactgctcggcgagttccatgaggttaatttggggcatgttttctcctgtgatgggttgtttcatgtctgcaattcataagaagcccgcgcgaggggattggggtggcctcgcgcgggaaaagcaagcgcgtccgcacggtggggaggggtcgggcgcggtagctcctattgaggaagctcgatttcggcttccgacgggatgcggaagtaggtctcggtccagtcggtgagtttgtgctcgagctcgcgggtgatggcgccgtcgagcatgcgccaggtccagttgccgcccagcgtggcaggggtgttgatgcgcgcctcgttgcccaagttgagcaggtcctgcatggtgtagatgcacgtgtcgctcacactggcggcgatggtgcggttgagtgcgtctgccatgggttcgccggcctgctgatgggtgtacagggctgcctgctcgcgctgacgcggggtggccgttccctcaaaccaaccgcgcgctgtctcgttgtcgtgggtgcccacataggcgacggtgttggcgatgtagttatgcggcaggtagtacgagttggtgccctcaaaggcaaactgcaggatcttcatgccggggaagcccgagttgtcgcgcatgttgatgacgccgggggtgaggaagcccaggtcctcggcgatgatgggcagcgtgccgagcttttcctcgagcgtcttgaagaacttgaggccgggaccctgcgtccacgaaccgtaggacgaatcgggcgaggagaacggcacctcccaataggcctcgaagccgcggaagtgatccaggcggatgacgtcgtacatgtcgagggcggcgcgaatgcggccctcccaccaggagaaaccgtcggactccatggcgtcccagtcgtagatggggttgccccagtactggccggtggccgagaactggtcgggcggcgtgccggcgacgctcacgggattgccggcggcgtcgatcttaaagagctcaggcgtcgcccacatctcgacggagtcacgcgagacatagatgggcaggtcgccgatgatgagaatgtcgcgctcgttggcataggccttgaggcggctccactggcgatcgaagaagtactgtgtcatctggtggtagagcatacgcgccggatggtcggcgcagaccttggcggaagcctcgccgcgggtgcggagctccgcgggccactcccaaaatgccttgagaccgcactcctctttgacggtcatgaactcacagtaggggatgagccagtcctcgttggcctggataaagtcatcgaaatcggccggcttgtcggcggcaaagcgctcggcggcgcggtcgagaatctgacggcggccgccaaagatagcaccgtagtcgacattgctggggtcggatcccagatagacgccatcgatatcgcgctgctccagataccctgcctcgataagctcggcaaagtcgataaagttggggttgcctgcgcgggccgagaacgactgatagggcgaatcgccatagctggtcgtcgtaaggggcagaatctgccagtaatgttgtttgcacgaggcgagaaaatcgacgaagtcgtaggcattccagccaaagccgccgattccgtatggtccgggcagagatgagacgggcatgaggacgccgcttgcacgctccatgaatgcgctcaccaaccttcttgttgtggggtcggcctgccgatgggtgtgcagtccgcctccgatgttctgattcgatacgcctattgtaaaacatgttgtttaaacatgtacaggcaagataaaaaagttggtcgattttcggcgaatggttacatgccatgaaaaagccccgacctcacaacgtgagatcggggcaagagcggtatgtaggttttttgctactcggcgtcggcgaagccgttggggttgtggctctgccagttccagctatcgcggcacatgtccgcgatgtcgtactgggccttccagcccatcatgcgctcggccttggaggcatcgcaccagttggcagcgatgtcgccggcgcggcgctcgcggatcacgtagggcagctccttgccacaagccttggagaaggcggcgacgacctcgagtaccgaggtgccggtgccggtgcccaggttaaagatctcgacgccggtcttgccgttcatccagttaagggcggcaacgtgaccagaggccagatcgcacacgtggatgtagtcgcgcacgccggtgccgtcgggggtggggtaatcgttgccaaagacctgaacggcctcgagcttgcccacggcaacctgggcgacatagggcaccaggttgttggggatgcccttggggtcctcgccgatcaggcctgacggatgagcgccgatggggttgaagtaacggagcagcacgacgtcccactcggggtcggcggtgtggacgtccataaggatctgctcgatcatccacttggtccaaccataggggttggtcgcgggcttcttaggatcctcctcggtgacgggcgggttgtccgggtcgccgtagacggtcgaggagctcgagaagatgatggacttgcagccatggttgcgcatgacgtcgatgagcaccagggtgttctcgatgttgttgtggtagtactcgacgggcttgctcaccgactcgccgacggccttaaagccggcaaagtggatgacgcggtcgatctgatgggtatcgaagatcttgttcatcgcatcgcggtcgagcacgttggcctcgtagaaggtgaggttcttggcggcctcgtcgcccacgatggccttgacgcggtcgacggcgacggcgctggagttggagagatcatcgacgatgacgacctggtagccaccctcgagcagctgaacgacggtgtgcgagccgataaagccggcgccaccggtaacgaggacgcaggtgtctttggggtcgagtgctttggacatgtagtctcctatcgaatcaggaacacttcttcaggggagtatagcgcaggcagggacgcccaaatcgtgcgctgtaggaaaagcagaggattgtgctaacgtactcatagaagagcttgcgtacgcataacctgatctttggcatttgcttacgagccgctgaccttgcagtttcctgccgttcgtggaaatcgttgggacgcgccatatgtacgctaatatgtatgagttgagcgacatataaataagcatgtaacggagtacatatgtcaccaaacagcgattccatcctttcccaggagttctcgcgccgcactgccctcaaggccctgttcggcgccgcttctgcggcagttctttttggcctgcccgctcgcgcccatgcggcggaggcttccaaagaaaccaccgataaactgaatgccgcccaggcccagctcgacgaggttcaggcccagctcgacagcatcgcaaatgagtatgcggcgctggccaacaagaatgcccagaccctcaacgacatcgagaatgtccagggcaagattgacgacacgcaggcccagatcgatgaaaagaaggccgagctcaagaagaagcgcaacgacctttccgatcgcgtggccgccagctacaagtccggcggcacgaacatcctgtcgctgctgctggcctctggctcgtttgaggaactcgtcgccaacgcgcattacgttgagaagatcaacaagagcgaccgcgacgccatcgaggacattcagaccatccaggaagagctcgatgcgcaaaagaccgagctcgagtcgcagaaggccgacttagagaagctcaaggaccagcagactgcccagatgcaggacatgcaggccaagcagcaagaagtccagaccgtgctgaacggtctttccgacgacgtcaaggagctcatggctcagcgcgattccgagatcctcgctgctgcccaggctgaggaggccgctaggaaggctgccgctgccgcggctgccgcgaacaagaacaattcctactcgggtggttcgagctcgggtggtggatcgtacgcgcccggaactccgcagcagaatgccggctcgggcaagcagcaggctgtcgtcaacgcgtgctactccacgccttcgccgggtcagaactggtgcgcggcgtgggttaccaatgtcttccgtaacgccggcgttggctactttggcggcaacgcctgcgacatgttcaacgcctggtgctatagctccgaccgctcggcgctgcaggtgggcatgatcgtggccgattcctcgcacagcggcacgggtgctccgggccttatctacggtcatgtgggtatctacgttggcggcggcatcgttatgagcaacgagggcgccattacgtctaagtcgcttgactcgtttattagcttctatggcactggctctggcgtgcgttggggctggctcggcggcgtggcgctgtcgtaaagccgacggggccgcgtgcccgcccgcaatatatttgattgcctgctcgggcagtcctgcgcaagacgaaggccacattaagtggccttctttgcgtgcggaactcgcgatcaatcaaatatattgcgggcgggcacgcggccctcttgggttcggggcgggcttataggacaaaatgtgtgtccacgttgggggcatcggcgcaggtcgatgccccctcccgtctcctgcgcccctcccggaactgtccacatcagtgtagccaatccagtcgcagccccgacccgcggtcacgagcgggggctcctgtcgtttccgtgcccctggattgggtcatagtgtctgacttcgccaaaacatcggcgttgcccgaccagtcgttttggcacttagggacgttccttatgtgccggcacttggggacactccttgggctaattgccgggatagtcgttggggacgttcttgtttgactagtcatttaagaacgtccccaacgactacctcgttttcgtaaccttttcgcaacaatgcgctcttcgcgaccgtagcgcccgctcacaacgtcccctgcgctacacttagtcgcactgtggcgctgctgcgccgtgcccgaaccaagggagaccctcatgaagaacactcagctgctgctgatcaacgatatgtgcggctacggcaaggtcgcgctctccgccatgctgccggtgctgtcgcacatgggctatcgcatccacaacctgccgacggcgctggtgtccgatacgctcaactatcccaagttctacatccatgacaccaccgagtacgtgcgccagagcctcgctatctgggaggagctcgggtttgagttcgacgccatctcgaccggctttatcgtgaccgaggaagagacgcgcatcatctcggacttttgccaccgccgtgcgcaaaagggcaccaaggtgttcgtcgaccccatcatgggcgacaacggcaagctctacgccggcgtgcccgagtccacgattggtctcatgcgcagcctgctcgagtgcgccgactatgcggtgccaaactacaccgaggcgtgcctgctcaccgatgcgcccattgccgagcaaatcacgcccgatgagggccgcgctcttgtggatgacgtgcgtgccctgggcgccaagtcggtggtcattacgagcgctgtggtcgacagtgcgaacgccgttatcggttacgaccatgtggcgggggagtactttacgattcccttcgacttgatcccggtttacttcccgggcacgggcgacacgttctcggcagtgctcgtcggccgcgttatggccggttggagcctgcagcgcgcgacgagcgatgccatgcgtgtggtagcggagctcatcgagcgcaatgccgaccaggaggataagtccgccggccttcccatcgaggcctgcctggatgtgattgaccatgagtaacgccgacgagagcagtaccgaggcggcgggcgagaacaagccgctcggcgcgccgcgtggcaagcgtccgcgtattcgcattagctgcgcggaccagctgggcacatgccgctgccatcacgggcacaagccgggtgacgtcttcgacttcgaccgcgaccgcggcaagatgtgcaccatggcctgccatgtgggctttccctatatagatatcctgcgctatggcggaaccgtgcctggcaacgagcccggtacggcaaagttctgctgccccgaggtcgatacgctgaacgtctggcttgctgagatcgtcgacgagtagtcgagcgcaatgtgacaaagtgacagttcttttgtcacattcgcgggtgctgtcccttcttttttgcttataatcttaaatctctgcatttcatccgatttcaggttctaaaaattctgcgtttcatcgataatcaagcgtataaaactttgcatttcatttgatgacaccgaggggagagcctatgctgcgcaggaaaatagcggcagagctggagcgttggctgaagtctgccgagcaaaaggccttattcattacgggttctcgccagatcggcaaaagctattcgattcgcgcatttggcaaagccaaccatgcaacctacatcgagcttaacctcatggaaaatcgtcaggcaaaagatgctcttctcgaggcgcgggatgccgatgatttcatcagcagggtgacgcttctttcgggaaagtcgattgcaccaggcaaaacgctcgtgtttatcgatgaggtccaagaggcccccgacatcatgacgatggcaaagttccttgttgaggacgggaggtgccgctgggcgttttcggggtcaatgctcgggacccagttcaagggcgtcaggtcctatcccgtggggtatgtccacgagcttaggatgttcccgctcgattttgaggagttttgctgggcaaccggggtgagcgagggggctcgccaaacgatacgtgacgcgtgtatcagcgagaggcccattcctgattacattcatgacgcgatgatggcaaacttcaggacctataccgttgtcggcggaatgccggaggtcgtgcagcgtttccttgacacgcagggcgatcttgcctctgttcgtcagctacagtcagagctcaacgaacagtaccggcgggatatctccaagtatgcaagcgggcgagcccttcaggtgcagagcatctacgatcagctccctattatgctcgagggcgaaaataagcgcttcgtgctcaattccattgaccccaaggctcactacgagaagtatcagcgagattttgtatggcttgtcgatgccggcgttgctctcaaagcagatatcgtaaccgagccaaaatcgcccctgctcaagacggcacggccatcgcagttcaagctatatcaatcggatacgggcatgttgatggcgcgctaccccgttggagtcgcccaagcggcgtatcttgatagcaaggagcccaatctgggcggcatttacgaaaacgtggtggcccagcagctgactgcccaaaatcgccagctttactactatcagacaaaaaagcgtggtgaagtggactttgtggtcgatggaccggatgggacggctgttccgatcgaggttaaatcgggctcctattaccacgcgcacgctgcgctcggccatgtgcttgatacggctgaatatggcgtaaggctcgggattgttttctcgagaggcaacgttgagcgcaatggagcggttctctatttgccgctatatgcgacctgggccctttcggatgttttgggcgactcctgtgccgaggggataaagctggaggtcaagccggtctagggccagtcccggatgtgacaaagggacagcccctttgtcacattcatgagtgtggattttctcccaccgagataacgagcgtggattttctcccgtttagagcgcgctcgaacgctcaaagtgggagaaaatccacgctcgttttatgccgatggcgtggcccgtgtgcccgcgccgcccgagcgcctacagctgctcgagcatagcggtgcaaccggcgagtacatcgcggtaggtggcgtcgaaattgccggtgtaccagggatcggccacgtcgccggggcgatcggtccaatcgagcaggcgcgagatcttgccatcggggtccttcccaaagatacggtgcaggccgcaggcgttctcgtcgtccatatagacaatgtggtcccagtcgccatactccgcgcgacgcacctgacgcgcgcgatgtgcgacgacgggaatcccgacctcgcgtagtttggcaatggtgccgtggtgtggcgggttgccgatctcctcggtcgaggtcgcagcggaatcaatgacaaactcgcccgcgcgcccggcgcgccgcactaggtcggtaaacacggactcagccatcgtcgagcgacagatgttcccatggcagataaacagtacacgttgcatatgcggtttcctttcgatcgccatcatcgagctcgagtatcgcatctacgcctgcgcccttgcccgcctgcgctcccagtgagccaatttaatcgtcaccagcgtaagcacccaggccacaagcgagaacgcggcacccactgcgcctacgtgcgcaatgccaatgctgcttaccacggcgccgcccactgcggtgccaaacgagatgccgacgttaaacgccatgggctcaaccgaacttgcgagtaccatcgacttgggatggcggctgcgtgccacgtccatgaagtgcgtgatgcacgacaccgagaacaagtacatgagcagcgccaagctaaagacaaaggccagcgcgagcggcatggtgccgcccacagcaaacagcccgagtaacgccgcagcctgcagcacgaacgtcacaagcagcgccttcatgccaaagcgcgcatcgatccatccgcccaggatgttcgagatcaggcagaacacgccgtaggccatgagcgtggtactggcttcgaccgtgcccatgcccagcacctgctcaagataaggcgtcacgtagccatagaaaacgtagaccgaccccacgccaaacaaaaagatgagcatgccggtgacgatgctcggctcgcgtagcagacccgcctgctcgcgaaaggtggcgggctcgtcggtttgcccagcgcgcggcataaacatcacgagcgctccgcagatcagaacggcaaaggccagcgtgccgtacatggccacgtgccaatcgagcgtatcggccacaaacttgccgatcgaagtgacaaagaccatcgccacggaaaacgcgccgtacaccaccgagatggcaagcgaagtttgctgcggggacagcagctcggggatatacgtcacgcccacggcgagcagtgcgcccgagacggagcccaagatgatgcgcgaggcgaacagcacttgaaagttgggtgccagcgccatgaccaggttgccgagcacaaagacgatgctatagcacacgagcagctggtaacggcggaagtgccccgtgctgagcgcgagcgccggcgtcgcgatagcgtagaccagtgcgaacacgctaataagttggcctgcggtggcaagcgatacgccgagttccgtcgctaggtcgctttcgatgccgacgaccacgaactcggagcagccgagcgagaatcccaacagcacgagcagcgccaggcagagcttggtgcgtgcgggggagagcgcggcggcagttgacttactttttggcgtggttgcggcggtcaaggttgtcactccaatgtcgcatgaataagcgggattcaatccctgcaactctaacagaatgtgacaaagggacagtctctttgtcacatggagagcttgcctgtatagtcgcaatacaggcgaagatggtctcaggtacatcgcgggcgacaggagatcccatgggtatgcacacgacaaaggttgcagtgggcgagggcaagtttgcgcttgaggaggccctcgaggccccctccattcgcgctgccctcgcgatgtgacaaagggacagtccgtttgtcacattccattccttagaaacttgcaaattcttcaagtttctaaggtaacatcttataaacttgcaaaaaatgcaagtttataagatttcatgtctggccgggcgctagggagactctatggatatcgttcgccgaagccgttatcttgatcgactcattgcttttcaggataccgacctcatcaaaatcgtgacgggcatacgccgttgtggcaaatcaacgttattggacatgatgagggactatctggcgcaacagggggtgccagccgagcgtttgctgacctttaagatggaatctctagagtacacgggaattacggattatctgacgttttatcgtatggtccgggagcgcattgacggcatcgatcatccctacctgttctttgacgagctccagaatgtcgaaggttgggaaaaggcggtcaactcgctccgagtggatttgccgtgcgatatctatgtcacgggctccaatgcctttttgctaatatgagaaagccattgtcaataggcatgttcgtttgagcccggtttaaatccgtgtcgcatccgggcagacatcgaaccatttgaaatggtctaacttggatttgtttttcgcaaggccgccgagaggcggccccgagaaattccttttcctatactagaaccatatgaatcgaacggaaccgatcagctaatagttgtgaggaccggacgggctcgaagcccatttattttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggagataaatcttctagagagaaaacactttaactcgaatagagggcaggagcccgtccggtagatgtccgccaggataagtccccgcagcacccggtccccggggtcgcacccgcgtaccttgagagccgcatagcgataggagagagatggaagagtatcctcttccagactcgattcttttctgcgatttatcagacagaatgatagcaatcattcatccgatccaaacaagaagaattcacttatatatgagtgaggagcatctgatcgcgagcacagtgaagacactgtgccgcggtatgagatacccgaattgcgacatacgagcgctattcatgatatcgattaattaactttagcgacacgtggatatcccgcgggcccgatgcggtcccgcaagataccacgggcgcacggcggatgccttggcacagggagccgatgaaggacgcggcaagctgcgataatccccggcgaggagcacacatccttcgacccgggggtctccgaatgggcgaacccatgcacagcagtgtgcatatccccccgctgaacgcataggcggggggaggacaacccggggaactgaaacatctaagtacccggaggagaggaaatcaatctcgagactccccgagtagcggcgagcgaaaggggaccgatggccaaaccgtcgagcgggcatacccggcaggggttccgccgacggggttgcagggccgcgcatccgggggctgccgcccccgggcgcaggtccggctggggagcggaacggcatgggagggccggccgcagcgggtgacagccccgtacgcgaacccagaccggacggcgcgacgcggtccctgagtagggccgggcacgtgaaacccggtccgaacctgggtggaccaccatccaagcctgagtactaccctgtgaccgatagcgcaccagtaccgtgagggaaaggtgaaaagcaccccgggaggggagtgaaacagtacctgaaaccgtgcgcccacgagcagtcggagcacctttatggtgtgacggcgtgccttttgtagaatgagccagcgagtcgctggcgcggggcgaggttaaccgaaagggagccggagcgaaagcgagccttaacagggcgacttgagtcccgcgccgcggacgcgaagccgggtgagctatccgtgggcaggctgaagcgggggtaagaccccgtggagggccgaacgcacgtcggttgaaaacggcggcgatgacctgcggataggggtgaaaggccaatcaaacccggagatatctcgttctccccgaaatagctttagggctagcgtcgcgcgttcaccgccggaggtagagcaccggatggacgagggggcttcgccgcctaccgaatccaaccgaactccgaatgccggcggcccagagcgcggcagtcagagcatgtgggctaagctgtgtgctcgagagggaaacagcccggaccgcccgctaaggtccccaagttccagccgagtggcaaaggatgtgcgtccgcccagacaaccaggatgttggcttagaagcagccatccattcaaagagtgcgtaacagctcactggtcgagtggacatgcgccgacaatacacggggctaagctggacaccgaagcggcgggattttgattttcagaatcggtaggggagcttcccatgggcggagaagccggagggcgaccgacggtggagcgcatgggagtgagaatgctggcatgagtagcgagagacgagagagtaactcgtccgccgtgaacccgaggtttcctgggcaaggctaatcctcccagggtcagtcgggggctaaggcgaggccgggaggcgtagccgacgcgcagcaggcagacattcctgcaccgcgcacgcggcgctacgaccgacggggcgacggatgggggtggctcggcggggttctggacgtccccgtgatggagcgcggcccgcggaccagggaaatccggtccgcagaagggcgaggctccggacgaagcgactgagcgaagcgagtgagcccgaggtccctagaaaaacccctaggcaggcgcgtgcgcgcccgtaccgcaaaccgacacaggtgggtgggtagaacataccgaggcgatcgggtcaaccatggtcaaggaactcggcacaatggccccgtaacttcgggagaaggggtgcccgcgcgtacgtgaacggacttgctccgggagcggaggcgggccgcagtggagaggcccaagcgactgtttaccaaaaacacaggactctgcagaagccgcaaggcgacgtatagggtctgacgcctgcccggtgccggaaggtcacgcggaggagttagcgcatcgcgcgaagccccgaagccaagccccggtaaacggcggccgtaactataacggtcctaaggtagcgaaattccttgtcgggtaagttccgacctgcacgaaaggcgcaacgacttgggcgctgtctcgaccatggacccggtgaaattgcactggtcgtgaagatgcgacttacccgcggaaggacggaaagaccccgtgaaccttcactgcagcttggcattggccgctggtcccgcgtgtagaggataggcaggaggcatcgatccggaggcgccagcccccggggagccgcccttggaatactgccctcgcgcgaccggcgtcctaacccgaggccgtcaaccggctcggggaccgtgccaggcgggcagtttgactggggcggtcgcctcctaaagggtaacggaggcgcgcgaaggtccgctcgggacggtcggcaaccgtccttttgaatgcaagagtacaagcgggcttgactgcgaggcccacaagccgagcaggtgcgaaagcaggctctagtgatccggcggccccgagtgggtgggccgtcgctcaacggataaaaggtactccggggataacaggctgatcttgcccaagagtccacatcgacggcaaggtttggcacctcgatgtcggctcatcgcatcctggggctggagcaggtcccaagggtacggctgttcgccgtttaaagcggtacgcgagctgggttcagaacgtcgtgagacagttcggtccctatcctccgtgggcgcaggagaatcgatggaggctgcccccagtacgagaggaccggggtggacgcacctccggtgaaccggttgtcgaccaacggcacggccgggtagccgcgtgcggcgcggataaccgctgaaggcatctaagcgggaagccgttccagggattagttctccttccggtaagggcccaggtagactacctggtcgatagacggcaggtgcaaggacggcgacgtcctcagccgagccgcactaatcgcccgagctcttccggaaccgcacctcgcggcccgcgggactgagcgctcatgcgcggtccgggcacgaggatgcccccgagtcacatctcccctatgcgccatgcggcccccagggcacgcgagagagacacccggacaccgtaacggtgggcgccgcccaccggtcagcggccagagcatggggggcacgcccggtcccgttccgaacccggaagctaagccccatcgcgccgagagtactgcggggtcagcccgtgggaggccagggcgccgctgaccggtggacggcaccgagccgtgggcccgtgggttataccctaagagcaaaccaccctttttaagggtggttctgatttacatcagcccccagaacatgtttgagaactgtgcctgaagtatgtatttgcaggccccgaatcggtgttgcctcccggcgcattccgcagggggagcgatattttgcagcacgaagtgcgcagcaaaatatcgctcatgcccgaggacgcgccgggaggcaacaccgattcggggccggacacacggatctacctgcgcatttacaaattcgtaaacttttttgaaaaaagtgcttgcacagttctcgaatcataggttattatcttcctcgttgaacgcgcgggtccaacaaaacggaccgcgaatcaacaacatagcatgtcggagtggcggaattggcagacgcgctagcttgaggtgctagtgaccgctttttggtcatgcgggttcaagtcccgcctccgacaccatcgcatttgagaagcctcttcggaggcttttttgttaccgatagacggtggggtccacgatggaaacgcttgaacgcaacgagtgggcagacgttgcccaactagtcgagatcacgagcgatgctgtcatcatctgtgagctcgacggaaccattctgcatgtgaataatcgcttacttggtttgatgtgcgaggaacgcgccgacgtcatcggtggagatgttaaagacgtcctgtactcatccgcttttgaacgtgcgacggaacatcgtctgccatttgaaactgatggctccgagaacgaactgatgctcaagctgagtgacggctcctttatccccgtcttggttcgtgcgggctccgtgacgcctccacgcatctttgggcgccgcgcgccacgtgtcctggtggcgctccatagcatcgaagaacagtattctcacgaccgtcaactcaagcgtgcgttatcggagcttagagtggcgaacaagcgtctctctggcacgctttcggtcattatgagcactgtgggctccgatgagttacccagcctgcttgatactgttttgaaccagcttgtaggaacgctcgatgcttcgggtgccgctatctatttttctgagagcggcggttttaaacttcgcggtgtttccaaggagctgtacgacagctacctgcctgagtttttgccgtatggcgctggcattccgacgtatgttcttcgtgagtcgcgtgcctgtcgcttgtcgattcaacaggaccttgagggcgataaggccgcctccggtatgttcatggacttggacaatcgttctaagcacctgttgcgcgtgcaggatatgcctccgtaccgcagcgagatctgtcttcccgttttttacggtacgcagatccttggcgtgctggaagttggttggaaacgcccccaggcaccgctcgcctatgacgttaatgtactcgaggtcacttgcgattacttgtctatccaactggtcggcatggcatcgagtcttcgctctcgtcgcacggccgagcttggccgctcgctcaatgtcttacgtgatgagttgtttacctttctagacgattccgtcgcggctacccaggcggtatcgtccgagatctgcaatatgctcaactgccatttttgccctgttgagtatgacgccagtctggattcctacgtcatagattttgaaggcggcagtcgcgttgctttgccggacgatcccgagaagcttttcttttccacgacggcgccagcggcacgtctgggggctggccctgatggctttgaggcatctgttttggggggtacgagtgccgaggaccttaaacacgtccgtataactcgcgttgacgaatcgatgcctatgggaggctggcttagggcgcatggtctgccttgtcaaggtctctacgtcgactccggcatcgaggcggggcacccgcgctctgagggcgatggcaagcacagtagcgacgcgattgttcctgcttctgttgcgaagagcccgacgacgcgcgcgctgctgcttcgtgatggtagccaagagccgattgatgaccttgaatatgactacttggtgcacttggcgcatgactttgaactgatctacgaaggcgaatctcaaaagcgcgaggagcgccatatcgctcagacgctccagattggcatgagaaattccctgggggatgttccgggtatcgcaaccgattcggtgtacctgtcggccacgaattcggcgttggtcggaggcgatttctatacgctcattcgtcttcccgacgactgcgccgtcatgattctgggtgatgtgtctggcaaaggcattgaggccgcatcgatgtccgcgctcgtcaagacggccctgacggcatatgcctgggagggcgctggaccggcccgcatggcacgctcccttaacagcatgctcatgggcttttcgagggtcgagacgttcgtgacggcctttatcgccaagattgaccttaaggccggacgcgcaacgtattgttcggcgggccatcctccgaccatggtcatcaggccagagtcgatgccgctgggtggcggtgaggcacgtgggggagaggttgagctgcttggatgccaatcgggcgtaatcggtgcctttgagagcatggtgtacgagacaggcgtgtttacgttcgcccccggcgacatgctcttcatgtatacggatggaacgattgaggcccgcgaccgcaccggagcgttctttggcgagcagcgcttgcgcgaccttctgctttctgtttcgggggagggcgtgtcgggcatttgcggcaaggtcttgggcgagcttgaccgatttaccgaatcggcgctggacgatgacattgcattggtgtcccttgagtttttacggggtcgttcatagacgacgctgggcgggctgaatccgcacggttggggaaacgaatgcatcgagtgggcttttttgggaaccatggtcgtatgaatgagtggaatgacatagcggttttgacgccaccgggcgatatcgacatcgccacggtgcctgcgctgcgtcggcggctggatgctttgattggccgcggcgtgcgtcgtgtcgtcatcaactgtcaggctgttagctttatcgattcgacgggcttggcattcctgcttacgcgcgctcgtgagctcatgaggcgagaaggcctgctttcgctcgtcaatgcatcaggtgaagttgttcgctttttggagattgctcgtcttgtcgatatccttcatgtcgcggggccggcacgggagtctattcccgccattccggtgggggagctgcctcgctggagtaagagcgttgaggtccgtcagggtatcgagaatcttccatactaccgacatcgcatcgccgaactccttgaatcgcttccgttgcgccgtgacgagcgctacgatgtcgcattggcgtcgggggaggcgctgggtaatgcctatgaccatgcgggcggtatcgggtgcgtcctgacggttcaggcctatggcgatcgcgttgtggttgaggtgcttgatcgaggtgccggctattctatcgataaaacgagcgagccggtcgcatccgaggaacgcggccgtggtatcaagcttatgcgtatgctcgtcgataacgtggaggttgctcgtcgtacggacggcgccggcacgcgcgtgcagatggtgaagctgtttagcggagcgctggaatcgtgtgcctagccaatcgctttaacgcgtttggctactaagaacatgcggcagacaagttttttgaaaaaagtacttgcgtcttttggacaactcgcgtaaattaataacccgcaagcggacatggctcagttggtagagcacaaccttgccaaggttggggtcgcgggttcgagccccgttgtccgctccattgcatttccggaccgtttaggcggtcctttttcggcgaagtggccaagtggtaaggcagaggcctgcaaagcctttacccccggttcgaatccgggcttcgcctccaggcaacatccgggcgctccggcgcccgttttgttttacatatgcggacatggctcagttggtagagcacaaccttgccaaggttggggtcgcgggttggcccttgcggcctagtcgctatttagggcgtccaagatttggggcgcggttcacttcgacggggcggtttcctttttcgcgaaggtccccctctaagcgtcgtgcatttttaggagtattcaacataaccaagagcttcgggcgccacgataaatgccaaagaccgcgaatatccctgcaaatcaaacgctgccagcccataaccccgcccatcattcgtagaaaacatcgagaactcccgattttttgcccgagatcggtatgcagggaccttcgactgcagaatactcgcaaaaatgcacgtcgccaccgcccccacatggcgcgaagcaaagcaaaagcgcagcctaaaaggccgcgcaccatctttattcagattaatcattgcccgttgtgacatcgccgaacccgcagggcagagaacaagttccctcccggcgcactccgcaggacgcaagaagccctcgccgcacgaagtgcgcagcgagggcttcttgcatgtccgaggacgcgccgggagggaacttgttctctgcccggataggtaagacaaattacgcgacggtgtaaacccagttgtgcttgtcctcgacagcaccagactggataccagtcagggtctcgcgaagcttcttcatcacagggccgatctcggtgtatccagccgggaaggtcacggtctcgtcggcgccgtaaaccttgttgtcgatttcgccaaccggagagatgacggcagcggtgccgcacaggccgcactccacaaaggtgccggccttgacctcggcccactcgacggggcgctggtcaacggtcatgcccaggtcctgagcaacctgaacgagcgaacgacgggtgatagagggcaggatggagtcggtgtgcgactgcggaacgacgagcgtgccatcctctttcacgaacaggacgttggcgccaccggtctcctcgacataggtgcgggactcggagtcgagatacaggttctcggcatagccctcgcgatgggcctccatcgtgggcttaagggacatggcgtagttcaggccggccttgatgttgccggtgccgtgcggtgcagcacggtcatactcggaaacgcgcagcttgacgggcttgaggccgcccttaaagtacggaccgaccggggtcccgagaatgcggaacgtgtactcaggagcgggagccacgccgatcacgtcaccggagccgatcataaacggacgcacgtacagggtcgcgccggaaccgaagggcggaacccaggcggcgttggcagaaacgacctgcttgacggcctcaacgaacttgtccttgggaaacgggggcatctcgaggcgctgggcagagttatacatacgctcagcgttcatgtcgggacggaagcagacgatgctgccgtcctcggcggtgtaggccttcaggccctcaaagacctcctggcagtaatggaagataccgccgcactcggagacatgcagggtgtggtcggtggtcaggccgccctcgtcccactcgccatccttccaatgagcctcgtagctgtaatcggtcttcatgtagccaaagccgaggctaccccaatcgatatccttcttctcgacagtcatatgtcgctccttacatacacagttgcatactcgcgaacccgcacgcaaggaccgaggccgaccgcgtcgcaacgtcgcacgcccggagcgtagagccggacgggacacgcgagcagcatcaaagccgatggcacgtcgattcgcatgcacgagattgtactccccgcatgcgtctgataaaacgcttttctttaactaagtaaagtattttcatttgaccgaagcaaaaaggcccgccaccgtaagcggtgacgggcctcaactgtacggtctgcgcgctggctcgagctaggcgttctatttacccagcttggccttaaccagaccgaccacggtcgggatgatcgacacggcaacgatgccgataatcagcagctcaaagtgctcttgcacaaagggaatgccgccaaagaagtagcccagcagcgtaaagaccgtcgaccaggtaatgccgcccagcacgttaaagacgacaaagttgcgccagtgcatgccgcccatgccagcgataaagggcacaaaggtgcggataaacgggaagaagcgacccaggaagatggccaggtgaccccacttgtccaagaagtcctcggactttttgatgcgctcgggcgtcatggccttgaccttgcccgaagcgatgatcttgcggccaaagaagtgaccgatcataaagttgcactgatcgcccaaaatggcagcggcccatgcggtggccagaagcgccacgatgttaaagccgccgttgtgggcaaagaaacccgaggcgaacagcagcgaatcaccgggaaggaacgggaagaacaccacgcccgtctcgataaagatgatcaggaacacgcagccgtaggccataagcgggccggcggcgatccagctggcgatcgcggtgcgcgggtccttaagcagctcggcaataaaattgatgaaacccatgaagtaaaacctctcagttgtgggcgcggatacgtccaagttgaccagtatacggttgcggtgccccctcgtgcgcaaccccacaaaagcatgactccattaccagcaagtttgcataactgacacttgtagcgcaaagccgccaagattgtcctttttaatccctagcgaatcgctatactttattgaatcgcattgccatggcgctaagggagggcggccggtgagctttatcaataccattcgcgaggacatcaagaccgtccaggcgcaggaccccgccgcgcaaaacggtctggtcatctttctttcctatcctggcctgcacgccaagtggaaccacgtgcccgagcactggctgtgggagcacggtcatcgctcgctcgcccgcgtgctctcgcaaatcacccgccacatcaccggcgtcgagattcaccctgccgcgcagattggcaagcacttctttatcgaccacgccatgggcgtcgtcatcggcgagaccaccattgtgggcgacaactgtgtgctctaccagggcgtcacgctcggcggcaccggcaacgagaccggcaagcgtcacccaacgctcggcaacaacgtcaccgtgggcacgggcgccaaggtgctcggcaacatctgcatcggcaacaacgtcaagatcggcggcaactcggtcgtcgttaaggacgtccccgacaactgcaccgtcgtgggcgtgccgggacgcatcatcaagcgcaacggctgccgtgtgttcgaggagagtttcgacgccaagcagcatcgcgagtacatgcccgatgacgccgccgagcagtccgccctcaaccgccagggcatcaccgagaatgcccgccgcgtcaaggaactcgagcgagaggtggccgagctcaaggccctcgtcgccaagctcgtggacgaacgctaggaacgcaagcggcacaaaacgacatcggcatcaacgcaaaggcgcgccagggaatgaactgcaccccaaaacctggacggcttaaataagaactacgccgcaagggactcacgagcgggggctcctatctttttagtgccctcggattgggtcatagtgtctgtcgttgccgaaacatcggcgatgccggagtagtcattggggacgttcttaaatgactagtcagaaatgagcgtggataatctcccggttttggcctgtgtgcgggctcaaagtgggagattatccacgctcgctttaatttgcctgggctgcgatgcctatctaatcggctcggcgtcttccctgagaatcgaaagatactcttcatacccgtactgccggtatctctgtcttgactcgtcgagaggacggaggatacccaattcttcaaatgatttgacgagcgagctcgcggtactcctgccgatatcaagttgggcagcgatgaatgcggtgtcgacgatggggtgctcttcaagaatgcccaacagcctttgcccgtttgcagcggtccttccgagattttcggtaatggttgctgtggaacggttatggaggtcaacaaggttttttaaagaccctaccgagtccttcgcactctcgagaagactgttgcagaaaaactctatccattcctcgtaagtgcctctctcccttacggatgtgagttgccggtagtactcgcttcgatttttcttgaactggaacgatggatagaacaagcaagaatgaagaacgccatcattgatgagcataaatgtaatgagaagcctgcccaggcgaccgtttccgtctaggaatggatgggcagtttcaaattggtaatggacgagcgccgcccgcacaatcggatccatttcgacttgaggctcattgataaagcgttcgaggtcctggagcgtgttgctcaaatcttcaatgtttggagggacaaacgatgcggttgcaatggtgcagcctgaggggccaatccagttttgtgaggagcgcagctcgcctgggttcttctccgttccgcgcactccgtccagcaggactgcatgaacttgcctaagaagtctcgtgcacaagggcatctttttgagcagttctacgccgcggtcgacagcacggacgtaattcacgacgtctgcgacatctttatgatggagttgtgtttgcgatggactaagtaggtcgtcaaacgtgcactgggttccctcaatttgcgaagaaaggagcgcttctttgcgcacgtacattgccagatacatgtcggcgttgggaacaaagtagagcatgccttcaagctctccaagctttcgtgagcatgcggaaagcgtgcgataggtttcctcggtgaggtttagctgcctcaatgattgcaagggcgttggaaaaaacgaatagtaagccaatttccccgatagattattgcggagcgttccctggccgttctcctcgatttgcatcgcgccctccatatctttagtgccggaaactcgttattaggctaatcatatcaattctaataacgagtttaaggattaaatagttattagaattgatgtaaacaatctaatgataaaaagtcgttattacttgaccatggagctcggcttggtacaagggggtcatccaaaatgaacgtggataatctcccgtttttggctcggtgacggcctcaaagtcaaagtgggagattatccacgctcgttagttaagcgtccgaaaatccacactcgccaaacctaccaaaaagggacgggtttattttggcacgtttcggtcggtatcaggaagtgtcagggacggggcggcggcaggactcgagagcgaaaagaagtatcgggtttggtgcgcccgcttctgcccgtcccgtgcgcagacgatactcggcttatcgacccgcgatgcaaaggagatgctcgtcccgcgagcactaccgggaagggctcgcgattcgagtccccaccttagcatttgaaccatttggcactataatcaccataggcatgcgcataacgttgcgcttaatcaagaggagaaaacgtatgggtctgtttgacatgtttaagaagaaggctgagcctgccgctgctgcagctcccgcttccatctctgcttctgccggcgccgacgtgctgtgctcgcccgtcaagggcaaggtcatcaagatggccgacgtgcccgatcccgtctttggtggcgaggttctgggcaagggctgcgccgtgtggcccgaggacgacctggtctacgctccctgcgacggcaaggtgaccgtcaccatgggtcacgccgtgggtctgcagtccgatagcggcatcgaggttctggtgcacgttggcgtcgatactgtcaacatgaacggcgatggcttcgagggcttcgtcaaggccgacgacgttgtgaaggccggccagcccatactcaagatcgaccgtgccaagatcgccgctgctggttataaggactgcgtcgtggtggccgtgtccaacaccgccgagtttgccgacgtcgagctcaccgttgaggcagagtccgccgtcgccgccggtgacgccatcgttaaggtcgtccgcaagtaaactgcggcatccaaaggatgtgcaagggtggtcgggttttccggccaccttttttattgcatcgcggggaagcgttttattgcacgttgggcgggcttgcaaaccgttcggacgctaaaacgaaccgaccgcgccttcgcgttgccgagggtgttcataagtggatagtatgggcttacttattacaacgtgtgccgcgtccgggaagcgcggtgccgctcattgggaggaacaacatgaaaaagaagctgctgcttgcgcccctcatggccgtcttggttgcatgcgtggtcgtactttccggctgtggaggtccttcggttgaggagctcatcaccgaggatcttacgacacagtttgacgaggtcaagaacggtggcgacgacttcctctctggtctggaggaggcttcgggcgacgagttcgagcagctgggtatcgatcccaaggagtacgccaagacctatctcgagggctttgactacaagatcggcgacgtgacggtcgacgaggacaagggtgtcgcgaccgccgaggtctctatcacctgcaagtctatgaacaagatcgtcgaggacttctccacccagtatcaggagaaggtcgctgcgcttgatacggttccttccgatgacgagctgtacaagatggccggtcaggtcatggtcgatgtgaccaaggccaccgagcccaggaagaccacggtcatcttcaagtacacctgcaacgacgacggcgagtggtctgccgacgactccgtcaactccgagatgatggatgcaatgctgagctagttcgttgcggcgttttaccaaacgccgcaactgctcgacgctgcaagcccgccagagcggcaatctgcctttcaacttcggcggcatgaccaaaaggtcaatgccgcctcggccacggtcttcggctaccacgtggacgaccccgagcgcttcggcgtcgtggagttcgacggggagggccgtgccgtctccatcgaggagaagcccgccgagcccaagagctcctacgccgtcaccggcctgtacttctacccgggcgacgtggccgccaaggcccataaggtgaggccctccgcgcgcggcgagctcgagatcaccacgctcaaccagatgtacctggaggaggggacgctgtccgtggtgaccctcggccgcggctacgcgtggctggacaccggaaccatggagagcctgcacgaggccgcggagttcgtccgcgccgtggagcactcccaggacctgcccgtgtccgtgcccgaggagatcgcctgggagaacggctggatcacgaccgccgagctggaggaggccgcgaaggcctacggcaagtcggtctacgggcagcacctgaagaaggtcgccgccggcgagatcgtcaacagcccgcgcgagtactagcgcaagcttgttttcttttaggggtcaccgtttatctggtggcccctttcgttatgattacgttgaccataaagacaatatgattgggagtggatgtgttaagcgtctactttggcgatatgccagaagcgatttacaacacagcgacatatttcaaaaactcttaccggtcttcttggattacggatccctatgcagtctcgataattaaagatgtcgatcgatcggttgttgtctccgaaaacgtcatcgaaagccctgtgcttggatccatctccccactccagctttctggtggcgtgaaaacgctggtgcttatgagatttgatcgtaagcatatttttaacgcttctacctgtggtgacaactgtgccaagtggattctcgacatggcgaaagaccgcaagctcgttgtgaatctctatcatgtgatggactttggtcgcgaggattttaaaattaaagtcgtgaatagcggccgaatcgttcacaacatggccgatttgattcacgagtcgattccgtatctgtaggtgctgcttatgaacggttcgcatctcgttaagatttcccgccgcaggggaaccaagtacacatttaccattaaacggaacattactattgtgcgtggggatagtggcacgggtaagacgacactgtttgacatggtcgcagactacatgcgaacgggcgagcagtcgggtgtttccttgcaatgcgattgtccctgtgtcgccctgaccgattatgattggcgaaaccagctttcgtccgttcatgactcgattgtatttgtcgatgagggcttaaaagagatccattctgatgagtttgcccatcatgtgctgtattcctcgaattatttcgtgctgatctcaagggctgatttcccctatcttccgtatagcgtggatgagatttacaagattaagacgagcggaaaataccattctttcatccctgtttatcaagatcgcgggaatcatcgttatgctatttcccggtcggcgccaaaacaggacttttctatccttctatgcgaggacagtaagtctggtttccagttctttgaacggcatttcgctgacagtgagcttacctgtacttcggccatgacgaacagcgcgattttgcgctggttggatcagcatctcgacgatcgcgtgtttgttgttgcggacggagcggcatttgggtgctatgcggaccgcgtccttaagctgcaagacattcaccgcgatactgttacggtttgtcttcccgagtcgttcgaatggcttctgctgagctccggcgtaatttcagggctagatgttaagacggttttggaaaccccagaagcctttgtaaacagtgagaagtttaaaagctgggaggatttcttctataagtacttacgtgaaataactggggattcggtttttcactacgacaaagactgcattccggaggcgttttgtacggggggtaattctgcgaaggttatggctcttatcgcatgccgaaatgtccgatagttttgttgaatagtgtcgcgtcgtcacttcctgcggcatactaaagaagctgtacatgcttcagattggattttcatgtctgagatttttgaacccaagaacatcatcgtcacgggcggctgcggcttcatcggcagcaacttcgtgcactacgtggtcaacaaccaccccggggtgcacgtgaccgtcctggacaagctgacctacgccggcaaccccgagaacatcgcgggcctgccctccgaccgcgtggagctcgtcgtgggcgacatctgcgacgccgagctgctggacaggatcgtcccgggccacgacgccatcgtgcactacgccgccgagagccacaacgacaactctatcgcggaccccgagccgttcctgcgcacaaacgtcgagggaaccttccgcctgctggaggccgtccgcaaatacggcatccgctaccaccacgtctccaccgacgaggtctacggcgacctggcgctcgacgacccggcgaagttcaccgaggagacgccgtataggccctcgagcccctacagctccaccaaggcgtcctccgatatgctcgtgcgcgcctggacccgcacctacggcctgcgcgccacgatctccaactgctccaacaactacggcccctaccagcacgtggagaagttcatccccaggcagatcacgaacatcatcgacggcgtgcgccccaagctctacgggaagggcgagaacgtccgcgactggatccacaccgaggaccactcctcggccgtctgggacatcctcaccaagggccgcacgggggagacctacctcatcggcgccgacggcgagaagaacaacatcacggtcctgcgcatgatcctcgaggccatgggccgcgaccccgaggacttcgactgggtcgccgaccgccttcgaggccgagcgcaaaatggattctaaaaaacaccttgccaaataggagcgtcaggacgcaaagaggctccgcagcgcgaagcgcgatgcggagcctctttgcatgtccgaggacgttccggagagaaacccccgtcacgcccccggattcccggtgggagttctagaccttgtcggccttagtacataccgccgccctgctgaccagcggtggcagcagcgatagcgtcctcaagctgagtgttcttgggcacatcggagacggtggcctcggtgatgaggatcaggctggcgacagaagcagcgttctgcagggtgacgcggctgaccttgacggggtcgaggacgcccatctcaatcatgtcgccccactcgccgttggcagagttgagaccctggccggcgggcagctcggcaaccttgtcgaccacgacagcgccctcaaagccagcgttcttggcgatggtagcgaccggagcggtcagagccttcttgacgatatcgacgccgatcttctcctcggggtcgtcgatctcaacagcgtcgagcgcaggagcagcgtccatgaaggcgacgccgccgccagcgacaatgccctcctcgacagcagcgcgggtagcctgcagggcgtcctcgacgcgatgcttgatctccttgagctcagactcggtagcagcgccgaccttgatgacggcaacgccaccggagagcttggccaggcgctcctggagcttctcgcggtcgaagtcagaggtggtgttctccatctcgcccttgatctgagcgatacgggcgtcgatggcctccttggagccagcgccgccgacgacgacggtgttgtccttggagatggtgacggacttagcggtaccgagcatatcggcggtaatgtcagcgaccttcacgcccagctcgtccagggcagcctggccaccggtgaggacggcgatgtcctcgaggatgcgcttgcggcgatcgccgtagcccggggccttgacggcgcagacgttgagggcgccgcggatcttgttgaggaccagggtcggcagtgcctcgccgtcgatgtcctcagcgatgatgagcaggccacggccagcgcgctggacagcctcgagaacgggcataatgtcctgaacgctggagatcttctggtcggtgatgaggatgtacggatccttcatcacggcctccatgcggtcgttgtccgtgacgaagtaagcggagacatagcccttgtcgaactgcatgccctcgacggtgtcgatggtgatgtcgaacgtctgggaatcctcgacggtgatgacgccgtccttgcccacgacctccatggcctcggcgatcttctcgccgacctcggggtcaccggcggagatggtaccgacggaagcgatctgctccttggtctcgaccggcttggcctgcttcttcatctcggcgacggcggcgttgacggccttgtcgatgccgcgacgaatggccagcgggttggcgccagcggcgacgttgcgcaggccgtcgttgacgatggcctgagcgagcagggttgcggtggtggtgccgtcacccacggtgtcgttggtcttggtggcgacctccttcaccagctgggcgcccatgttctcgatgttgtcctcgagctcgatctccttggcgacggaaacgccgtcgttggtgatggtcggggcaccgaacgtgcgctgcagcgcaacgtagcgacccttggggcccatggtgacggtaacggcgtcggccagagtgttgacgcccttggcgagcttagcgcgggcatcggtgttgaacgtaatgttctttgccatggtgagtaatcctccaaaagaaatgtgactcgcgtcgccgcttccgagtcctatgcggcaggcgcgttcaaagacgaatcagagattccgacgagactaggcctcgacgacagcgtagatgtcgtcggcgcgcatcagcagatacttctcgccgtcgaccttgacctcgttgccaccgaacttaccgtagatgacaacgtcgccaaccttgacgtccatggggatgcgctcacccttgtcgttgaccttgccggcgcccacggcaacgatggtgccgcgctgcggcttctcctgagcgttgctggcgatatacagaccagaagcggtcttctgctcggcctcgtcgggcttgaccagaacacgatctgcaagcggcttcaaagacgacatgcttgtctcctcctttttgggccgcgtggttatgccacgcgaattaaccctttttgtttgcgtacgcgttgaatggtacccacgaatggcgggttatacaacacagagtcaaaaaatcttattttttggcacttagattttctgaatgccgggggataacttggcagtggctcccggggcggaccggagggcatgaagtttgctgctctacagtcctgcgcaagacggaaagcacattaagtgctttcctttgcgtgcggaactcgcgacaaacttcatgccctccggtccgccccgggagccaggttaactaattcgggcccggtattcagaaaagtcagtgcagcaaaatggcgatgcagatggagcgaacaagaaaggggcacgttgctgaaacgtgccccttaagttgcggtggaatatggactgtttttggctgttgaggtgttatttagtccgtatttcaccgcaactgaggggtgggatgtggggttaacggtagcgcgcagagatgtggtgtaagaggcggggcatgacccgcctcttcccttttgttagcgtcaatataattttcaccatttccaccaacgcattttcgccaatcgcgccaacgcggatacaccggattcgccaacgcggatgtgccgctttcggcgcctaggcgccctcctccttcccgtcctcaccgccgatggacacgtccttcaggcggtacgaccggcccgttatcttgatcatcgcgcagtggtggcacagcctgtcggcgaccgccgaggccgtgacgttgctgccgaacacgtcgccccacctgccgaccggcacgttggtcgtgacgatcgtcgaccgcttgagcgcgtagcgcctgttcaccagctggaacagcaggtcggcgccctctttcccgatatcgaggtagcccagctcgtctattatcagcaggctgcagtgctcgtagaaccgcatcctgcgcgccagcgcctccttcgccgaggcgtgcttgaggtcctcgaccagcctcgagcagtcggcgaagtacacctgcttgcgggccatcaccgcctcgtggcctatggctatcgacaggtgggtcttgccgacgcccgggctgccgacgagcacgacgttgtcgccgcggtcgacgaactcgagcgtggccagctgctcgaccagcccgcggggcacgctcggctggaaaccccagtcgaagtcggccagcgtctttatgtaggggaagttggccatcctcgtgcggcgctcgtcgtcggcgcgccgcttgagggctatctgggcgtcggtgagctcgagcatggcgtcgaccaggctcttcctcccgtcggcgacgagcctgacgtactcgggcaccgacgacgccatgccctcgagccccagctcctcgagattggccgccaggcggttgagcgggctggcctgcaccgcggcgctcacagcgagccccctatcgagtcgagcagcccgaggttggcggcggcggccgcctcgatgtcgccggcggcgtcgccgaaccagcgcttcccggccatggcctcggcgtagtgcgccgggtcgtaggccggcccgcccgccacgtgcgtcgccaccagctcgccgccgacgtagcagtccatcgcgccgccgggcatgcagacgatgcgggcgggcctgccgatgcagcgcctgggcaccgacatgggctcgccgtgcgcgctgaccagcatcgtggccggcaccctggccacgcgcaccacgtcgcccatcgcctcctcgagggcgcggaggttgccgacgggcagcagcgcgtccttctcctccatgaacagcgcggagggcggcagccccgtggtctcgttgggctcggagttgctggcgtcctcgatccgcgcgatgatctcgtcgatgtcgtcccagccgtcgaagtcgccctggtaggccgcgagccgcgacaggaagcggttcgacgactcgaccttgcccttggtctgggggctgcgcgggcggcacagcttcagctcgaagccggcggccttggcgaactcgtatgcgcgctggaccttgaggcgcctgccgcccttgaccgtcaccagggcggacatgttgtccgtgacccactcgcggggcacgccgccgagcctcgcgatcgtggcgtacatgcatctgaccaggtcgtcggtcgtcctggtccccgaccggatgaatatgtgcctgcgggaatggcccagcgtcgccgcgaacacgttgaactcgaacagctcgccgtcgcggttcgccatcctgaccgactccttccagtcgaactgcagctgcagcccgggcggcgtctcgaagcgcgggtgcggttccgggccgacggaggccccgacggcgataccgttcttgcgcatgaactgggtgaaggcgttgtagccggccaggttctcgccgggatacctgtgcagcagccactcgtggatgcccttcttggtgacccccggcagctgcgccttggcggccacctcctcgatgtgcgcgtcgaaggagcccgccctgtcggcgcgcccgtcgcggggccggccgccctcggccctccagtacgccgccacggtgtgcctgtccttgccgtagcgcttcgctatgtcgctgaagttgggctttatgcccgcttccctgtacatgtccaactctccgatcaggttcttctccgccacggccgctcctcccgaaagcatcgttcgcttgtcggtcgaagcgtaagccccggcgttggtggaaatggtgaaaatgcgttggcgtgatcggggaaattgcgttggcggaatcggctaaagtgcgatggcgaaattggttgtttttacagtagcgctaattcccggttccaccgggccgcgcggcaaggagatatattgccagaccggaggggcgccgggggcgggaatctgggcgtacacatttcctacacatctaagtactctcggctggctggttaaaaacaggaggggacctcgcatccgagatcccctctttcgcccatctatagcaatagactcttaaataccttatgccagcagcttgcgaccggactcctcgatcgcgtcaagtgctgcatctgcctcggcggcatccgcgcccttagcgaagatgtacagcttaatcttgggctcggtgccggaaggacgaacaatacccttgttgccaccctcaagatcgaactcaataacattagccttcggcaggccgttcacgcaggtgttgtaatcaacgacggcctcaatcttggaaccggcgagctccgcgggcgggttctcgcgcagaccggccatgatgccggccatctttgccgcaccctcagcacccggatagctcagcgaaatcgtcttgttgtgatagtagccatacttctcgtacagctcgtgcatcgcgtcggcaaggttctttccctggagcttgtaatactgcgccatctggcaaatcaaaagcgaagtgctcacggcgtccttgtcgcgcacgtggtcgccggccagatagccgtagctctcctcaaaaccgaagataaagcgatcgacctcgccagcatcggaaagagaagtaatgatgtcgccgatgtacttgaagcccgtcaggcaacgacggagctcaaaaccgtactcatcggccagagcgtcaaccatggcggaagaaacgatagtagtgacagcaaccttcttagtgaggtcctcaccgcgagcagcgcgggtcttgcagatatagtcgagcagcagaacgcccatctcattgccggtcagcagcagatagtcatcgctattcttaacggcaacgccaacgcgatcggcgtcaggatcggttgcaagcagcagatcagggtgaacctgctcgcacaggtcaatgcccttctgcatggcctggcgaatctcggggttaggatacgggcaggtcgggaaatcgccgttaggctccttctgctcgggaacaaccgtgacatcggtgatgccagcgcgctcgagcaccgtcgtgacgggaatgaggccggtgccgttgagcggagtgtagacgagcttaagcggagcgccagcgatctcctcggcagaaaggttggtcacgccgcgggcgagaacggcgtcataataacgctcgaggcacgagtcatcgatccatttgaccagaccctgctcaagagcctcatcgaagtccatggacttcacgccggtaaacgtatcggtctcggcgatagccttagaaattgcatcggcagcctcgctggtaatctggcagccgtcggggccataggccttatagccgttataaggcgctggattatgactagcggtcatgcaaatgccaccggagcacttaaggtcacggacggcccaggaaagcgtcggcacgggagaaatcttaggatacacgagagcagtcacgccgtttgcggcaagaatggcagccgtcgtcttaacgaacagttcacccttattgcggctatcgcgagcgatggcaaccgtcggatgctcgaaggtcgcattgagatagtcagcaaaaccctgcgtcgcgcgaccaaccgtatagatattcatacggttagtgcctgcaccgatagtgccacgtagaccggcggtaccgaaggcgagatcttggaagaaagcgtcggtgatggcgtcttcgtcaccctgctccttcatcgtgttgagctcagcgaggagctcctcgtccttgacattggcaatccaagtatcaagcagctcatgaacatctgccatgtgagtccttccgtcacaatcaataaaacaacccgtgtaaaacaggacaagcgcatcagcgcgctaaagcaaatattagtccattgagaacagagaaccggccacagaacggtgaacgtttatattcaccggtggatgattggattgatttaattgcttagtgaatgccgcctataacgcaaaaaggaggaggccgcgaggcctcccccttccaagttcaagcgtacggctcggtgccgtccaccggtcagcggcgccctggcctcccacgggctgacccttcccggttccaccgggccgcgcggcaaggagatatattgccagaccggaggggcgccgggggcgggaatctgggcgtacacatttcctacacatcttgtgatccgactaacgtttgccagccgttaactaccgctcgccgagcatctctttatataaggcagtctcatggttaaagcggatacgtccccctagctaaagcacagccagcatcgagcaactcatcacgttcttccaccgagaacccctcggcgtagacgcgcaccactggttcggtcccgctaggacggaccagcagccacgtgtcatcctcgaatgacagacgcaagccgtccatatgactaacgttttgcggcaccttgccacaaatcgacttggggtttacgcccggcagcagggttcgtaacgtttcggcatcttcggcctcaaggcgcaaatcgcgtcgaccgtaactcgtcttaccaaaactgtcctcgagttggtcgaccagaacgcccaaaggcgcgtccgtctttgccataagctcacacagaatcagacaggcgaggattccatcgcgctcgggcatatgcgcggcgatgccgataccaccggcttcttcgccgcccatgaggacgccgcccttcttcatctccgccgctatatatttgaaaccgactggtttgacggtcacgcggcagtcaagcgcctcggcaatgcgacgcacgagcgtcgagcatgaaagattgacgacgacgcgcccctccaaattacgaaattgaaccaagtcgcccaaaacgagcgccatgatctgatgcggatgtatatatctgccgcgctcgtcaaccgcgccgatacggtcggcgtcgccgtcggtcaccaggccagcgcaagctccgtcctcgataaccgtgcgctcgcaagcgtccacccacggttcaacggggtcggggcagatatcttcttggtcagacgcctgcccggcgtgaatctcgtgcacctcaacgccaagctcgcgcagcaagtcggctagatagccctgggctgcgccgcccatgggatcgacaaccacgcgcaagtgcgcggcgcggatggcttcggcatcgacaaacgatgccaccgcctgcatatagtcaggaatgatatccgcggtgcgatattgcccctcgatccccattggctcgggagccatagtctcttcgagctcttcgatgacatcctggttggcggtcgagccgtcacccatgcgaatcttgaggcacagatagccctgcggatgatgggaccccgtcaccatgagcgcgccgcacgcttcaccgtcataagccgccgcccacgtaagggcaggggtcgggacaggtcgcgaagcgagcacggcgtctagcccgtgcgctgctagcacgcccgccgcaagctcagcgaactcgcgcgccaggggccgggtgtcgaaccctatatataccgttttgcccggattggtcttttgccataactcgccgacggcatcggcgatacgggcaacgttatcggcagtgaagtcctcatcgacgcgagcgcgccaaccgtcagttccaaaatgaattatcgcgcacacgcgcagacacctcacagtgtttggatcatggtacgcatggggtatacccgcaacatgcactcggcaacctgccggcaccagcattcaccatttgggcaaatgctgccgaggacatgcaagcaatcagaaccacccttaaaaagggtggtttgctcttagggtataacccacgggcccgcgacagggcagtgtgggaggacctccaccacagggacccgtacccgttctggctggattaatggatggaaacggatgttctatcgggacacacattttgtcctataagccgagccttcgcaatgaaaatggtgccgccacttttaagcttgttgccgatattgagtacaacgatgaggtagggctcgtacaaaacaacgagcaccccgtcgtcaatatcatcttggatttaaacggtcacaagcttaagcacttgagtaatagcaattcattattcgatgttgccaacggcgcgacacttacaattaaggattctgtgtatacggaggaaaaggtcagtaacggccagcagctaaatgatcagggacagaaattaactcgcgccaattatggcaaggaagccaaactgtcttacgacaacgatggcattccgacttacctttcctactatgtgaccgaatcgtccccagaaggaacgggcacaaccgagtcgcttgtagagcatggtgttgatattaaaggtaaaggcgatattaaaggtaaaggcgccattgtggcttgcgacggttcaagaggactgaagctcatcaacatccatgacggcggtcatttcagtcttgagagcggcgtgctcacgcaaaagaaagacagcagtgtccgaaacctggtgtacgcggggagcggctcgaccgtcaatatgaagggcggttatgtttgcggaggttattgtccggacggtgctgccggcgcaggaatatctgtcgaaaattcgactcttagcatttctaacggcgtaattgccggcaaccgcgctcctagtggcggcggtgtatatgccaatgggtctgcagtcacggtgaccggcggcgtaatctccggtaatagcacgcttgatggcatgaacggatttggtggcggcatcatggccgaaggcggcagcgttactgtttccggcggttacattacgaacaattgctatgccaaattctgcggcacggatggcaacggtgaccatggcggcgctgggcttgctgccaagaacggtacccatgtcaccatttccggtggccagattactggcaattattctaaagaagccggtggcggcgtttacgttaccgatcaatggcgagacggttctcgcaaggatatggcatggctcaacattacgggaggaattattgcctctaacgtgagctaccgatctgaaggtgccggcatccgagtgggccagaaggttgacgcgatgattaacggccctaaagaaagtaacggcactaaagaaagtatagtctacatcacaaacaatcactgcatgtctcgcttcgactggggcggcggcggcatctttgttcagggcgattcaaacactgcatctaatgcgggtaggctatttgtctataactcctatataagcagtaatgaggccggtggctatggtggtggcgttgcggtttgcccgacgggtaagactttggtgacaaacaccgacggcacggcgatttttggcaatagagccgctgacgcgagcaagcaatagggggtgcggacagaaagttggaccgtgaagcggtccggactggaggttcgagacgatatgagaaagccattggggtcgcctcccccgcgttgcagtttctttccgcgggctcggggtgccacaatgggctttgagtatcggcccgtgcggtagcccttaccgcacctgcggggaggaggcttcccatgccccatgttacctccatcggcctggacgtccacgcgcgatcggtcgccgccgcggcgttcaaccccttcaccggcgaggtggtgcaccgcgacttcggcaccgacgccgccgagatcgcggagtgggccctcgggttcgaggagcccagggcctgctacgagagcggtcccaccgggttccacatggcgcgcgagctgcgcgccctcggcctcgactgcgccgtggccgccgtctcgaaaatgcagaggccggcggcggacgcgcaccgcaagaacgaccggcgcgacgccgagttcatcgcccgcatgctcgccacccacaacatcgtcgaggtcccgctgccggacgcggccgtcgaggccgcccgcgacctcgaccgcgccctcgacgacgccaccgttgagtaccgccgcgccaggcagcgcctcaacatgttcctgattaggctgggatacgtctgggacgagcgcaacgccgacgggacgaggaagaaggcctggacgcgcgcccactggaggtggatatccgagatcaggctcgagggcccgcagcgcgacgcgctcgagtactacgtcacggccgcccgctgcgcggaatcggacaggcggcagctcgagaggagggtcgtcgcgctggccggcgccgaccggtggcgcccggccgtggaggcgctctcctgcatcaaggggatcgacaccctgacggccttcaggctcgcggcggaggccgggtccttcagcaggttccgctcggcaccggccttcgcgagctggtgcgggctcacgccgtcggagcactcgagcggcgagtccgagcggcgcggcgggataaccaaggccggcaacgcgctcgcgcgcacggcgctcatagagtccgcatggcactattccatgtgctccccgaggcccaaggcccccgcccccggcaccgacgtgcccacggcggtacgctcgagggcggacgactgcaccgccaggctccaccgccgccgcgaggcgctcgcgcgcgccggcaagccggcctgcaaggccaacgccgccgtggcgcgcgagctcgcctgctgggtctgggagatcgggtgcaggtccgaagggaccatcctctagcggccggcgacaaccgactcccgccgagagggcccgcgcctcgacgcatcgccggcgcgagttcacggcctcttttatgggcagcccccgggccgcgcccgacaaaagactggattcgcacgatcgcgccggacggagaatcgaaatgcggtggggtgcgcggacataccgggctgaccgccggcagcgcacccgaaagagcccgcggatattagcttgccaggcaagcgtcgactaaacgtgcagcgtgcgcgggccctcccgacgggaaacgaaaaagcccggatttaaaccgggctcaaacgaacatgcctattgacaatggctttctcatattaggtagcgcgcagagatgtggtgtaagaggcggggcatgacccgcctcttccctttcttgaaagggaggggacaccgcctagaattcgtcgttggagtaatgaaggtgacgaatggaaggaaaggcgatgccccaagaagagagtgtactgcgcctcggccgcgacgaggccctcgaggcggcgaggctttggcaggagtgcggcgacgcgcgcgagttcgcgtgtagggtgctgggcggcgtgatgaacgcgctgatggactccgaggcccagcagatgtgcggcgcgggccgtaacgagcgcagcgacggcagggagaacagccgcaacggctaccgccccaggtcgctcaagaccgccgtgggcgacgtggagctcgagatacccaagctcaggcacggcacctactaccccgagggcatgctcgcgcgatggtcgcgcgtcgacacctcggtggccgccctcgtgcaggagatgtacgtgtgcggcgtgtccacccgcaaggtcgagcgcgtggcgtccaagctgggcatatcctcgctgtcgagctcggaggtctcgagcctctgctccgacctcgacgccgaggtggcggagttccgccgccgcgacctttcgggcacgccgtgctgctacctgtggctcgacgccacctacatgagctgcagggtcggctcgtcggtcgtctcgcagggcgtcgtgaccgcgatcgggctgggcgccgacgggcgcaagcacttcctgggctgcgacgtggtcgacaccgagagcgaggactcctgggcggcattcctcggcgggctgcgcgagcgcgggctggccggcgttcgcctcgtggtctccgacagccacgccgggctcgtggccgccgtctcgcgcctgttccagggctgcgcctggcagcgctgcgtgacgcacctgcagcgcaacctccagagcgcctgctcgggcaggcccgaggactccaaggcggccgtcagggacctcgtgcacgccgcggtctaccaggacgaccccgacctcgcgcgctgcgtgtgggccgaggcggcgccctgggtggcgtcggtgtccgccagggccggcgaggtcttcgagcaggccgaggactccgcgctggcgttcacggccttccccagggcgcactgggccaagctccgcaccaacaacgtccaggagcgcgccaaccgcgagatcaagcgccgctacagggtcgtgcagtccttcccctcgagggagtcgatgctgcgtctgacgtgcgcgagcctcatggagaccgaggggcagtggtcccagcagcgcgtgttctccgaggcctcggccgccgagggcttcgccgagcccgcggacaggccggccccgacagaggggaggcgccgcgcgctcgggcggcgcgccagggagatagtggacgagatagtcgagaagcgcggcctcaagaaggagtaacatcggggcttgcagcgacggacctcaggacactcttacaccacgtctgcgcgcgccaccgtgaactgcctcccatttcttggacacgagaaatgggaggctttttatgcgtgtcgacttgagggtgaagcacgacatcgaggccaggaaggcggcgatcgggctcttcgagcgaggccacggttacaaatcggcggcgaaggcgctgtcggtcccgctcggcaccgtgagacaatggctctacgtataccggtcgttcggaagcgaggtgctgctgcgcatggacggaaagcagggcaggtacacatacgagcagaaggtcgccgccgcctccgccgtcgtcgacggcggcatgacgaaggccgaggcgatggcggcgttcggcataatgtcgatgtcgccgctcaagaagtggtgcgcgctatacagccggggcggcgcggaggccctgcgcccgaggcccaagggccggccgagcggttccagggcgaggccgcgcacccgcgagcaggagctcgaggagcgctgccgaaggctcgaggccgaggtggcctacctaaaaaaattgcgtgccctggtcgagagggacgggctctgaccagggcgaaggccgaagcggtcgcggccctgcgcgccgaggggcacgcgctcgggcacctgctcgcatgcgccgagctcaagcggtcgacctactactacgccctcgcgcacccgccgaggcccacgcgcgccgagctctgggaggcggccgccgagatcttctcgcgcaccgccaacggctgcgggcaccggcagatagcgatgtgcctcagggcggaagagggggccgtgatagccaacaagaccgtgctcaagatgatgcgcgagatggggattcgctgcggcatcagacgcgagacggcctaccacaggtacaactcgtacaagggcgtcgtcggcagaacgttcgagaacgtgatcgcgagggatttcgacgccggggccccgtggcagaagctggggacggacgtcaccgagttcaaggtggctggcggtaaggcctactgggccccgacgctggacttctgcaccaaggagatcgtggcgagcgacatatcgaccacgcccgacatggcccagcaggcgaggatgctcgacgagctgctgtccaagatccccgagggcgccgccccgaccatgcactcggaccggggctggcagtaccagcacgcctcatacacatccaggctcgaggccgccggtatcgtccagagcatgtccaggaaggcgaactgcatcgacaatgccgccaccgagcagctcttcggccacgtcaaggacgagttctacaggggccgcgagtggaagacgttcgaggatttcaaacgcgacctggaggaatacatagtccactggaacacgagccggaggcaggtaagattgaagggcctgaccccggaggagtaccggaatcaggcccttgcggcctagtcgctatttagggcgtccaagatttggggcgcggttcactggattggcaacacctatttggacgattccgggagggacagccccgcctccctgaactcgaccggagacatgtagcccagcgtcgagtggatcctgaagttgttgtaccagtgcacgtagtccgagagcttggcccggagctcgcgcgtcgtgccgaacgtctcgcggtggacgagctcggccttcagtatcctgttggtcgactcgtcgacggcgttgtcgtaggggcagcccttggccgacagcgacctctcaatgccgaaggcctcgagcatcaggtcgatctcggcgttgtcgaactcgctgccgcggtccgtgtggaagacctcgatgtccgagatggggaaggagagcgtcgcgaacgccgacttgaccagccgggcgtccttcctgggcccggcggagtggccgacgatctccctgttgtagaggtcgacgagcaggcagacgtagttccacgaggccccgacgcgcacgtaggtcaggtcgctgcatatatgggtgcgcggcgccctgccgccgaagccgcgcgcgacgacgttgggcacgtcggcctcgttgaccgccccggggtgcaccttgaacctcttcctgccgtatgcgctgaccaggccgttctccctcatgatgcggcagacccggcgccggctgacggtgacgcccgacctctcgagcgacgcctttatcttgcgcgagccgtaccggcccttgctggcggcgtgggccgcgaccacggccggcgcggcggggtccggcgcggcgggccggtcggcccgcgagcgcatggagtagtacgtcgacctcgcgacgccgaggagcctgcactgcgctgatatggggtagcggccctcgttggccgctatggccctcactttcgagcgtatatcagcgccgcttgttttaagacgtcgacctccatccggagcctgcggttctcgcgctcgagctccaggatccggttctgctcgggcgtgcggttgcacgcggcgcgcggcgagccggtcgcgtttatcgacttgatccacctctccacggtgctcttgccgaggtcgtactcgtccatgatctcgcgcttgggcttgccggcgttgtagaggtcgactatctgcctcttgaactcgtcggtgaaatgcctcgggtgcctggggtccctcatatacggccctcccgtctcctgcgcccctcccggaactgtccacatcagtgtagccaatccaacagacactatgacccaatccgagggcactaaaaagataggagcccccgctcgtggccgcgggtcggggctgcgacaatgatgttgaagtgccataggcgcagccgcgccgcaacgaggttgggaggctcccatgccaaagtattctaccgcgttcgggatggacgtccacctgaggtcgaccaccgtctgcgccctcgacgcggacaccggcgaggccgtgacgaggaggttccccggcaacccctggggcgagatcgccgggtggatggatgggttccccgggccgtcgctcgcggcctacgagagcggctacctcggcttcgccccgcaaagggagctcgccgggctcggcgtcgagtgcgtcgtcgccgcggtctcgaagatccccaggtcggccgccgactcggcctccaagaacgacaggaacgacgccgccaggatggccaaggcgatactcgcccacgacatctcccccgtatgggtcccctcccccgaggtcgaaggcatcagggacctcgccggcgcctacgacggggcgaccgcgcgcctggcgaccgccaagcagcggctgctcgccttcctcgcaaagcgggggttcgtctacggcggcaccacgcccgccggcaacccgaggaagtactggacctacgacttcctgaggtggctcgacaaggtcaggccggaggacgatggcggggttcggacgctcgccgccctgaggaacgaggtcgaggccgcggcggaggcccgggcggacctgctctccgagtacagggccgccgtggatgccagcccgatcgccgcggaggtggccgccctccagtcgatcaagggctgcgccttcgcgctggccgcagccttctcggccgaggtcggcgacttcgcgaggttccgttccggaaggcaggtcacggcctatttcggcctcgcgccgagtcagaggtcgagtggcgactccgtgcggctcggaggcatcagcggtgcgggcaacgcgctcgtgaggaagctggccgttgagggttcatggtgctacgccgcggcacggcaccagccgaagctcatgccgagggacacgggcgtgcccctcgagataaggatgcacgggaggaaggggtccgagcggctcctgcggcggcgcgaggagatgctcgcccgcggc
